United States Patent 8,781,750 (CELL-TYPE-SPECIFIC PATTERNS OF GENE EXPRESSION) - sequence listing, part 39

SEQ ID NO: 37607 - DNA, 64788 bp, Homo sapiens
gtgcgtaaattatagcgtccggccaaggccgcaaggggggcgccgccggtgagctggcgggtcgtgcggggaagcagcacccccgcgccgtgccagggccggccagcgtccgcaggtaggagccagtaacggcccgacccggcctcgccggtccgtttcccttttcgtttgtggtctgcccggagccttgtgcaaggcggggggccggcccgcgtgcgcccccacctccgggccccggcgcgcgctcggtcggaggtcgagcggggagcgtggggcctgagggagcccgccagaccctgccccccggagggcacacaggctggttctgctccccgctggcgcgggccccgaacgctctaggcccgccagcgtcatcgggaacagatggatggggggtggcaggcgcccagcgctcgctcccgtcgcaatccgggctggcgcggggagggggagggaggaaggcgggggaggcgggctcgcggggacggcagcgtgcgcgcctgccaagcctggcgcgggcatgtcccggggcaggtttggggctggcacgagggggctgaaagtcgaaacccgcaccgcagcgcagcgctggggcggccgcccagggggtgctggtttgccccagggctcagaagtagggacgcgctagatcagaggggtgttggaagaggatgaggagggagcgaccccggggcctcagagccgcccgggggggttacagcccagggcgccagaaggcggcaggggaggctcgccgacccctgcccccgaggcccgcccctttaaccccgagcttcctggggacgcgcccgccgcgatggggtgggggcggggcggggcggggcggggtgggcggagccggggggtgggaaggctggggccttcagtccctctccgcgccgcctgtgggtgcccaggaatttcaggacgctccctgagtcattccagtcaagtgcctgggtgaggtagggtggggggtgccaggaatggggaggcgctgcgctggggccagaagcgcaatgggtcgtgccagtttctggaggcgggcgacctcgcctctgaccgcaaccccagctacttaatgatccccctggcgaagcggcgcctccgtgggttctccagcccctgggccgcgggttctttaaagaacaccccccgcagcggcccgcaattgtggccttcccaaaagttacttaaaactggggggtggggtgccttatggaattttgaggccaagttcttagtattcagccttttctagttggggtaataaggtcaggcatggggggggtggggcttgggtacacagtctgttttgtgtcgcctccccccaccccacgcgccaccagcgcccagaaagttgttctccaaaaggcctccaggacacggagttacccgtccgcccattattgggcctgctctgtgtcaggcactgttctaggttcccgggacgcagctgcgagacagggctccgctcacgtggcgagggtgctgcactactttaagagttaagtggccggtcttagccaccaaggtccccgggacccccgagcagtccagccaggggctcccgagagtgtgggggtggcacctccgcggccccgctggtgtccccggctcacctggccggccgggccggggaggggcgtgtgcctgggcgggtggatccgggcgcccgtcggtgcgcgcgcgcgcgcctgtgtgtttgcggctgaaacccgacacctcccgctggctgaggtcagggagccgggagcgagccagtggcccgggagtgggcggcgttgcgtttgggtgtgtcctcggcggcgacagcagcaggtgtttcttggccggggccccggaagctccacctccccagcgggcccgagctgccgccgccgagcagccccgggtgagataagcagtttagacaaacactgggcgacggtggctccagcatgtatcagccgaggtggagctgcggggccctggcatgaaaggtgagcgcgccgcacccggccggggacggggtcctcccccctccccccaccgcactgtcctcctgcaagttcgcgggtttcgcgggggcggccgccaacggctcccgggcaacttccccggagtgttagcggcgataagagccgggagggcgggcaggcgaccaaaggccacccccttcctccgcccgcgggtcgcagcctgggaggcctggctgcgggcggggactcgggggctccgggctcaggagtgcgctcagcgggggatggggggggtgcgtttaagtgcgtgcgggctagagggcaggtaaagtggggggatgggggtggcggggggagtctccgagagctgcgggcgctggagagctggaatgaaaactttgcggcgacgcgggagggagcgaatgggggtggctgtgcgcccccgcggcaggtgctggcgacggccgaggaagcgggggtgtggggggggggggtgctcgctactggggccgcgccggttagggttcttgtcttgctcccctccccctccccgaccccttgtctcgggggagttggtcgggagggcgggaccgcagcctgccgggtttgtgacccccacgccctgcttcccgaggaagggcgcgccccgggctcggccgcttctctcctctctctccccccacccccggcggagcggctccctgcccctcccctcccccccgcagaagatggctgccccagcctcggaggtgggagagggattgcacatccgccgccccccacccgcactggcctttttccctccccggcccttcctgctccgcctggatgcgcctccccgcccccagccctcccgggccctgcggccgcgctgatgggcggcgagtggcccgaccgagtggagccgattcaattatattgcagcaccagagacacctcctcggccgcccgcccgcctctctagcaggctaattaaattcccttcatggaggcggagcgggagtggagctcaccctccctgcgcccgcccacccccagctttccgcctcccctccccagcgccgggtgggggaccaggggggcacttagaaatgtgcggtggagactcgaggcgcaggccatagggagggggttcccagatggggggaagggacaccgcgacaccctcattagatgggggagtggaggctgcgccctttccacgtggtgggccgggggcctggccgcagtgcccgtctgagttccgagggcagcgtgctggcggtgggggagcacctgccgggttcccagctgggcggtggatgccagccggagttgagtcggtttggctcttacaaactagcctttgtacaaagtgcgtttaaaacacactaaacccttgctccccgctgcggtgccttatctggggcctgaggggtagcggccacacaggttggggtttggaaacaaaaagcggggccaccaaatggaaagagggctccttttgtaaaaggcgcctgaacaaaaggcccagccgcactccgggtggaagcgaacccgcctaagccgatttccaggcggcgggggacaaaggggcagagagaaggtcttggtgggggcgttgtgaaatgtgccccctggtcggccgtctcgtcctctcctctgggattccgtgctcccgcctcccggcaggggtggaagggggaacccaggtgagcagccttccctggcctccctcggtgttgcttaagcttggggcacttcagtgttgctcaccctgtgtttacggccgcctccaccagcagggacggcagaacctgaggcacaggctgtgcctgactcagccgccacgccacaggtgaggggcccagggcgcaggctccgacggcgaagtgtgtcatcccggccgccggctgtgcagggagtcgccccgcccaggtagattcaggagcgctggaagaggccctggcctgcgagagcagcgacctcggtgcttcctaagagactttccgagacagccagccccgtgtcggcagcgttcctgatctcctgcgggccgggtgcgaggatggcttttgtcactctggcagcagacaccaaagtcaggaggggaagctggggaagctggagccaaccacggttttgacgcttggagttttctttcctggagccttgggggcggtgccgggccagagctggtgagagcccgccaggagcctccggtgacctagggtcagccctgccttgggaagggaggtcgggaagtcctagttctaggcacagtgaggctgagctcaaaacaaggaaggcaacaaggtgtccactgtggcgcaggctctgagctgtttgggacagtttttaggatcttggagtgtcagagttcaaaggggcttgtacatctccaaactcggtgttttaaaactgctgctggccaggcctttccaagcccagttaagccacagcctctgggttcctgacccgggtctgggggttgtcagagctccccagctgatcctaacgtacacactgggggtaggaacaaggggcaaactgaggcttggggccaggcgtggggcggacaccgcgctcacagcaggaagcctcctccgatggccccgatgagccctcccctccagcagtcacttccctgtctctgggggaagttcaggggctgcagatctgagtgccttgtggtttcagagcagaagccaagcctgcctgtgggctcagcatcgccggccccaggaagagccaagtctgcacagcgccactctgtggcagaccggggtcctgcacctctgagctagagattccccccttccaacccctggagtcccaaattccccttgagcccctggagcaggtactgtctgtcctcccctgctctgaaggaggcggactggggggcctttgggctcggagccccgagctgaggggcaggagctggtgcctcccacttttctggaagagtgcggataagctagagggctggctgctaccttttccctgcctccaggagctcgcaggggcttgtggagtcggctagcagggccggtttttcctggccccatttgaagccttggaattcccagcctgggttactcgaagtccaaggatcaaaccctgggatcgggccagggttggatggggaccctctctgggtagcctgtgaattgtctctgttgtggcaacagcagggtcctctgaaaccacagggcttcccctccctttcctggtgtgccgggagagctgtttttttaacctgcagagatccatgttgcaggtgacatttcagcttggtggctgtgccgaagcctggccgcctggctttaattcctcccccagtggagtctcagatctcggtggcctcaccgagtgcggtgtgggacgccgtgctgctggcttcacttccgcatgctggcctttctcccccggctgaggccacagcctgggaggtgacgtttcggagtgtcgctgtcaatgagaatttattgagctcctcctctgaatccagccgtgtgcttgctgctgggaggtgtacagacagataaaacaggagcgtggccaaaagcagccctttgcatgcctgccaaacgcacactcgggggccttttaatcttgcttctgcagctctgattccccaccagcctcttctctcacgccctcagctccagccagacgaaaccacacgccattctcgccactcctgcgtttggccacgtccctgtcctagcatgggccatcccgtctgcctgggattctcccgtctgctccaaagcccacctgtcactgaggccagtccacctgcccctcctaacctgatgcctccctcgcatccatactcccatgcccaccccgtgtctggaatcagaagttcagaggggaagtgagagctgcccccgggaggctggggcggagtccaggcctggaggaaggagctgtagatgagggcagggctggtgctggagagggcctctggtttaccttcacctgcacctaccagtcatctgtggaaagaaggggttgggctgcacttgaggcttttgtgggtccttgtgacttgggggtttctagggaggcaggtggaggaagtggggagcctccagctcgggggtctctcctggctgcacttttgaatcacctggggagctttaaaagctcccagtgtccaggctgtactgccaggcagttcaggccaaatctcggagggatgcagcctgggcatccgtgtgtcaaccctcccccccccccccccgttaactgccacgtgcagcccaagctgagaccctggctctgctttcttccagagcagcttcctagtcacctaggggccagggtgggagcttttcaatgcttggcccccctaatccagaagggccttctgctggggggagcaatgtgggtaggaattccttctcctgggaagatgggctgatgctgtttcaggagacctggggtctctcttcccacctgggaagccagagaccgccttgcttgccccggaattggatggagaaccctggtgactcagaaatggacgtctcccctctacgccacctcccccgcaggacggcgtggcacctgtcacctggctgctctctggatgtctgtgggccttgtgttaaccccaggcagaatcctgaaggtcattcttgcctggcccaggtgtgctttgagctcttctaaaggggcttacaaatgcagagtcccactggcatgggtggattcgtgttcacctgcatctctagccaggccttccaattctggaaccggttcctccagctggaggacttgacgtgtctgaggaggtgtgtgtaatagtggctttgggatcactggactgaggtggcgtgaggggggtgcgtgctaatggtgacatagatccttccactttaatcatcacgtcctcacccccacccccatgttctcatctgtaagacgaggatgcagaggccctctggcagttgagggtgaggatgagatgctgtaatgcccgccacatgcccctgacgggtaaatgacagatgcgggtgagggttgagaaggcctggagcgtggggtgagcccctgatgagtgtcagctgttactgtgtcgatcagtgcatctgactgttcgtatctgcctcttgcttagcctgtgtgacctcaggcacttgtgttctgggcctcagtcttctaatctgtggaataggaatgacaatgtcacctgtatcctgaggctgttgagggttaaagcctttattaccaagtgcccagtacagcacctgacacaggctctgcaaagccttgcggctactcctgttgctgttgttttaattagagacagggtcttgctctgctgcctaggctggggcgcagtggtgcgatcacagctcaccacagcctcaaactcctgcgctcaagtgatcctgctgccgcagcctcctgagaagttggaaccactgatgcgtgccgcgacacctggctaattttaaagaaatttttttgtggagacagggtctctcactgtgttgcccagggtggtctcaaactcctgatcttgggtgatccttccgtctcagcctcccaaagcactggagttacaggcatgagccactgtgtccagcttggctttaatttataaagttccaaggctctgttcccctacgctcaactgactcccttgcggtgttgggggtggccccttttcccaaaaagactggagttgctttttctgccctaaggctcaagtcaccacagcagaccctgccggcccctctgctgggctttaacaaccggaggttctttttaggagcctcaacgtcccctcgggctcacatgcacaccactgcccccttggtgattggcactctgggcccaggtggcgggagatgctttaacaaactgtccctcccccagccctgcccttcctgcgctcggatggtgggtctgtggccacaggcagcaatgaagggtatcgaccgcccagcttttggttgagcagtattgatgttggacaggttaagccgtcccgaaggaaaatctatatgtcaagctgagcacaagacagcttgcgagtggaggcgggaggggggtggggcgcagccttaagggccacttctaggctaaccctgagtcttatcttctgggttggggggcaaagcccgggggtgccaagcgatgccccacagccccagacgggcctggagggacggcaggcgctcttacgtggtgtgatctgtgggcagatggtgtgccggccaggtcttgatcccacttaaggagttgtctctgggatttagtaaccagatgggaaagactgtatttctgtatccagaggtgctgtggctgccccagcctatgagggtcacgccgtgggctgtgcgtcaggcgtggtggggggacgttttcaccccaacgtgctcctcctccccagggagggactgacttgctaggcagggattatccccatttagccatgcaccagggaagaaaggggccccggggatccatatcctccctgtagtcacacagctggtaattaattggtagaggagcagaaacccacaccatgattttcccactccagcctcctcacccaactcccacccgctctcccttagagcctggagagaggtcaccggctgcttcggaaggccctgtttaacctgggctgcttatggggtgcggtggctcaagcctgtaatcccagcactccaggaggccgaggcaggtggattgcttgagctctgcagtttaagacctcctctctacaaaaaataaaaataaaaataaaaagaactggccaggcttggtgggatgcgcctgtggttccagctactcaggaggctgggcagggaggatcacttgagccccggagctcgaggctgcctgcaatgagctgtgatcgcaccactgcaccccagcctgggtgatagagcgggactcttgtctcagcaaaaaaacaaaattaaactgagctgcttcacccagtctcgggatgtgagtggattcttccaactgaattcccagtgtacatttatctttgagtgtatttttgtaatgtttttgcatttgacatgtggtattttttccattcacttaaatatacgaggatccactagacagccgatgctatactgggtgttgaagacacaaagtggaatgcggttcaagcaaaaattctcagccagatgggagcattggagagacttccgcctcccagaggctgccgatccacgcggtcgtctctgccgcccgtcgggagggtgcggttagtcaccccgtaacagataagaaaacagggtttcggaatcagcccttgtggaatgcctgggctggcgccccactcagccctgcatctctgagctgttggggaacccgtttagatggtctcagccttgggtctctgcactgttctcagccctgggtctctgctctgttgaggaacccgtttagagggtctcagccctgggtctctgctgtgttggggaagccgtgtagatggtcttggccatgggtgtctgctgtgttggggaacccgtttagagggtctcggccctgggtctctgctctgttggggaagccgtgtagatggtctcggccatgggtgtctgctgtgttggggaacccgtgtagatggtctcggcccggggtctctgctgtgttggggaatccgtttagatggtctcagccctgggtctctgctgtgtgggggaacccatttagatggtttcagccctggatctctgcactgttggggaacccgtgtagatggtcttggccctgggtctctgccctgttggggaacccgtttagatggtctcggccctggatctctgcactgttggggaacccgtgtagatggtcttggccctgggtctctgctgtgttggggaacccgtttagatggtttcggccctgggtctgtgctctgttggggaacccgtttagatggtcttggccttgggtctctgcggtgttgggggaacccgcttagatcgtctcttgaaaaaggtttgtgtccaccgccccccgtgctggggtgtgcagggagtggagtgtgcgctgagatcgtatctattttaaatcaagccgatgtcctggcgtccttttttgaatacagtcttatcgttttacaacgtgttgtttccacctaaatgtacatcttataagactttataggactaaggaagttaatccatccttagcagggatgccagacccctggagcctgtcacctgggcacagggaggacattttaactaagcagctggtttccaggttgagactggttgggatcctgcggagtgactctgaatccactaacagcaggactgtgtctgcttggatgctggagctggggtttctccagccacggctggcagagtggaccctggggttttgtgtcatccgtgtctcttatccactggagagactgttgtgttccttctgccagattacccttgaagaagcaggggaggggagggcgctccggcccacctctgcttacctgcccacctcgggctcattcttcccaccccatactccccatgcagccttcaggacaggagacatagcctggactacttctcatggcgcaacaagaactttgttaccagtcttggtggcagagactgccagctcccaacagccaggtctgcacctgactgggaaatttactagttcctcactgggattctggaggggcgtgtgtgtgtgcatgttgagaattacagaatcatttagacttaagcagtcagccattcagcagttgacaggatgattgtggccggaaaaggtgaccagtttgtcctgtttggtggctgggttggatgagggagtccaggactcctggcgcatgactgttatgggagcttttcctggacagctccattccaaagtccatcttggctgagggtgcttgttggttttttccagtgaggcatttagtgatgtctgggcacagcacttggggctttgaagatgggagacgagtctggacgaggaaacgccattagaacgtggatggttctgggccctttctttttccaccctgtatttcctctgtccaggcaggtcatattggggagggtgttcatactcgtgggttgccacttagggaactctgtgctgtaggagtttgtagcctgggttcatggatgctacacatcttcaaacacacgctcccacagggtttacagataggctcttcgaacttggtaaaactgtatgtaacatgcagtaggtgtattttcctggggagagggtctggtccgccactttgaaccatcttgagagtggacctttttgcaaaggcggatgtaactgttttatgacttgaggggcaagtcctgacttggtgagcttgctttgattcaggggagacctaccttggggttgacacacgccagaattgtggccttcataggcgtcccctgaagctgagcctgggaaggggttgacctctttctgttacaccctcatggagttaccgtgtcgatgacatctgagtggagtgtctgtgctgagggttgcagctgcagctgccgcagggctgttagttgctcagacctgcatgtacttggagaattgggaagacctggtgttgaggaagctggctggcctgagaccatagggaggggaggggtgcagactctggcaacctggagagttagggacaaactaagggagaagtgccactcatggggctgtggtttttatggcttagacttttcgggagaaactgggcaccttctcgttgacttgaagcctcctattttaagacattgcccattgattctcgtttaaacaacacagcgtgatttcaggtcaaataaaaacaggttgaagggtaaaaggctggccccttgtccactcctttttttttttttttttgagacagggtctcgctctgtcacctacattgcagtgcagtcgcgcaatcacaactcaaggcagcctcaacctcctgggctcaagcgatcccccacctcggcctcccaaagcgctgggattataggcgtgagccactgttcactgaccctcttgtccaatcatttgcaccctctctccatggtactgacagggaaactgaggctcaggccatgcggtgccctggaagtccgcactgagctgttgggcatgagtcagcctgggcccacccccgttccccttggttttccagctcaggaccaagccctttttgctctgcccccatagtgtgttccctcgaggccccacagctctcagccttcagtggaagttcaggctggctgagtgggatgtgaggaccccggtgcctgcaggcaggcacactgcgccttctgacttaaaggcgcccatttctgctggtgtgggcgtccgccctgttggagggaagggacgttttccagtcatcaccatctccccgcctctgaagctggagaccctggacccctcttcgaaggccaggtggccctttctgcccccgcgccacctcccctgctgcccaggccactcctggcccctgtatgattgcttctttgagcacctgttggtgtccagctcctgtacggcctggtccctgttcttggctgtagactaagggccctgtagataggtactggcactcactcggtacagaagggacaggcattcataggagacgtccttggatcctctctccctcccacttacctgagggagcttgttaaacactcagcctcctccacactggggagaggagaggggcctgcatttcgtgggtccttgtgagcaagcgtctcagcctcctcttcctgctggcccatgccccccggccgccacccgccgtcccacggaaacttggagacctcagtgcccgccctggggtgggggagccaggttggatttccctcctgggcacctctcacctgcctggacaccttggacctcatccgttcctctgcccagggcctctggagggaggaagggctcccacaggagcaggtgcaatggaaggcagcctggtcagctctggtgccatgggctacacagggcacccgggggcggttccggcctctagcacaggtgccctctggctgagagctgtgggaaagtggggctgggggaggcctcgagtccagagccttcctattcccagccgtgtaggtcccgtccgtaaaacgggtatagcactagggtgggcacccaaacagccgccacagggtgagagctgccacagggaggggaccccaagtgacgccagccatttccaatctcttcgcacattaaagggaagcagccggcaccatggccaggacagctgggtttccttccggctcctgagcctctacatgtgacccgggttgagggcgtgaatctccagcctccgttcagcctctgtaggctgggagtgagcatcccactgtgtggaataaacaggtggagagaggcgcctgggcaccgccaggaccactgcctccgggaagcagcccatggggagaatgtgacaagggaccccaggtaccgccaagggcacagggtggcggaggggctgggaatcggccggcatgggtgagcccccggctctgtctcagctgagctgtgtggccccagcggcctgtgtcactttgctgttcgcagctttgctttctggggtctgcttacgtaaagggaagtaagggtacaggtagccggcgccctgtaaaagttgccccctggtaccttgatcgctgttggtgctgggcaccatctcccagagtcacagctctggacaccgaccccagccttgactcagggccccgccctctcccttggtctgtcgtgcccctttaggaggccgcctccctgccgaggccaggctgccgcccgcatctgccagtcccgcccttcccgccgccctcctctccagcccttcatctgcccggcctgcttctccgcacacacagcagccgcttaggataatcgcgtcaaatgttgctgccatctgttgcctgacttcccgtccctcgcctccatccgggaacctccgggaccagtccgtggccgtgaacctcagtcgcaggaccgtcggctcctaggaggctgctgtccgcgggtccccagaatgcaacctcagcatccagcgccttctgtgcagagcccccctgctgtcctcaaaactgtagtgtggcgtccaacctgggaagcccctccaggtgacctggccccccaggtgacacccctgggattgacctgctcccttgcactgtccaatgctgttgtgtggacgtctcccgagagctctgcaccccgtgttcttctgcagaacacggcctcctttgtgttcccagcatggcagtgagcaagagaaggctggggagaaaccggggtggccagccccctccccgtcacccccattcacagcaggactgcagcttcaagggtgtcgtggggctcgggcagaatatggggttcagggtggctgctgggggccctaggcattgcttgggagatggctcattgcgggtggctctacgtggttgaccggggccctggagggcagcgtctgggggctcctgccgtggctcagtgagcgtggcagaggacaggtctacacgggccaggcgctgtgttgctctttcctcctggggtagggactcctgtggctgcacaggttgcccccgcccacctgcttgtgttttctcagcccttcttgttccaggtcaggatcctggccacctgcaagggctgtcctttgccttagccatgagtgatggccctggccggtttctggggcatagaccttgggaagcaagtccagtatggggacccagggcagcctgggggggtgtttttatttggaaaaaaaaaattaaggcacaagcaggctgcccccatgtgtctggagcaagaagacctctccccagggtctccccgccccctcccttgcctccacccccaagaaaaattgctttgtgccactgagcttggagcacgtggagggcagatatgataatgaatttatcatgaagccgcccaggctcctgcgatcacgtggtgcccgtgcagcctcagccgccagggtctgtagcagggtgacccgacctcgttagggccacggaagcttcgcccctttgggggagtggggatcgcgggggcgggcaccagtccccgagctgggggacgccctttatttgttcacaaacatttctttctgcggtaatgaaaaattaccaagaggggtgattagagaatccaggtccagattgtgtgtgcggggcctgaaagtgaaggcctgctgggcccagcctcacggggtgtaattaccccacggggggctgtcagggggaaggggcggattggtgcttgaaccgggacccagcagaaaattcacctcagctattagcttgtaattacagagcacagagggagcaggcctgaggtctggtgccggggaagagccgggatgaaaggaagcagtaattacgggatccgcgggaggccgggagggcggctggcacgctgattaataagcccctccagcctcgtggggagggggagcgaggaatgggacaccatatttaatggagtagagaggcctcccccctcgtttaaatcctgctgttggagcgtttggacagcaggcagaccggtttggggtctgttctgaagaactaagaacgagatgggttccggaaaatagcagctcgctgggccagccagccttgtccctctccactgggactttgcttccttttcttcttgccttttttttttttttttttttttttttttttttaaagcattgtgctgcttctgaccctattagaaacctagccagagaataggagaaagtattgattcaagaagcggtgctttgttacggggggcggggggtgggggcctcacccgggggcggtggtctttgcttccccagacctttcctgtctgtgaaatggtgggacctgagggttttgcggtgctgtgggctgctgcttcattctccgtttcctgccctctggcttctggcagaagcctctaggttctcagctctgccaggcagactgtctagaccaggtgggttctttctgaaagggtccagggagcagacagttgaggctcacatgaagaaggggtatgtcccctggcccctcagtttgagggtgcccagggccgaggggcctttaggtgtctggctgtggcagctttttttttcctgggggtgggggtcaaggtggcagctgacagtggcaggaagggttgtccagagcagcacgtgatgtaaataagagggtgggggcctcgcagacctggtccacctagacccctggctcgttttcgcctgctgagctgcacatgtcaagagagcttgtacagtgcggagacagcccccggccccccggccccccggccctcatccgtcacaggccttcacacggtggagcgtattcccagctgttaggataatgaatttacatgagctgataatgtagacaagaattcagtcaatgtccaggagcgcagaagttaataaatacctctctaatgagggcagcaggggggtgtgctctcccagggcctccctctccccgccatccctgtgtcccccacggacaccttggcacctgcactgacctcagccagagaacacctgcacgggaggaggcccgcatcggtctccctggggagggctgggggcttcgtgccgaggcctcgggggcagcagccttgaagtgatccccaccaggcctggaggggcaggaggcacgtgggccctggaggctgtgtccattcacagcaggcccagggggacccctccaaggatctcggggttccccggctcttggcctcctgtcctggcctcaagggagctgcgcccggctgctgcggcccccgccccgcctgcccagtgcacacatactgaggagcagcgctaattttagattccccctaatgaagccgctcatttggaattctattttaagtgacctgacatcagcagagccgcttcccaggctcacagctcctcaggagcctgcagctgacaccggggcagggatgctgcccgcaggggacccccagggacccagggagactgtacctggggctggagggggcccatggggcccggggagcagatattgggctttgtcagaggccggggtagggaggttgctgtcaggatgccagtgggctggtgatagtgacactgaggtagcctcagacccaggcattggagggagcaggcagagggcctccctggtcaccagggaagggctggggagctgtgggtgagggctcaggttcagactcctgcagggacaccccagttccctccacctctgccctgtggctggacagccccacgcttttgttggcggtgctgacttcgtgccgtcgagccgccatccctttgaatgtccgccttttaaaagcctggttcactgcagaaaaattagaacatacagagagagaaaaaggatgaaagtgaaagacatagctcttctcgttgccatctgaagacactgccagtagcctcaaggtgtgtgcgccatctggggtctggtctgggactcgcgccatggcctctgtgtaccactgatagggtttggatgtgtgtcccctccgaatctcatgtggaaatgtgtcctccagttttggaggtggggcccagtggcagtgattggatcatgggggtggatctctcatgaaggggttatcaccgtcaccttagtggtgagcacgctctcgcaagatctgggtgtttaaaagcctgggacctccccactcttgctccctctctcaccactggatgtgctggcttccctcgccttccgccatgattagaagcctcctgaggcctccccagaagcagatgccagcaccacgcttcctgtacaccccacagagtcaggagccaaaataagcctcttttctttatgaattacacagcctcgggtatttctttatagcaacacagacagcctagttcagccacccagcccgtgcctgtggctggtggtcatagcacatctgcccgggtggccagccagcctcatgaaggccacaggagagagaattggcatctgctcccagaccttcagggcgggtcacctggaggtgaaatgaccatacggtgccccacgttccccttttgcggtagcatgtggtgtggtttgcagggcatagtcagccacccagcctgcaccggagatcggcccctcctgcggccctggagcaggtcgagctgggccctggctggcttgtcacatgggcactgtgctgaggtcatctcagccctgctctgcactggacctgggctccaagcctgccttcgcctatctgggaaataggcccagtcccagctttctcatagggcggccaagatgtagagtggctggctctctgaggaatgtgggaaagggggatgggggatgctgatggtctctggcatcgaagggacatgttttggagactctgggtgaagatgcagagtctctgtgtgcagatagtttcacttcttggctttctgatggattgagggggcggcctggattaatagagggtgtggtgatgctgaccgtatcagttatctagcgttgtgtgaccaactgtccgcagctcagtggcttaaacacaaaacctttgttatctcagtttctgtgggccagggattggaggatggcttagctgggtggttctggctcagggtctgtgatgagcctacttgagatgttggctggggctgcggtctcatcagaaggccagcctggggctggaggattcattgccaaggtggcttctcacatggctgttggctggaggccttggttctttgaaatgtgggtttctccatgacctgcttgagcatcctcatgatacggcagctgacccccctccactggagtgacccaagagggccaggaaggaggtgatcttaccttggcagctgcagactgctgcttccattatactctgttcatcagaagtgagttgctcagtctggcccacgcttggggaagggaattggtctctacctcttgaaaggatgactgatgaagactttatagacattctttttattttttgagagacagggttctgttacccaggctagagtatagcggtgtgatcatagctcactgtagctccaactcctgggctcaaataatcctcccaaacagcggagattacaggtacgcatgtgtcgtttcagggtaatttacagagacagcgtctatgctgcccaggctggttttgaactcctggcctcacgcagtcctcccacctcaccctcctacttacctgggattacaggtgtgcccaccatgcccaggatgaatgtttttaaccattacagttcaacgtatcttagctgtgtgtggtgcgcgcacatgtgaccattcacgccttctgatcgggtgccatggttgggccgtgtactgggcaggtgctggtaatgagcagtgggggcccaggaagccgggttcaagtcctggacatgctgctcaactgactgaccttggaccaagcttaggtcatctcctggtctcggtttccccatctgtacgctaggcctcttgggcttgggcgatggctgtgaggggtgggacacaggctgggtggtgggtgacagttcagctgctgtggcctctcctgggctcattgtgaggctgtcttgagaggtgcccgactggtctgtgtgacttctgagagctgctgcagtatcccctgggggggtggtctttgcgttccccggggccctgctcctgtcttccaggcagctctcctagcgtcaccctcctgagtgcctcgttgggaccacgaggacctggttcattgatgtccgtgtgggtccctgtgagggtggggctctgtcctgtgccacttcgtctttctagacattccctcctaaaaacccgcagcctactcggtgtggtgctgaaggtgcttcggtgacagataggacccggaggtcctctggactgcccatggcagcccctatgttggccatgtcctccagtgtcccctgcaggcaccaggacaagagctctggtctcccccatcctccagtgtcctgtgggtcaccttttcccggccaccggccttttggggtcacggggtggccctctgccgaaggtgtgtgggctcgtgggcccagggcacggggcttgtgggcagggtgcctgccagcttgacaccatgtgccctccccattgtggctccagtggggtgagcatcgcagactcagagcatgggtcccatttgctgagacacctgcgtggccttggctggaccccctgcctgctgggactggcatctgcctgctgggactggcatctgtcctcgctggctggcatgctgtctcgtaatggccctggggtgccccacaggctctgaagcccctcatgtcagttaccccattatgctcaggggagtgacctcatgaggtcagctttgctgtgctgttaccccgtttggtagatgaagaaacggaggccctgacaggcaaagtaacttgccccaaaaggttgttcagccagaagcatccagaagctgggtctgagccacaggcgcgttttcatcgcctccaatggacccgctgcgcctctgtgcacagggagaggcactgatggcagcccggtgcgggggacacgcagaggccaggcccgccttgggggcagcgtggctggcggtgcggagcagagagcagctggcagggttcaggctggccgaggacgggccctcattggcagcccgcattttctggaagtgaggctgccaggcagagcccccgccctcccgcttgtttggatgtctgtgccgggttgaagcggccttggaaaggcaggatgggggtgcaggtccccctccacccctggcccctccagaaagagccaagggaagacaggctaggtggggcccgctgctgcagggcacggccacggcgccacctggctgttgcctgccatgggcatggggctctcaggggtcctttgttcccaaggtgtgagctctcactggggagaacaaacgatgccccccgaactcgttcccgcctctctgttctctcatttgcagccccctctctcaggcagtgcccccagcccttccctcagtgcccccaaagaattattttctccctacgtcccctctatcaggagagggaggacttggctccctgaatacatggccaggactcacggcctttggtggcaagttctggggatagcaggtggacaaaggaggtcttgagggggtcctctccacgctgcctccgagcctgctgtcccatggggacaggttccaattagacttgtcaatgtcacttagaatctggcagaggtggagtgggctctggaggccagggcagcctcttccggggaggaacctgggggcccccttgcccttaccccataggaagtgcacagtccgcccctcttgtgtgttgccccccggatctctgtgacaccagccccaccatgtgtggccccagcgcccccccgccccaagatgcatccacagggaggaagccgggaccctgtctgtgggtgatgtaggggtgggggcgtctctgcgggggagggatgttggtggaaacattttgaccaggttgggcttttattgattggacacacggggtgggcggactgagggcttgtttggaggtggccatgtcctttccccagtggttctgatgtcaccaggtggctgcccctgggctcagacctctggtgccgccgccgccgccgctgtcaccactggccgggagggccaggtcagccgttgctgcgccaggtcggcctgaacttggccctgggaggaaagagggttccaagctgcaccgcggtttggatttgcggttttctgtttttagcatctccgggcagactctgtgcccagtaaggggccacagtggggtctgcagtgcggccgtgttcttccccaccgctccctgtcagcctgcctgtgtggccccatctctgggacccctctcagacagagacgcacagggtccctgagtggcggggaggccgggggtctgccctgagtgcccgcgtggactgggccgagttggggccttagtttccttttctgtaacgtggggcagaactcccgccagtcttctgagggcattgccatgcgtgcctggcatcgtgtgcttgtcgcgtcagtggccacagcagttgtcttggttcccgtcgtccctgggcctctccaccagcgtgtttctatcctgaggatgcgggccgcacgcctcctccgcctgggcctcagtctccttccccacgccatttgatggtcaggggcctgttgggtgatgcgtgggatcctccacgacctgcccagcctggactgccctggagaggtagagggacagtgctggcccaagccgttcagcatctggggtcctgggggcctcttgggtctgtgccgggttccagctggactctggggacggggtctgttctctctgcagcgctggctctgtcctgttcttgcttgtcctgctggagcccccggggctgcccctgctccctgcctgctgctgctgacaccggccctgccgaccctgctctggtgctgggcgctcctgctctctgggtgacctctggttcttcttttcctgtttcaggcatgagccatgagcccaagtccccttcgctagggatgctttccaccgcgaccaggaccaccgccaccgtcaaccccctcaccccctcgccgctcaatggcgccctggtgcccagcggcagccccgccaccagcagcgcgctgtcggcccaggccgcgccatcctccagctttgccgccgcgctgcgcaagctcgccaaacaggcggaggagcccagaggtaagggggcccgccaggctgcgcgtggggggagcggcggctcccgaggccgggactcagcctcccgcctgcggcgtgcacgctcacagcaggtctcgtctttcccacgccgtgtgctctgcatggagcaggcagtgctggctgagctacagaccctgggccagtccgcctgccccagcacctccgctttgcctctgtgcttctgtctctcctgcctctgtccttcctcggcccccggagccactgcaggggtgtccggatgtagcgaggtgctcctaccagctctgtgacttgattgggaggagggtgggtgccctggaccaggggagccccaagaggctgcagagggagagctgggccccagtgctccccaagtggctccttgcccaggttttgacactccctccagaagtggcagagaacatggtgtccctggaaacacagtggtctggagcgggggtctctggcacagctgaacccaccactgctcaactccctgaggcagagactgtggggagcatagacaagcggcccccggggtctggagccttggcttctggtatcacctgggcaggacctgctgtgtgaacctgggcacgttgctgatcctctgagcctcatttttcctgtctgtgcagtgaggctctaaagacgccccctttggctctggctctggggtactttttggcgcctgcgatgaccattggcaggggctgctgctggcacaaatggggaggggcagtgggcggctggagctgctgggggccttggccatgtggattctggcctcggacaccctttggactcgctgctgacaggcgggggggctgaggaaaccgggaccccagtggcatccgcttcattcacctccaaggcccacgggttaagatccgggtgccagggccctccggggtggccacagcaacacatgcaggagccatgtccgtctttacattacccgggttccagcttggcagaggggacacctgccctgaccagggcgggctggggggacttctcatttctgaatgtctccttcctggatcctttctgctgctgctcgttggagaatggggggagtgtgagaggacacacctgacattgatggatggggggtattggcccaggagggaggcccgttggggtctggtttccgtaccaccagggggcagcccctcgcctcctggctcttcctggcaaaccaggcacaggcaggaccgccagaaaaccctccacgcccttggcaggggactccctggccacacctgagcgggccaggttgcatgggccccacctgtgtcaagaggccggacagctgcaggcaagatggctcagggggaagcagactgcctgcctggtggaggcatcctggactctctggggcggtgaacaaggcagctggggacagaccctgggaggaagctgagcttggagtcgagactcgggctctcctgagaggggtggagagaagcgaggtcagagctggcccagctcctgctgctgcagttgtctttttttctcagcgtttgggggcaggagaaccagggctggtgagggatttccgaggccacgggcggcacgtgactggcgctggtgctacctgggctgggttatccttgcatcctgctttcatccagcagctgtgtctgctttggggcctctgggctccacccctgggtaacgctgcagaggacgtggtcaggaaagggcaggtttccctcctcgccaaggaaggtggtagagaggtgttcagactcgccttccctccctgggcccagcagcggccgtgggcgtcacagcaggagcctgctcacagggccgtcgcttcctctccgctgccccatgctgctggccccagcacttggtttggtggctcggccagcgggtggcctgagtgccagaggccgctggtccccactggccaggaacaaagtgccgctgggcgcccctggcgggaggccagacaccatggcctcgtggccctgctccctcccagctgcaacctgggcactgggaagggtcccccatggtggatgccccccaggaaagatgcccccggggtggatgcctgggaactgaatggcagagggtcgggagagcgggcgagcagtgccactgcctgagccatgtgcccatcggttcactcacccacctcaccccctattgagctgggaatgccaaggtttgtggggctcggagtctgcggatgtggagcagtgtttgggtcctggaacgccctcagccaggcctgggccctcgtcgcccccacccgttttgatgaatctccagctggtcacccctgtcaggccttggtctggatggggagggactgggtgactcgttcctcgtgacctcagccactcagtgcacctggtccccattctcatggagtcacccggaccctgacctcacgtttccccgtccatggaactggccggcagccctcccgggaccctcgggcagctgagaaggccaaagttcagagaggacaagtcgcaagacggcagccacagcgggtggggtcgtgtccgtgtcccactgctgctgggccttcccgggggggggctgggagagccgccgttaggacagttctgagctggtggtcccggcggtccctgctggaaaggaagcccccctcacccctagcaccactgccagtggagcagggagctggcgttgggcgcacaaaagggtctatgcctggctgtcagcacgctgaccctgcctccctgtgggttgtggagtcctggatgacagtggggacatgtggaccccccagctcccctgtgctacccccccagctccctggtgctacctccccatctgcgccagagggcagcagggggaacctttggcggacttggcagtgggaggggtttgcatttcttatttaaaatttttttagttacaattcacatgccataaaattcaccctgtagaagcgcatgatttggtgattttcctacacagttgtgtgaccatctaattctagaacatttgggtcacccctaagagaacctcggttgcatttgccgtcagctcccacgccctcccccagcccccggcggccgctgtctgctttctgcctctgtagatgtacctgtgggcattttgtacacatgggctggcgcggtgcgtgtctggaccctgagcgtgacatctcctggtccttgtgggccatctgcggcgtgacagcccttcctgcttctcgtggctggacgacccgggtcgggggagctgggtggggccacgaacccgcagctgcctttctgctccgtcctggagttggaccagtgagggcctccccaccttcatcatggcagtggctgtgcccccttgattgcagcagtggctatgtatcgagtccccccttgatcgcggcagtggctatgtattgagtccccccttgatcgcggcagtggctgtgtatcgagcgcctgctgtgcccctggcgggctcgctgtgcttctcacacacccttcgcctctggtggatgagaactgagcctccggcttgcccgggtcccacgttgtaagtggcatggggaattccaatccccagcttgtgcctgagactccatagacccctgccccgcaggtgtagcctcctccctgcagaaagggagaccgggcctctgtgaaagccacacctgccggggagtggggtccctctggtgcctgccaggtgcccaagagagcaccaagccccagcgggctagcggctgagctggccagctcagcggcccgcagccagggctgcctcctggcgacggcacgtcctgggcagagggggcagggatggaagcagggcagctcccagagctgcagggggaggtggcaggagaggtggcagagctggcgcacccagggaacagcagaggctgtgctgccccacgcggcccctcctctgggtgccctgggccccagccgcctgcggcaagccttctcactcaccctgaccctcctctccagtgcacgcctgacgacttctggaagtgcctctcggttttcgccatctgactgcgattgcctccgcgtctctcctctcattgtgtctcaagggtgtagtttaaaaattcaattcagacgaagctgtggcatgcgctgccctgggagaaaggctgggaaggagaggaagaggaggccctcgctgggatttatttttctggaggcgctgagacgtcttctcttcttcaaagctcagtcacccgcccaccagcgcgggccagacacccttccccagggccagcctgaccctttaacctactcacctactcactgccgaggctggggcgctttgggcaagggcagacgcttgcgaatcgccgatgcatgccccagcactttccttccttgctgtgtgatccgggcaggccgctttgcctctctgagcttccactttttcttgggtgaggagcaggtctctacctcatgaatcgtggggactgggtgggaatgtgccacagccgggaatggtggcatgagtgtcaatgcagcaggcctccaccctggctcccacccccgcctccccttccctgccccccaccctaatgctgcctcctttcaccttccccattcttgccacccccacctcctacgtgcctcccctacccctccacccactgccaccccttcccctgactccccgtcctacccctgtgacccccatcatctgccctgggagggcgtgtgcttccccggtggggttggaaggtgtgggtccgccatggcttccccccgtcaatggctctgggccgggagcctgcggtggcttcctctgtcccagtggtgcagggtgcaggcagggccaagtggctgcctgttggtcttgactttctgggagaaatggggcttggagtgcccgggccccacgcagaacattctagaaggaggctgcaggtttgggcgtgatcctgagttgatcctgggttgcacccccagccccttcccagcgaccggcctgggctgcagtctgagccgaggcgtccctgaccctgttctgccctggtggctattggtctctttgttcctcccacattgtcccagccaccaaagggacgtccccggggccgcccagccctcccttcgacgcagctgggccagctcccgctgtagcccagactcctcgggtggcaccgggtccttgggtacaagcagggacctgtcccctcctcggaatggcggcctggccaccgcctccctccctgcctctcctaccaggacctcttctgcacagacacccaaccacccccataggcatctgaaacctcagcctaggagtcccaagactggggggatgggtcccagccctgtgtcccaccccctgcgctggacagattctgactcccctctaagcctcctgggcgccaggcctagcctgccttgcgggtgtgtcgggatccccccatcatcccttgtccttggaggtgcttgttgactgactgaataagaggtgtttgccccgagggtgccccgggaacgcctgtgcgtggagccaggccctgtgcttccagctccccagctccacaccctgaaggcagccctgagccaggctggggtgtgacagctgtcgggcctgcccagtgtctctgcagagggcaggccgtggagcctccaccgccgcccccactgctgtgtgacgaagccagggctgctgccaggcaccctcgcaagctgtgtggcatctgcttgccgtgtgcagcaggcggcagcctcccgcagggacgcagcgcccgtctgccaaggcggccgggggcggaggtacggggagccttgcgtgtcctcagctgctccaggaggcacaggcagcacctgggaccaggcaccccctccctgggaaacagttgggggcgatcgtgctgcgggcctttgctctgggaggccggcgctttgggaacagggtggctccagagccttcccaggtgggctggagagccgccgtctggaggacagttctgagcaggtgctcctggctggcgaggaagccccacctcaccccagcaccacccatggtgcagggagctggggttgggcgcacaagagtctgagcccgttcccaccccgcctccttgtcaccagcccggtggccgggactcatggcttccctgcccacacttcgctcccttaacaccggccgggggctcatggtacctgccctggaagctgccagaggcctctccaagcaggtgttggccgctgtgttacctgcggcaggggtggcccagccacccatagcccggcttgggccacagggacggggccgacaggtggtggcagtggggctggaactgctctcttgtcatcgaggcccgcggggccctgtgccgccttcccctggtggtgtctgctggctgcctgcctcgtcttgtcactggctttgcaggcaagaggggaggcagatccggttactgtcctgtccctggtgccacctgaaaccgagatcccagctgagtgagtggggactacgtgtgcggggaccacggagcagggaccacagacccatcctcatgagctgccgtgggaatgcttccaccgtggagccggcctgggcgggggagaggctccccctttctgccgctgcctcggaaatctgcctctcaaagaaaacagcaaaacaaacacggaggaaggatcccgcctggcaggcgcgcctcgcgtgggtgtcagtctgcggcggcggcggctctgcaggcgtctggagcccgtctgtctcccgcgcaggtgtgagcgccgcgggcgtcctcatggtgcctctccgttctcctggcccgggggccagagggctggtggtcaggggaagccagagccaaaggggagcaaggcccacggagaggaccccaccacctatcccgaccccttctccgcatagcacagtggggagccctgggcagggtggaggagcccagtacttggcgtgtcagcctttgggggcctgtcctgggataatggaggcaaggcctcccctagccacgtggacataagggtgatttttttccggttttccctgatgcaccctgtgcctccctgcagcccctgtgcccgtttcttcttcctcgtcctaacgtcccacctccctcagggtacctgtctcagctcctttggtcccacgcggactctcccggctccatccggctcccagggtccagcatctaagctcacgctgttcagcacataatccgcccccggcaaaacgcatctccagctagaaacccgcacctcccgctgtcagtttgggtttgatgactgtggcacgtgatggcagggtgggcatgggagcccgccactggctgacgcccccccccgcccttttgcagctgtgaggtggagcctcgttggtggacgcaggccgcgggtcgggagagccctgccctgggagccttgtagggcggctgctgctacttggtctcctgcttctccctggaacgcagggggtcgcggcgtgacttcagccttgcgctgtggtgtgcctgctgtcccgtgtaccagggctgcggtgactccagaaggtttcccagcctgttcttgtcacttgtgcgatggggacttcaccttccagacccgcaccattcccagtgggtggggggctgattggctctttcctctggggtctgctattcccgttccactgggcagatttcaaggaaagtggctggggtgactcagctcctgtcccacttccctactcactggctggcggcttcctgtggctcccgtgggcctcctaggccaaggggctggacctcctctggccgggctcctttccacatccatgtcgccacaagtccgcccagggctgggttcccaggttttgggtggaaacaggtcggtaggcgaaagtagaaagtggaggagcagccctggcagacacaggctctgtggacctgccccgccctccctccagctgttccagcctacaccggctgagggcccagctggcatcgccgttggtgggtctgctccagagtcatggcacgtggcacactgagtctcctgctgagtggactctgcccagagcttttcaaggttgagctgggagctgagcatgatgctgcatgcctatagtcccagctgctcggaggctgaggtgggaggatcacttgagccctggaggttgaggctgcagtgaggcatgatcacactgctgcactccagcctgggtgacagagagagaccctgtctctaaaaatattttgtaattaaaaagaaaattttaaacactaacttggggacagaactgatgacaggaagagcccccaggttagcagacacacagggtcccctgggttcccaccctggccggcacctgcccctgcatggttgaaagcagggggcaaagtgcacctggggaccctccttccaaggggctgagacaggggtctgtcgctcacccatctgttcaagctgcccctcacctgtgtctccatcggcagcatgggctaggcatgggctgtggacaccggagccgtcccctagggctctggccctgctaagctctgggcagcccccggccatggcatctcacaaagacgttccagggaccctctttagggaagcacgtccggtagttaccgttctgttctctccaccgttcccctgagcagttgcagcggggccgggccctggggtgggtcggggccgtgcagaacagcggctgggggaatgcctgagccgagctcggctggggagtctttacctctccgggtgccctgccctcccctttccttccatgctcgctgctggcctggtcagggcctgtggctttggggcctgaccacggtgaggccacgcccgcctcggtctacagtgcgctggagagtggtcctgtggcgtggcccccaagcgcctcttaaagaccgatgactcttcagggggtgccggtggtttttgcctggcggggtgggcctgagcctgggtggctgacaggtgctgctgtggcgctgcggtcctgtttttgccctcaatacactccctcgctgactttggggtgtcagctgttaattacatctgcccgtgggcctcagcgctaatcttcgaggtcagacagcagaggtgacgcggacacgggctgcctcttgtcatctccaatccagatccgtttcattgacttaactcctggctgaataccgccagttaattacagcaatcacagaccttcctgctccagccacgcggtgagaatgagggttcgagggccaggtgccagcctcgctaatgggcctggcgttgtgggggcatcgatcgaggctgagctggctggtctgatgagtagcacccgccagcggggattaggccgctgagtgtcaatggcctgccctgccccagagaagctccccacccttcacccacccctcttacttcctcacccgcgcctctttcttcctcacccactggtgcttagaaacgaggctcattcagagactctggagtggcagctgccttggtcatggcaaggggtctctctgggaggtggggttcagagggatggggcagcatggggtctggagccaggcagctccaggtctctgtgcatccccttatggcatgggctataaggttctccccatttgtagagttggggtacagagaagtctctgaggttcctggggcttggcacgtggtggggctcggaagctcctgctcccagctccccactgtccggtccccagggaggacccacagcccacctggccattggccccaacttttcccctgggcagcaggagcccggatcatgagctcttggcagcctctgcctgggtggggtggcggctctcggtgtgttggttttatttcctttttcggctccacagcacaaatgtccacatttcccctactcacagctactggaatctagatgggaacaccctgggtttgggccgggtgcacaggagggctttccatgaagtagggtggtggggcaggcaccgttactcatgcctgtaatcccagcactgtgggcaactgaggcgggaggatcgcttgagcccaggagtttgagaccatcctgggcaccacagcgagaccctgtctctaccaaaaacaaacaaacaaacaaaaaactagccgggcctggtggcacgtgcctttagtcccggctcctcaggaggctgaggtgggaggatcacttgaacccaggaggttgaggctgcagtgagctgtgattgcaccactgcactccagcccagcctgggcagcagagtgagatcctgtctcaaaaaaaaaaaaaaaaagagtgttgggcacagtactgttgacagcggccacaaggtgggcccagcctgtatgccaccagctgagggacggaccagtaaggagtgggtggacagaggcacacagtggactgtcacttagccgcgggaaggagagattctcttaggtgctgcaatgtggatgaaccgtgaagacacggctcccagtgagaggagccaggcgagaagggccacgcggtgggattcccttgatgtgaagtctccggaacaggcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgcccctgaggtgaggggcgtggtgccccgccctgcagccagcgtttcccctcctcaggtggatctagtagcccgccggcacagtgcccagtcccaggtgttggcccggtcgacttggggtggtggagttctcagggtgtgggcagtggttggctagtccatctgggggtctggggttgggtcacgcctcaggggcagcagccctcagcctcattccccacctgggccagatcctggtgggtgggagcgtgatgaggtgggggccttgccttgggcagttcgggggttgctggggagaatgtgaacgtgcctctgggccgctctggggcgtggccgatctggctagacggagtgtctgttgtggagctgccctatccagttgtgcaggttgcacacaagcccaggaaaccacattaaagaggcccagataccgttctgcaggaagcaacggacttgccctcgggacagggcagctgccccaccccaagggagcacctttgggagagcaaagttctgtttccacatcgggatgcctgtggggcctctgcctcctggtcacgccactaaggccactttggctgcctgaggcctctgggcaccccctgtgagcagcagttttctttggtgaatgtgcgcgtgcccactccggacacagtgaaggggagatgaggctgcttctgcccccggaaccaaggccaggtctgaacagaagtcgggcaggatgccgggagctgatgggctggggtcctccttctggaaagggcatctacctgcttctaccacgcattctacctgcttctaccacgcttcctatgcatgcattctacctgcttctaccatgcttcctatgcatgcattctaccatgcttctaccatgctttctatgcatgcattctgcctgcttctaccacgcattctacctgcttctaccacgcattctacctgcttctaccacgcttcctatgcatgcattctacctgcttctcccacgctttctatgcatgcattctacctgcttctaccacgcttcctatgcatgcattctacctgcttctaccacgcttcctatgcatgcattctacctgcttctaccacgcttcctatgcatgcattctacctgcttctaccacgcttcctatgcatgcattctacctgcttctaccacgcttcctatgcatgcattctacctgcttctaccacgcattctacctgcttctaccacgcattctacttgcttctaccatgccccgggctgtaggtgcctcccaagtggggcttttgcaaacagaaggtgcccaattgtaccacacctcctcagatggcagcatctgtccccgtgggcccaagtgcaagcttgcacagctgctgtgacacggggtctgggtgcctgaacgcacggtgctgctggtgggtggacatgtgcctgctcctgctggaacctgcccccagtggacactgctgtgatatcatagaatccagggccacctctgcggcctgccttgttggggaccttggcctgtgctggacaccagttgggtgctgtgtgtgcctcttgggggcggagatctgccctgggcctgtgtcagggaagggggcttggggagggtgagccggacactgagctgtgtacaagtccacaaccgtgtgagcggcacgaggtctccccgctgcaggctgcaggccagccggagtcgggggtgtgagtgtgcagccgtgcaccccctgggcttcgtcaggctgggcagggctcttgacccccaggcagcagagcttctggaaccccaggcccaggcctcactggcagccccagcctctggggagctgctctggtctcggtcacgggggcttgatccccacaacaagggggggggtgggggctccggaagcgaggctggtgcctggttggggacaggaggactcttgcagcaggtgcctttggacaccccctacccctgccaccacacacacttggtccccttctgacctgggcgggagggagacaacagaggggagccctggtctgagaaggcagttttgctccatgaaggaggaagccccttcccttagggcctgggaacactcctccccgtcctccccggtccaaacccctgccgcacctgcagatgggccggggcggccctgcccgtccatgccccctgtccttggggtatcctcttggctgtagccaccagtcacccaggcccaaagccctcctgcctgccctgcaccctccccctgctacccgcggggctgcagccacccattctcccatccctgctgcgttttgggggctgaggggttctttctgaggcgacgggcgagttccggggtaggtcgtggtggtggttgtaaacagcgaacctaggcaaacctcctgatgtgtacccttaaagatggtgaattatatctcattttctgaaatttaaaaataaatggatcttttaaagaaactcccccagggtcaccgtgggtcaccctgaatggctgccatttgggcttcctcagccaccaccgcactgcatccctgcttggctgggccccgtagaggggtgctgaccacttctttttttgttttgagacgaagtctcgctctgtcgccaggctggagtgcggcagcacgatctctgctcaccagaacctccgcctcccgggttcaagcgattctcctgcctccgcctcccgagtagctgggactacaggcgcgcgccatcacgcccggctaatatttgtatttttagtagagacagggtttcaccatgttggccaggatggtctcgaactcctgacctcgtgatctgtctgcctcggcctcccaaagtgctgggattacaggcgggagccaccgcgcccggccagtgctgaccgcttcttgtgtttgttccctgctgcactgcagccccatgtctgccctgcttgatgggagcccccggagggggcgccttttcctgtgaccccccaagcacatgggggctccccgggaagactcagaggcttggggtctctgctgcttacacgtggagctgcctctcggtggggcagggtgtgtggcccagctggcctgtgtgtcctgggatgtccacaggcccttggttcatgacacctcctagaaacacgtgtgttctctaactctggggctccatgtctgtcccggaaggtgctaccttcgtctctcactcagggacgtcaggcactggtcctgcccgccctgcccaggctcctcctgtctggtggcggtgggcggccctgggcaccagagcatctgtgctttgtgccacgtgagcagggcccgtggggcaaagggatagggagtgcccggggtagactgagctgctgacccgatcgggcctcaggagaggtgtctcctgcctgcctgtcttgggtgggggcccatgaggctggtagacctggaggtctggggcctcacttggagcaggggggcagctggagcccaggtccccagctggcactgcacgtggctgtcactgcggctcccactcaggccaccgtcttctcctccacagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggtgagtggggcggggcagggagcctagcgtcctctaagtggggaggctggattcaggcatccattgggggctctggagctttcgaggttgagtttacattccagacaccccctcccccaccctgagtttccgtctccttctctgcaacgtgagggtgacagcggcaccctcctggaggccctgtgcgggtgagtacatcggcccacgcatcagtctgtcagaagaaaccacccgctgggggtgtcccgttattttctcctgttctggaggccacaagttcacaatccgggggccggcagggctggtttccccagaggcctctcctgggttgccggtggctgccttctccctgggtcgtctgtggtgtctccatgtctgggtcctgatctcctcttctcataaggacaccagtcagctggtttagcgcccaccctaatgtccttattctcattcggtcacctctttaaagaccgtgtctccaaatgcagttccgttctgaggccctgggcatcagggctctaacacggatttgggcgggggtggcagtccagttcaagctgtgaaagtggtgtttgcacgctgagcacccggcacactagctgtgactgtcatagtctgtgaactgaacaaagaattgaggtaggaaagatcccagcccagacgctatcagaacaagacatctggtgggttttgtgtttctgtcttacttttggggctcccagcggaggcccctccccaagttttcggggctccttatgtctgtgggcccctcgctctgcactgactggggcctgcctgtgtggaaggagctggcactgggagctgctcttctgccgctgcctggggcctgtgcgccctcaggtgggtacctgcagctctcccggccccccacccctggcgcgcagcctggagtgggcccttcctaattaagagcgattctcaggggctgctgtcacctggacttttctgctgagttcccagagggacagccccacttggaaatactaattaaaccacaaagaaggtggggaggaggggagagtcactcttgcctgaagctccctctcccccaggggaggacatgggtattggagccacctgctcatcatcagggcctgtctgccctctatccccagaggtgtgggaagggagccagcctcagtccacaggtgacagcccccgggcaggccctgatccagggtcccagtgggaatccctgggagctccggactgggacccccggggcctgacgttgcctctgcttcctttcacgccttccctggctgaggggacaaacctgcccagggtcctcaccttgctggacctcctctgcccctgaagcctctcgtagtttgactaatcctcatgtgaggtctggagaccgaggggcagggcgtggcctggagggtggaccctggccacaggggcctccacaccccacagggcttggagcagcccaaggcggccctcgtcctggtttgagggaggctgagggagttgttaccagctccgctgcctccagaggccgccccccagggccagccttgaccccatgggccctgaatcacccgactcaaacagctgaggctccttgcgccccactggtggggcctggctgctggtgccagcgcccgcagctcatgggaggccacttccctgccccagcctggaccaggagcttctaccagccaggaccctgcacccagccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatgagatgaaaaagcctgttttaaagctaacagggcatgtcccgcctgtctgactatggaacccttgctctaatcaccggagaatgacggatttgctcctccccctccccctccgcccctcctccccctccccctccgcccctcctccccctccccctccgccttctttctttcatcgttgcagctgcggctgcagccgctgctcagaaatgaaaagctgcccacagatgcgccctgatgcgtctgtctgtggagacggcagtgagaccccggctgccgctatcggggtgcctttggggtagctgccgagcctgccgggccttgcctggatggggggcagccctgtgcctcactccaggccccgctgacctagttcccaggtgtctgtgccagggttggccgggcgccagccagacggaagccacagacatgtgggtctggctcgccgggcccctgccccgcctgctggctgccccccagccccccggactccctgtttgtcctcagccaggccaggaaggtgccatctggcctgcgagcagggctttgtcctcggctgaggggagaaggggttcaagggccgtgtctgggctggggacaggcccctccttgtggcggggcggctggggccctgtgctttgccgtttgacccggcccacggcgcgggcagcatgcggaggagggcggcaggcctgggctgttggtagtttgaccctgggtgctgtcctcaggtcgaggtctgtcctccagccctcttctgactctggccacccaaggctgggtgatgattgaagcccctggctgtcgtctccctcctgccctggaggcctccccaccagcctgggagggggagtccaggtaccccgggtgcctgagcaggcgaggcccctgttctgggcatccagagacccactagctttaggcctggtgttcattggggtgctacttggatgctggggggccaggggccactccgtcttgttaagtccatcccagaccctaggaacagggtgtgtccttcctcgtgctccgttcctcagatgtttggccctatgccaggcagggtaggggcgtgaggcaggatctagaagcccagcctggaaatagcctcacggggctggggtaggcaggccagcctggcaacacacctgccatgtccgggcccccaccctgctggtgcgtcccccacatgcccgtgcacagctgtgccatcaactctgctgccctgtgagtcccccgcatgcccgttcatagccgtgccatcaactctgctgtcctctgagcaggtgccgtgacgggcacatgccattgatgtgtgcacgaggcacgacaggatggccaggtctcccaaggtcaggttggcccctcggccactcccccactaccccggttgctgacaccggctggagaccccaaggccaggcgctggctcctcaataggaagttcccggccccacgcagggcgtcagtgcccatgtgtacctcccaccctcgagaccagcaccctggagaggcaggtcagaagtcgtgaacccaggaggaccctacagagaaggggggccggggctcagcccgcgggaagggagcagatgctgcctctcattgaagattccaggcggcggcggcggcggcggctcctccagttaatcctcgctgactgtctcctggagggtggagagaggggaggcgccggcccgggctgcctgcactgcctctgcgcgggtgccatgtgctgctgccgggtcaccgtctgccgctatgaagatggatgggcccaggaagaggggctggcgggtcagggacacaggcacggcccctgggagacagatgcttctccacggtggggcaggtctcagagcccctgggccatcattcctgctgatcttgtggggagacggccatggcctccttgttttttgggtgtttggcatttcgtggctcagggaggcagagcggggctggtgctcttcaggagcactgcccgctgatcagcagtcgttacctgacatggccagatggaacgtgaggaagggccgggttcccgtggctctgcatccctgggaagctcagaggggccagcgtggccatggctctcagacacccccaggtcagggtaggcctgggcagtgctgtccccacatggggaagatgctggggctgagaacggctgccccagtgacagagtgacgcctgggttggcagccatccagagtccagagcacagcccccatctgggccgccctgaggctccctccgcccccctcctcccccctcctcccccctccccctcctcctcctcctcccccctcctcctcctcctcctcctaccccctcctcctcctcctcctcctcctaccccctcctcctcctcctaccccctcctcctcctcctcccacttagtcacacgaataacaggaacaagcaaggccttttcatgctctggtttctccgggctggaccctgcgtgtgtgcggggcagcctctgcgtggctaggggtggcacggcctatccttgaacttggcagggacctcagcccggaaggtgggctttgggccactgcctcctcctgctttgtgcctggagaagacccctcatctgagtcctctggaccaccttcccagctacacccaggtccactgtgtccaggagcctgggacaggcgagctgttgccttccctgccccaccgtgtgtgtgaaggccggtaccccagctggccagtcagggcccagctgctgcctgttctggtgggctccagggccagggccaccccaggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaagtaagttggtcggcggggacttcggtgaggtggccaggtggggacacagtgctcagggtctgggtccccaggcagcctgcggtctgcacagatgaggctgtgcctgctagatggttgtcggccgctgagccctggggattgcagccctgtctgtgccccttcacactgaggtggcagtggcagctcgctccccccgctgcttaagccccgtcctcgttcggggtgccaggagtctgggtgccgactgagcgccaggggtgatgcagggagtttagccgtccccccatgcaggagcaggtgtgcactcacctgtccccaccttgcccactatccccgcctgcagcctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggtgaggcatcccccacgcgccctctcgtctaggtgctggcctgttcctggcaagatggaacctggcggggaaggtgtttcttatgacctgagagccaggctcctaggggagggtctagagtagcccctgaaatcgtccccagctttgagcctaaattcagccctgatggcccattaggggtcccctcctggtagacagtcccccttggtgactgtactgtcatccttggctcctccccttctcaccggggggtccattgacagcaagtcactgttaagagagcagggctttgcccgtgggagaggcgatgctttgctgtgtagcaggagacctcggtggcactgtggtctggcctgggtccgtggagaagctctgcccatccttgtcagaggtcagaggggcctgtagtcatgtcatggaccaccccacgtcagggcagcccagcctgctcgccagccttggaagggcctgggcgcttgaccactctgtgctggtctggctgagccgagggaggtggcaggcggcgccctggaaccccaagctgtcggcacctagcagcctccggcatcaaggggctttggggctagcagcaggcatggtcttcatccccagccattttgtcacgttccccacgctcaggcaggtgtgtgtacctggctgagacacacctgtcgacagggctgggtcttccccttggttcatttgctgctcacagccccgtcttctctgcacaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggtaagtgcgtctcgagccgaggagcccctctgccctccctgtcccttgatggcagctgggcagaaagcctgggctggaacctgactggactccttggccatgcctgtcctcacagtttgtccacctgccaaatgggacaatgatcgttcaggctctgctctgaaatagcgcctgtctcggtagccgtggtctcctgcagtaaacctgcaggccgaggagctctcgggcgtgcttgggcattttgtaagccgctttgattgtatggaccttaagttcttcctgcaccagtgaaacccggctcacctcccgtcactgttcagattagcgccctggctcgttcctggttatgctttttaagggcctgccccaggtccgtctcttgttcctggtgcagcagagcccccaactctttccatgtgctgcaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcaggtacctgggcgtgggtgggctgtgctgggcaaggtctcagccacccgcggggaggagccctgaatcgcagcacctgccggttgccgtggtgtaaatgttccccagctgagttcgccctaaaagcgtggtgtggctgaacatggagtagggagcagaggcacgttggcacacgatgtagacacagtggatatagctgaccccaggaggacagttgtgaaatgtagccggggcattaggaagggatgttttgagtgcttcgttgattttatttctctgtaagtttacgaaacaattgtccagtaataacaaccagcttttgcatgtttcccggaaatttaatagtctgctctttgagccagcatgagctggctctggcaccgcactggctgggcaagagttttgccagccagccacggagcgtttccttccagggacaagacatgcttcttgaaagctcccgtagggccccttctgaatatcttggttctggctgcgggaagaaccctttggaagggctctggtttctctgggcagttgggtgagagaggacggggagggagcatgctggcccacgtggctgagatcctgcttgaccgtgtttccccccacagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggtgagtgagccccaggaaggaaggagggatgagccttcacgttccgatttgttcagcgtgtattgagcacctcctgtttgcccaacatcctgccccagcgtttctgcctgcctctttcatttctgttctttcatcttcacgttataatgcctgtcttgcctatggggaagctgagactgaggaagaaaatggattgctcaaaggtatccccaccagtaagtaaagagaccaatcaagtccatgttgagagccagggcactgcacacgcagcctgacctagttcccaggaggccattcacagcagatgaagagtgcaaggtagaagctttaattactaataatacctgttctctccatcttcctctgcttttgagcctggacttctttttttaacaagaaggggacagcttttgattttaaggaaaaaaatgagttttattgcttttgtattaatagtaaaaacacatgcccgttttctagccctttatgaaagcatttcccaggaaactgtgtggtggtcccttggaccccggctgcagacacaggtcttatgagctgggccccagtgcccccagtcctccctgcccctgcctgccctgggattcctgccttggggctgtgctggtcccaggcccccacgtcatatacccccagggctcactctgaagggctgagctaagatcctcagccagagttggtgggaatgacctgccagccttccatagctctgctccaggcccagctcagggacctagggacactgattctgttccctgagcctcactttcctcaactgtccacaaaggagggtgggtaggatgatttctgagcatctttccagctctcaaggctgtgatgctgtcctgggataagaaacccttgggctctgggacggaagcgtgttggtggtttaaaatctgtcctcccttctgcctgcctccgttatccagtagggcagcgagggaatgcgcccccgctgatcagggatgactgggagtgactgtcaccaggccacagctaagtctccctgtggctcacactgcccggcacggccgaagtgagatcccttctgcctctcccagcccccgtccctgaggcctctcaggctcagccttgcctactacccagaggactgagggcagccagctcctacctggcatggcctgataacatcagggtgccctgactcctgtaggcatcttcttcctcagggctccccagggccccagcacaggtgttgtgactttgcccacccatggactgcttccagccagtgtagctgccccatccggacctggggcatgatgggaagcagggcctggcctcccctggctgcggtggttcccctgtggccggctgcacacgtggccttacagcattgtgaacttgggggcctgacagggccctcatgctccaagctagaaaactgttcagtgcttggtgtggcgcatgaaatatttattctcctgcaggtttcattcccttgctgtttacttaaggacacagcttcttcctgtggttccctgttgtattctgctaagagggacagcagcgtcggatttgtcccttggcctggagtctggaataactagggagagccttggtggctgtgtttaaacagggctcccggggcaggctagagatccctgagcccggccgtgtgcctgctgtggcctctgcctctttcttcccctcaagctttgcccagggtctctgcacagtattggtccagacatcctgtgagtatatctccctttaaaaaaaagaaagatagccaggcacagtgacacatgcctgtaggcccaactactctggaggctgagatgggatgatcgcttgagcccgggagttctcggctgtagtgtactatacccactaggtgtcccagctaagtccagcacaaatatggtgacctcctgggagcgggggaccaccaggttgcctaaggaggggtgaaccagggcaggtcggaaatggagcatgtcaaaactcccgcgctgatcagtagtgggattgctcctgtaaatagccactgcactccagcctgggtaacacagcgagacccatctcttaaaaataagctggaaaaacaatactaaaaatagccctgtgagtagattaaatcttgttttaattgcactgaggaaacaagccatttagtgtaactaaggggcagcttcttgtttaatggaagggttctgatgttagaaatcccttctttccctccctgcctcagcaggccttagcctgggtccttgaagacactttgaggcctctgccacaggccacttgggcagtggggtcgctgcagttgtgacaggggccactggggggcagtctcggcacaggccccatcctgactgggaggatcttcatttcacagtgggtttggctctggctgggcagacactggaaggttgtcttgtggctgcctgcggggacagtggggagggaggagtactgccctgtgaaggtggccagcctgccctgtgtcatgtgtccctacaaggcacagcaggaggagagggtgctggtggcagggccacagcccagtatatagagtgggtttccccatggaaagtgcggatgagcgcttgcccttaggggaattcacgcaagcaggtgggaaaatcgaccgaaactggatctgtcccaggcctgagagggtctctgccttccctagcagcttaggctgggagcctccctatcctcttggagcagcctgcacacacctgccgcaggtgttggagggccgggcacagtggctcactcctgtaatcccagcacttcgggaggccaaggcaggtggatcacttgaggtcaggaattcgagagcagtctggccaacttggtgaaaccctatctctactaaataggaaaaattagtagctgggcatggtggcacacgcctgtaatcccagctactcgggaggctgaagctggagaagcgcttgaacctggtaggcggaggttgcagtgagctgagcttgccccactgcactcctgcctgggtgacagagtgagtctttttttttgttttttttgagacggagtcttgctctgtcgcctaggctggagtgcaatggcacggtctcagctcactgcaacgtctgcctcctgggttcaagcagttctcctgcctcagcctctggagtagctgggattacaggcacccgccaccatgcctggctaatttttgtattttttagtagagatggggtttcaccatgttggccaggctggtctcaaactgctgaccttgtgatccaccctcctcggcctcccaaagtgctgggattacagggatgagccactgcgcccggccgagtctttaaagaaaagaaaggaaaagagaaaatgaaagacagaaacaatgatccttggggtggagtgtgtgtcccctccctgcagccctgttggcactggctctctaaggggctgcgccatctgtgtcatcttaggagcggcaggcagccagggaagcctgtggatgactgaagggtcttttctccctgactgaagggttggtttcactccctaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaaggtctgcctccccgcgggccccgagctgctcagggagagccgcacagtggggatggggagcctgcatgccagccacctgcccctctccgtccactcctgctttttgcctggggtagtcccaggccccaggtggcaagtgcactggcttctttgtagcagcatgacaccctcgtaggggaggcagaccctagtccccgtgcctgtcctgcctcgatgcaaattgtcccaaaaagccaaatcaaagcccgcctgtgaagatagttccgcagacaagcatgatgaataagtgatgagcggaggctaataagatagttttaaatattaatagtgcagcataacaggagagccggcctgggctcagcgggggctccacatacagggccgctgccacgagctgcagcaggtgggtcaggggttgaggacgcggcggctggcactgccccgggtcagggtaggaggtcaggcacttcattcttatttctgcttgggggtggggcgtcctcagccagcggctccctgagttctccagagagccaggaagagcaaccgagcaggcgagagtgtgcagaggggagcaggggctccagcccagttttcttcctgatgctgaacactcaggtcctgtccagtgctgagctcagcctcctcttcaatagaagctggggcacaggcggtcttcctggttgttggtctaggctggatggagggcccagccaaatttctctcccctactcactttgtaaaggaggagggagataccccagcgcccctgggcaggggctctgctattgttctctgtgtcttagagagctcaggcctgtgtgtgcctgtctcctcccaggagatggactcagatggccacagcatgggggagtgcatgtgcacaagcagccctgtgttgccgtggacacagccccaggcctgtgtgatgaatggttccctgccagggggaggagggaggtcttgtcagcccaggggaccacccagctactgggagccatggatcccagggaagcctggtgtctgcggtcctgcaaagccccaggactgggttaatgttggtttccacctcggttgaaaggaactggccttcagggtgttcaggtgccagcaggcctggcctgataggtgctctgcacacatgaggccctgcgggcatgtccactggacagatgaaggctctttgtctggctgaatacaaccatttctccatcagggtactactacgacctcgatgactcttacgacgagagcgatgaggaggaggtcagggcccacctccgttgcgtggccgagcagccgcccctcaaactggacacgtcctctgaggtactgggctctcctccccacggacatgctctgggctgggctctcgttcctagcgtccacaccctgcagtccaccccactgttgctaggttcctccgaagtcctggcgggttcgccccatgaagctcttctcccaccaggcgcagccagctacggcccacacttcgaggaccccaggaggggaccccgggacagtgcaagcataccactgccagtggcttcaaactcatttgttttctttcccaatctagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaaggtagggcctcgcctgggtaggaaggtgggggctcactggggtggaagtgggtttctgaagcagcaggtggggccggtggactccaggcaggatctgcgatcactgagcctgaggctgcccctttactcctcccggctcccgggaacagcctctctgttcttacaagccctccatagcagccttacctgacaggctttgctctgagagccccaccatcttgacctgaggactacccatgtcactcatccatctcccagcgcccgagaaggcgctctttgagccgagtgctccagtgaccaccaggcgtgaggggaggtgccaggtgttccaggtttgtctgctgcaggcttttcctcttgctggaccgcttaggtggtctgctgggtgttgtgtcctggtggccggaggcctggggaagggctgccaagcagggcagcacacactgagcagatggcttgccttgaaagatgcttccagttcagtctggccacacagggccacattgggacagaccctctgggctcgaatccatatagcagaagaaacaatgcagccacaacacctgctcagggttttggcttccttggcctgcagcgcaggctggcttggtgcccagatgttgacgttcctggccctgccccttacgcacgctttcaagtcctcgtgggcccctggcctcctctctgggagaaagtcgaaggaaagcagagttacttcttggaccttgagcagcttcaaggtgttgatcagggtgtagccgtttactttctccttttaaccagtcagtagttttccctttctcttagcgggctagtgacgtgttgattgccagcccagttccctagatacaaagcatctttttccctgaatttttggaggaaaaaaaattaagggcgatgcagcccttgagtttcacagtcaagaagggccgggtgacatcagggatctgctgcgtggaacatcgtggggtcatctttccccttcaggaagtggcagtaatggtaggagtgggggagaaggcaccctgcctcagaggccaggcctgggtctttggggtgtttctttgtgttggggccaccttgtctgacttgaaataagaatacatcctcgcacgtcaccaccgaggtccgtgggcacagtgattcacagaggcgtcgtcaccgcacggacagctgtctttggagcacgtctaggacattgtgtagtggatgccgagagcaatctgggctcgctttgagatggttgcttcctttcaactgggcctgccccatcacacctgcttttggtttttcgggctttagtgctttgcctgcccctcaaggctcggctagaatcccgctgtccttctctccaaaaaatgatgcaactggctcgttaatctcaggctgcttttctcatagacaaagagagacttgttgaaatgctccgtgccatgaagcagaaggcactgtcagcagcagtggccgactccttgacaaactctccgagggacagtcctgccgtctccctgagtggtaagggaaggatagccccacctgccaccacccaggaccatcccatgggctgcccaggctcagaggcgaccactcgaggtcttcatcattgtgaatgtggcctcctgcaggctgtcttcttccattcttgtaccagcgtacgattcttgcacagttgtgacagtcattgggacggaacgtcagtttgaaggcgggctcagagttgaggggagggtctggcttctgtggagctctacgtgctggtcactatggtcgtagtaaccgttgtccttcagttacggcacagaggctcacatggaggccaatccaatggtaccatcccaggagggagggcgtgctccagccttagtgcccgcagcctggtcctgccactagcctagccgccctggctctcttcctgctctttgtcttcctcactctgccctctgggccctgccggcacctgccgccacacctttcctcctcttacagttctggctggcctctgccctgtcagatgtcagagggaatctttacagtgcgtcccagtcctcggcccctcacacactctcttgtccggttggactgaatacctccatgctgcctccgtggctgggggacttccttcttcctgtggatctgcttcttccttcttgggacatctttcaaggatggacttgccactaaacaccccactgtcttcagagaatagccatgtgcgcggcggttacttaaatgttccccgggtcttggttctttgcgctaggtctttgttaagtgtaagctctagagaccaggatctgcgtgctggacactcagcctgttaacttgcatttcttaatattttccttcactttgtctctaaaagaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaaggtaatgaggctgccagtccctgctcagctctcggctgtggttgaggctgaccaaagttgctgagcgccacagctgctcagccgttcagccgtgggcacaagtttttataaactccaatcaccagaagaaaataatttcgttattatgccaaaaccatgtttgtttgtttatctccaagctctaaaacctgaactcgtaggtgagaaacgtttgtaggcaccagcgctgacgctgtgctgtgagcagggacgcatcgatcggtaagaggtaaaggagtgaacgccgacaggcattggtttttgcagagattaaaagattccccaaaggcaggaagagcacttgagtggatttttacccgcattcatttgaaagaatcatgtttttcaagacagagatgcagatggccgccagtcctcagggtagagcttcccttccttcatggtggtatctaaagatgtcaccaccagccctctggatccgtgggttccgcgtctttggattcaaccagcttcagattagaaatatttgtgggtggggtggaattccaccaagttccaaaaacaaaacttgaatttgccaagcaccaggtactacattgaatccatgcaaatcaagtcaagtgtaggcattgtgttaggtattacaagtactctagaggtgtgcataggtgatacgcagatactatgccactttatatcagggacttgaacatccctggcttttggtattcacaggaggttctggagccagttctccatgacagataccaagggagactatacagtgctactgagatgcctttcgaaacttcagaataccctccctccctgccctttggcagtgcaccttgtagaggcttttctgtggccctaggacactttctgccttattctgaccttgtcctggccttacactaaactgtttcctctagattttagtcactctgccataccagtttgagccaagtcactccattgactgggctggtctcaggccccaccaggggctgccatccccacgggaggccaggtgtgctcctgaggatgtcacccaccaggccacgccatgagacagggcatgccctcttgaaacggggcacaatgaggctgattcctgggggagggcagagccccattatgcctagggatcaaaacagccacgccttgtgagaggatgggctggtgtctgctgagggctgactatagaccaagctcaaagagatggaggcagccgggcgcagtggctcacgcttgtaattccagcactttaggaggccaaggcgggcagatcacctgaggtccggagtttgaaaccagcctgggccaacatggcgaaaccctgtttctactaaaaatgcaaaaattagctgggcatggtggcacatgcgtgtaattccagccactccggaggctgaggcaggagaattgcttgaacctgggaggggaagttgcagtgagccgagatcacgccatttctctccagcctgctacccagaggactgagggcagccaaaacaaaaaatggagtctcagagatgaattccaacaaaaatggtccacgtaccagaatcaactagcactcagggctgcgttgtctcctggctgtctcggactttctcaagtggcccagaggccttgggctaggtccctcctctctacgcgatgtcatcttggtccccggagccctgcagtcatgttgactctgcaccaagggcagagcagagctcccttctgagacagcaccctgtgtcccttcccccaacacactgatgcaagccctgtcccctccacagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaaggtaagggggtgctggggaagaggggggagggggtcaggaaagtacctttggaaaggaagctgagtgatgagttcatgcagacctctgccagcctggggactgtttctccgtcctggggcacagtagatatgaatactggaagtttcttccggcttctggtagcggtgatgtcccatgctggaacctgaggccagtcttgctagggcatccaagtaccatgatgccagctctggtggcacctgtcattctttatgtgggccctgctctgtgggctgcatcagtgctgatgtcggcctcagcttcgtgtaagggtcctgggagacaacctagttggttgatttgctgagccctggcagctaggcctggtcactgctccagcatgcctcttgcctagtgacagactccccacactgcaaggattgctctgtggccggtgggtgccagtcatgttttcagctgcctttactttagccaagcactttgcctaaaaagacaggctcctggtaaaggcttagtcgaaggcttgccgcctctcagaatacccaggatgttttgatcccacctgggaatgcacacaccaaccctcctgggaagccacagcaccaggcggactcaggccacatctcccctgccagggagtggggccacgaagttgggcgttgcagcatttgatgctcctgtatactgcacaccaccttctgcctctgtgcctcagtttccctaggatattgcacaggcccctttggggaacagcagaggtacccagccttcattttgcactcaccatccttactgcgtgggcactgctgggtatgcgctttgacaaaagctgggctgggccacagccacctgtaattgatttaacatgtcctagaggactctttatcatcacatatgacagtgttgtaaatatcatcaaacacaaagacttgattatgaatgtcagccacttcaaatacttagaaaagtagtttttttcttttttctcctggtagaactcagtcaggaaaagtattctccaaactaaaaacaaacgcccatgtagccacaaccaggacatcaaatcccgtattttgtttcctttcctcctcccgtggaatctttgagtttattgcgcaccaccccctacatgttgccattcttttagtgcactcgtatatatccagaagcaatacacagtgatttttaactctcctagatgaaatatttccatctttgctggttttgtaggttttttggtgtggtgttgggaattatttccataccccatggctgtcaggctattcttctgtattttcttctgtgagtttggctttttcctgttctgcgtaggattcatgtgtgtgtacagagtaaggcagaaatcttaactgtacctttcccacccaaccagttgtcctggcaatgtgtggggtgccctcttccctgcctcactcccacacctgctgggcctggcttcgcccctgtcaggcatgacctgcgctgaccccctcttctctcagctaccgctcagctgtttttagcccatggctttcccccaaggacttttcccctaaggattttaggatcgccttatattcaccccaaagagtcctgttagattttcagttgcattgaatttacaggcgtggttggcatccttttccatgaatatggtacaaaactattacatcatttttggacgtgaagttttgactagatttagtttcaggtatcacatagattttgggggtctttggatttttgtgttgcctgtgattattccttagatcagaggaatcacagatgatcaaacctgcaaatacaaggtttggttctttccttttgaatttgtctgattgtcttgtcactccagtgctgccaaagagaggcactggtggggcccttgtctgtgaaactttaaagcatcccattaaagagtgaaggttcccatttccggagtttttcatcctttgattttttttttcttgatgttgctccatccttgttgaatttgttagtacttttaggatttttaatgtatgttcgttagtattagactctagttttattgtactttggtatccagattgtgagcactttccctgtttttcatttgctgaaacactgtgtataaggtagggatttgtcctgaaagatgtgaagtcactctcctgttgaaactaggcctggtatcttttggtagagcagaggctttattttattaattaaatctgtgctttaggtgtactctggcctttttccagcagcctaaactgaaagcctatttttttttttttgaaagctgcattttaaggccatcaaatttcttcctaatctgtatcaaattgcctttaggtcctggatcctttgtctttattcctgtgtattgggcttaatttagtgacgtttatgtatttatcggtacaattcaaagggctgggagcattgtggtccacaggagaggccttcgctggctgcactggagagaggttttgggctctgctgggcagggtgtgaagaggagagcacaaagcgggccttcgggctcctgcatacggaaaatacatcaccatctcctgtcttttcagagcaaaatctggagcggcaggtgttacagacacaatgtagacgactggaggcccggcactacagcctcagcctgacggcagagcagctctcccacagcgtggcggtgagttgggaagggatggaaaccttcaaacacgcaaccttttgagtttgggttcagaaacacccatgcagataagtttcagagaggaaatgtgctcttaagagatcaaaatttggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaagatcaaaatttggactgcatgcaatggcttacacctgtaatcccagcactttgggaggctgaggcaggatcacatgagcccaggagttcaaggctgcagtgagctctgaccacaccagtgcactccagcctggttgacagagcaagaccactgtctcctgaaggggtaaattcagacaccagttgattatctaggatttacttatagaatatcgatcctggaagggtagggatgctgtttgtagaatgaattattgcctgtatcagtctcctctaccgtgatttgctgaggagagcagcagggttttattagagaagggaagctgaagcaactgaaaccatctcacgtggctcacagccacactagcaggattggttcagcagatgtccttggggggcagggatgggaagcaggtctcagatcactcccaaagtttttacatctgggggttccaagaactccgagtttgagccaagacagcagcagatgccgattcttaagactctggaagagccagggacagaacacaggctgagaagtggactttgtttctctttttgaggcgaagtctcactctgtcacccaagctggaatgcagtggcgcagtctcggctcactgcaacctccgcctcctgggttcaagcgattctcctgcctcagcctcccgagtagctaggattacaggtatacgacaccatgcctggctaatttttttgtttagtagatggggtttccccatgttggccaggctggtctcgaactcctgacgacaggtgatctgcccgcctcgacctccaaaagtgctgggattacaggcgtgagccaccacgcccggccgggacattttcaaatgtaggtttacccttccatccagcatgtttgtactctacatgcttgtccttacagaggaaacgggttggttttgacacaaatttccctctctccaggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgtt

SEQ ID NO: 37608 - DNA, 93532 bp, Homo sapiens; identical to SEQ ID NO: 37461

SEQ ID NO: 37609 - DNA, 78413 bp, Homo sapiens
  misc_feature (3892)..(76891): n is a, c, g, or t
gcacacagtgcacgaagacgctgtcgggagagcccaggattcaacacgggccttgagaaatgtgagtaagggtgatgggcaaccaggtgggagggagaagccaggggagaagccagggcatgggaggcaattcagggagacaggaacacccttctctcttcacacacctcatcagttccactgtgcacacgcgtggacacacacaacacacgccccatccctcctcctagggatcagaggagacttcatacatagatgctcatgccatggtcctttcttccctctgggctcttggcagggagcagcgagaggaggggaccccttgcccaggacgggacactctgtgcctgtgtcccccactccacagatggtttctcccagacgctcttgctgaacctgtgggagccctttcagagacccacgggtggaaaccctcaccctccattaactggtcccaagccagtcctattcctggaaggggaggggagggacgcgtccgggcaggggaggaggctggaaagggagtgtgaggggagtgtggtggcctctggactggacactgccctggagagtgacccgatgcagcagctgcacaggccatcctccccacccacgcacccctgctgagaacatgtctgtgaggttcagggtgggcagagaggagaatgcccagtggtatggccgtctcatcccctgccacagccactgcccacatggcaagagtgctgaacccctccagctccagatactctcttttgttttggcaggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaaggtaggggcaggatgggcgggcagaggggagacaaaactgggccctctgggatctgggatctgtatggcatgcacacccccagacacagcccagccccacaagagctgatggccaacggcctctctgagagcccggggatgccctggatgggcgctcactggtgtagaggccctcggtgagcactgaggggagaagcacagagaaggaaggggacaggacccactcaggaaattcaacatccactgagtcaggaaaaccttccccatctgctgtctagctgagagtctttgggaaaccactgtgcctcagcttccctgtctccaaggaaatgattgacatggctgcctgcttcaacaggaacacagggacatgaggaggagaaatgtgggctctggcagcacaggaatagccttcagcaaggacagtgtgctcagaaccctcacctctgtggcaaccaagggtaccttcccaggcctgtctttctctatccagtaaaaatgagattcagggctcaagcagagcctgcgaaggtccaacaactaccattcccaggagacccctggagattatgcgtgaattacatgacaatggcacgtcttaccggctcagaagacttggcgagtgtgcagtgttgggggagggcgtttgctggcagagtcaaggagaggttgaggaggctgtgaggaggaaggaagagggacgaggcagtgcctgctgacactgagatgggtgggcttcagggctcatgttccgccgagggcatcaggaggcactcgaggtgtgaatggtttgattaggctgaggtggaatctgaagacagaaaataaagcggagctgtctgagctctgggaatgaggggcaggtaaaggctgggtacagacaaccaggaccccaggggaacaggccataggaggtggtggggatggagaaggacctgaaacctgccagaggagcagaaaacagggaaagggtgaggtacccagtccaggacaacacgcaaagagtgaatcagtgggagactcagggaacagctgaaagtcacatggggaagtttgcagcagctgagcccagcaggtagtgaccagccagagccattgcggtgcatgatgcactctgggcgagacaaggaggaccatcactgagccaccacgtgcgccactccgcaacagatcttcttcctacccactgtccttcttccaccagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtgggtgagtagccccccagggatcccttttctctgacctcagccatattgaatggggggccaagaaagggaatcttgaatgcaaagaagccgaaagcctggctttccttgttcctcccctcgagagagcttttcctaacgaggcctgtcaacctgggctctgtccccatggagcagtccccagagagcattggagaggcctggaggtccaggtggcctaaagatgcctttgtctttaggtctctggtgagtgacctccctaagatcagagccactactcaggtctcccagcagaagcttaaccctccttcctgaatgccttccagaccttgatgaatgtgcttcccggagcaaatcaggggaggaggatccccagccccagtgccagcacctgtgtcacaactacgttggaggctacttctgttcctgccgtccaggctatgagcttcaggaagacacgcattcctgccagggtgagccagagtggtgtagcagaggggaaggggttgagccagggcttgctgggccagctggagtcccccgtaatgccctgtggctctgctctcacagctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacaggtacagccgtcctacccctgaaagaccccttcctccccttctgtctgcacttggctcctcttgtcccaacttcctcctggatcccctggccagctggggcaggaacggccaacatcacccatgggctgggtaagttcccacacaactagaattgggtcatggggatcccttttcaccttcccctgaaaacacacataaggcaggatttcatcaccaccaccaccaccctggccaccaggctactacccagttggccctgtgtaaaaacgtccaagctgaaaaaaaaaaaccctcctcccctactagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagagtaaggctccctgcaggcctccctcgatggccagcaatggggaaaaggggggaagaaggaaggacaagtggctctgaaataaatatgccccctggtctccccaacagtcatcaagtgcccccagcccaagaccctagacgagttcaccatcatccagaacctgcagcctcagtaccagttccgtgactacttcattgctacctgcaagcaaggctaccagctcatagaggtaagagcccagggctgaggggagagagccggcccagcaccccaggaggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacctgaggtcaggagttcgagaccagcctggccaacatggcgaaacccagcctctgctaaaaagagaaaaattagccaagcatggtggcacatgcctgtagtcccagctacttgagtggctgaggcacaagaattgcttgaacccaggaggcggaggttgcagtgagctgaaatcgcgccactgcatgccagcctaggcaacagagcaaggagtctcaaaaaataaaaataataatttaaaaaaaaaaaaaaaacaagaacaagaagagcctgtcaataggccaatgacggaggtgtggggatgggaggagaaagagaaaagagacagaagccaaaaagagagggcaaacagggagctggctggctgcagaaggaagagatgtgggacctggaactgacttgcccttgtcttccctgtctctccctcagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgc

SEQ ID NO: 37610 - DNA, 212224 bp, Homo sapiens; identical to SEQ ID NO: 35633

SEQ ID NO: 37611 - DNA, 88732 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggtaagggggcgaggaacccccaggtccggggtctcgaccctctgcggagccccctcccctcccccatccgggattgaggagcatcccaattctgggaccatctcggggtccctgacccggggcgaatggctctcccatcttgggacccccatgcagggctgcagacccccaggcgcccccaccccggggtttgggcccatctggctgagggcgtttgccccccgctctcctccccctgacccttccccaaatcccttggcacagaccccctcgccggggtttcccatcccgggactgaacccctcctccctttcacagattacctcatccgagcaagattcctccctccctccctcctagagacctgatcccgccacatccccgcctccctctctgggcagatgtgttactcctagggcagttttcctctcgggcgtctctcgggtgatggcctcatccagggccacgttctcctggcccttggggatcgtgtcccttccagcaccttgctttcgaaaacccgatgaaccctcgcgccatccccgggccaggtccctatactgccagccactcccccttccttcacctccaccctctacccccaccccaagcagaccgatcctcccccatcccgccctaccccaccggggaaaatctctcctctgcaccttgcctggtctcacctcctttccctctgaagataacggtgattcctcatacagcagtctcttcccccccccgccccgtcttacagggctacagtttctagcctattggtagccgggaattactctaccttcactccaccctttccctcctttagaatgaaggattagtggcatcttggaggggaaaatagtccactgtcccctaggcttagagaagagcagctttccaccactccccttggagaggaggcaggctttccctccagctctggggaagggggcccctgtgaggggaggtgtttgttgggggactgaggcagcatcctcccaggggaagcagctgctctcctaccccacccactgcgcctgagagcacgcagtctccaacccgagctccctcccgcccttctcttctcgtcatttcattattgatccaccttttcctaggccaatcctggggcttggaaggggtgggggaagccaggttggggtgaggagagtagataagggacagttatactttagtgtggtggcggtggttgctttgggatgggagaaaaaggattatcaagcaaagttattccttagaaaggacttggggttgtctctgattcttgtaaggggacccaaggtggatgaagggtcagagcgttgccccttccccattagtactggggcaagaacggagttgcttctataaacattattcggcccccttcagcaaaaaggaaagttgcccaaggaagggaagttgagttcaggttcagccagtggcgttgcgcatttgttttccattggatgcagaaggggggagttcgaattgtagaggggggaggatggcatgggggatgctaggaggaggaagagcagctgctaggggctgaagcgaaggggggtagggggttgctgctctggagtgctcttgattgaaacagaaagggaaagataacaaccagccgtttcctgcgtgctctgccgttggtgcacacaaaatatcctgggcaaaccccttgtcccctattgtgccccgcacccctttagatttacggaaagatcctgggaagaaggggagggaggagatcccaaggaccctggcccctcctttcaaggagctggcattttttagttgttagtcttcctgcctccttttttttaatcgtttctaaggcagcctgatcaggagactgacaacaacccgccttctgacagagcaaggaggacatgatgggggcgtgttccttgctatgtagctagctgcagcgtcccctttccctgcctctttctgctctatctccacctccttttcccagccttcagaaggcagctgcagtcagcagggttgtttgagactatttattggttgctgtagattattatttttttttgaaaggccaattctgtattttttaagctaacaacacagatcccatgtagttggagaaccaaaggccacatacatgacaaaaagactgaaccgttcaggttacttgcatggagttggtgcttaaatgtgagttgattttgcttttttaaaagatacagcagcaaaaaaaaaaaaaaagaaaaaaaagaaaaaactgacatttcatttacctgcttattttcaaaattgagacttgcctggttatatgtagcattttagccccatgtatatttgagtttaataagaaagtctctattaggagaagttagtccattttaaggggatcctaagaagcattttcttcttgttcagtatgcttatttattttgtatagaaggactaagcattcacattccaaatattatcacatattcaaaagcaaagttttatgctgacagcttccaatcatagtttttcaagagactggttagaaagagagccacctggattcagggacctaatgtctgggcaccagaatattttatctgttggtctttgacaaatcacttttaaagttttaatcaggggctaaacgttttcttatctactggcattatgagataattgtaaactactgttttatttttcttaacactagtatataatgtaaagcctgtcaaggaattgcagttatttcaaataggatcatatttataaggggtttttgtctttaaaactttttcctgaacagtagttgctgcttcattatgagaagagtggttgactccttacattaaacttgagtattttttctgaattggacttgaatgagctctgttccatgggtaagctttttatgtggtgtttgaggcaatccagtatgagttgatggtatgcattgagtagtggtaaacctctgagctggtagttttcagtgtagaagcaagcactttttttttttttttaacatagccttactaatcaatgataaagttccaaaagggaagtttagggttcaccctgggctgacatagaattctaaagactgcttctcagaactcactcatagctctgtatcaagtcttatctggattcatgaagaaatggttatatgatccaaaatgattctaacctctttaaactctggttcgccttcagtgaataatgactataacttgcctatgtaacaacacctatgttaatacttctaaaactaggtaacagaacttccagatgactttgctgtttgaactcccttagccataggagacttgtccttcactgctgttggttcctaacttcctttgtatgacaattaggaagtagaattgaggttttgttttattgagcactgtaagaaatcagaggtccattttttgcctttccccttccctctgtagtgtcagtatcccatttttctaaggattctctcaggtaatgttcatactactgtactttgccatctaaataaacatagtacagcagcaccctttctgttgactagaagttaggctgttgtaataataaacccctgaaacagtgtgtttatcagtaactagtcttcgtttattaatgtcataatccagttaccttccctactacttcacaaaatattaaaagcaaaatttccatcctgatcataacatagcaaactttaattagatacaaattgaaactgagttacagcattggtgtgtatttattttcacttgaaattgcagtttagttcatgtggactgagacaggcttttggattggacttgaaaagatagtactcctgcagctgaaaggtagtaggagagcgtgattttttttttttttttttaatgtttactggtcatgtatgtaccaagagtgggagttgctccttcgttgccttcacagctagtcctaagattggcagaaggtaaatgaaggagggaacacaagcagagtggagtgcacgaagcctccgagtagaagtcagtggatgtgggctctcatctccgttactgaacagttatgagaccctgggcaaattcacttttaaccttaaatttctgatctgtaaaatgaaaagtttggactaaatagctcatgaatctgttctgtgtcagtattatgattcctttctgttgtattaaacttttggtcaaatcagaatttcttattctgagtttatttcaaaagtcagagtcaagtgagacgatttgataatttttgttttttttttgagtcagggtctcactatgttgcccaggtgcatcttgaactcctgatcctcctgccttagcctcctgagtagctgggattctgtttggtaatttttaatatcagattatacatttgcctatataactggcattattattaggaggagaaatttcaacttggaaagttttcgttgtgtggaaaaaacataaggactttggggaagttgaccagtttcatttataagaaaaatgaggataaagtttttacacatagttctgagaacctacagaatcccaggcattatctggtgtttagaggccctcttgtttggctaaatgtgttgtcattgttgtgaattccagactatccaaaagagaagttattttcagtctaggtggtatattcctgtaggtgtatgaattttgaatgaaaagaaaaatccaatacatcaatgtatttataaatctgaagtgatagtacctacttcataggatgtagttattaatatgttctgaaatggtttatactgagcattagaaattcagtctttagaacttttcttcctctgtgactgaaaaccagatgacatgtccccatctttcacttccatttaattatcttaaggcacatactcctggaggaaatcatcattcacacaatagtgatccatcttcttattggaagttgagagaaactattcccatcttgacttaattctcatctctttgctcaccttagagctgtccttccgtggggcagctgtgcagactctataccaattgcctcccttaccctgtggctagagggggtggcaacagtgctttgcttgctcagaggcataacagactgcagtgcctctctcttttggaaactcgctgtgttttaattgtaggtctcctaattaagatctctttgtgcctgcccacattccactagtgttggcacagagcttcagcttccttctagcacttaactgaaggccttcaatcgggccttttgtgaatatcttgtctctttccattcttcctctgccaaggtggagagcccagtggcatagacctttgagaagggggaagctttgtgactatcactactttgggaggaatttattcgaggattgctgggatgggaccttcctttgtttgcatatgttattttcagggattaagaaaggttaaattactaatgagtctggcatgatgtacctacattttaatcagattcttaaccctgtaggcactagtaggaaagaggatgccacagagttcactgttacaaagtatttccttggatcttatctagactggtttatgaaacttgatgagtaaaatattgtcgtggagtaaatctcagactcgtgatttttgtggactctgaggttgttgaagacaagacaatcagatgaaattattgattgctcctaagttgtatcggctttgagacacagactgaattaaagttagctttcagatctgagttaacttttgattagaaagactttaggaggttctggaaattgttgagttaattaagaatacccttgtaggctccactatttcttgagattttcaggaattgtctaggcttctagagtattttcagaataagataaaatagcttttctggaaaaagtagtttgactttagtttccaggaccttcgtattcaaaatacagtatgttctttactagatctacatgtggcatgctagagaaaatgctatcttttattaagaaaaaggaatcttaagtcctttacctggacccagatggcttcattgatcacatcagtatgaggttacgcagacaaagggctatttttgttgttgttattgtcatttcattggttgttgaagaaggcctgggagaaggaagtacaggatcttttatggcatgcattaaataaagctggaggcctgcactcttatacctgagtgggtggttttatggcctaattctctaattgctggcatttatgacagtgtggatgctactggccctgtggctgaggtagattatgctgggaatagggaggaaaaaggggtccttttgttagccttttcattttgcccctcaataaagtctctgcaaaaaccctgaggaaatacagagacacttggactgagggaatgacttcccataaaatggttctttatgtttttaaaatgatgagccgcttttcttgacctatccaaagaaatccataccaccactgttaaatatttcaatgagttttttaccttgtcaggttacacaccaggggaagccaaccatgagactgtagctgctgccaaacattcgcttctaaagacttaagacatttgaaagaagaattttgttacgtgatttgtaattgttgtggatgatataaatccccttgaaggattagtccaaaacttctaagaggccaagcttggtttaacttttagatgttgaattgaatgtattgccctaatgagttttagttttaaggaaacaacaaagatataagagttagttggcagttttgtgtgcagtgtatgaaaattccccttcccttgaaatgagtagttgtttttctatttgacaaatagactgaagggatttccccagatatcttaccttcaattattgctgcagcagtaccctgtgaagtaccagtgggcagcatcggtccagtagcatttatttcaggagctggagtttcttccgtatatagtgttttatccattttcttgcatttctggttttgtgttttgttgggatgtttgggtatagatgttttgatgtctttcagcaacaaaagatatgaatctttctaacattcatactgttttagagagatccacttgtattatctatgctttgctgaagcatcattgtttcattcttattttacagcatcaaggtaatggtagctttctgtcttgaattaggagagtgatattacttgtgagaagggttttggagaatagttttttctttaggctgtcctttatactatctcagttctaaacactagggaaaagttaattcttatctctaataaatatcctacacctagagaaagaaatatttacacatgcccatattcaacttctgtccatccatgaggattgaccactttttagatcaaacacaaacattgtccctagattattgcctttaattataagcagtaaaaccttgtggataacatctctttaagcttagctaatgaggaaatccttttgtaatctctttggctaggattttttatttgtgcatatataaatacctttacagaagaaagggagaatctcataatctaatctgtagtggtgtgagatcgtttagcatagtaattaagagttgttaagaccatgggctctggatttaaactgcctgagttcaaatctaagctcagccatcttgaaaaagttttttttgtgttttgtttggtttgtttgagacaggatcttgctttgttgcctaggctagagtgtaatggcacaaacatttcatttcagcctcaacctccagggctcaagcaatcctcttgtctcagcctcctaagtagctgggactacaggcatgcaccaccacactcagctaattgttttatttgttgtagagatgggagtctcaccatgttgcccaggttggtcttgaactcctggcctcaagtggtccccctacctcagcctcccaaagtgttgggattacaaatgtgaggcactgcacccaaccagaaaagtttttgaacctctccatacctctgtttcttcatttgtaactgagaggtactcatgcttcatagtctcattgtgaggcttaagtgagatcatgcatgtaagcacttagcattttgcctggcacataggaagccctaattgttagaaccaagagattgaaaggagagcagggttataatctttttttttcatcaaaataactggtttttattacattaagttatacctgtatatgtatgcatacatacacctatttgagtgctataatcttagaatgttcttgatattagtctgagtgtcaagttcttctataaactaggtggaaccaaattgaaggccagccacccgtcttggtaacaacattagtgtccaactaaagcatattaaagataaggcaaaaaagaagaaagagaacaagatggtaaataggcaagtaagataccgaggaacacagtgcctccatgagttgctaattatcaggccaaggcagctataatggggttgctacctgttgtctctataactagtgttcctgatatttttatgaggaggcacttggtcgttccttataacagctctgaggctcttcagggttcttgggctccaggttcagacccattagtctatacttgatgacatttgttcttaagtgtcagcttgaggagaatgagtgctggtctacagagatcaatgcaagtaaccatttaattatagaagaaatgctgaattgtaggttgcaatttctgggggttggaacttgagcagaatggtcaaaagcagattagagtttaagaataactagtaaagagtagtgtgtttaaggaggaaaagtacagttttgggttgggcgcagtggctcacgcctataatcccagcactttgggaggccaaggcgggaagattgcctgaggtcaggagttcgagaccagcctggctaacatggtgaaaccctgtctctactaaaaatacaaaaattagctgggtgtggtggttgcgcacctgtatccccagctactcgggaggctgaggcaggagaatcgcctgaacccaggaggtggaggttgcagtaagctgagattccgccactacactccagcctgggcgaaagagcaagactctgtctccaaaaaaaagaaagaaaaaaagaaaagtacagttttgctgtactctctttaaaaagatttgcaggccgggtggggtggctcaatcctgtaatcccaacactttggaaggccgaggcaggcagatcacttgaggtcaggagtttgagaccagcctggccaacatggtggaaccctgtctctacttaaaatacaataattagctacatgtcgtggtgcacacctgcaatcccagctacttggggggctgaggcatgagaatcgcttgaacccgggaggcagaggttgcagtgagctgagatcacaccactgcattccatcctggaggatagagtgagactgtgtctcaaaagaaagaaaagaaaagaaaagaaaagatttgctaacatactcagtacaccatcagaaaccatcaatacacctcagaaactgaggcacagacaagttaaacagttttccttaagttatatggctagtaagtggcagggctagaatttaaatctgaacctacatctgtttgaaagttgattcttgctctctacactgtgctgtctttaagtcctttctcttcccactcacatccaatcaatttctgagtcttgtccattatattattgtagtgtttctttcatttgtccctgctgttctgttcctgctgtcctagtttaaatttccattacttttggatagtttattgtggtaatcttctcattggtcttcccacctatcttttcaccctacacagtgcttcacaatatgatagttttcttaaatacagatcagagtatgtcactttattcctaaaattctttggcttctcactgaatatgaaataaaatttcagattctcagcgctgcatgatcttgctagcctgtatttctaaattttgaaccgtgtctcctgaatgtacatcgttactgcttcaaccacattggactactgaactattaggtgttctccacagtctttgtttatctgcctttgtacctttgctaaagcctctcctttgccttaaagtctttcccattttgacctgtcttgggcttattattcgtctcccatggttcaactcagatccccagatcctaactcttccatgaagttttcacagattgtactgctagttgaaactgaacttctttcctgttttctttttgtgttttgtatgttatccttaaaaaatttaaccccgtataccttatgtcgtggtacttttgaaatgtgtctgtctttgtcccattagatagtgactcccttaagacacgggccatttctaagtcatcatttatgttttatgttttttataatggtgactttttatatagtatttgttgaattgaaaatttgatgtccatacaacttttaggaatactttgctgggacacattacataaactaggagaacttaagactacgaacagaatatttggactaatcattaagaaatactaatttaagtatggcaaaggaaagcacaggtgccatgatgcgacatttttgtaaaggtattgattggggttttgaaagcgatgttagggtatcctgatgggatggcattatcttttatgtagataatacttagcactgatcatccccttacttgagtgttgtttccatttctaggttcctcaacttaaaagggatgaggagaccttggagacggttctgaggagactcaaaagatgattatatgattggaagtcagtcctatgaggaaaggttgagagaatgaaaggttaagaggcaacttaataactcttcaaaaaacatgaatggatccattattaggaatggtaaccagcggtttcccagctccactgacagcagaataagagaaaataggtttaaaccgaaatcaggagtagttgtgtaaagaacttattggtaatgatggttgtcattacagtcatggtaaaaaggttaccaaaataattttattatcttctctggaagtatattttaaaagtacagtcctgcctacatatgtataaaatgacctcttaagctaccttttccttctgtgaatcagtaaataaattcttattcagctcctcgaagcaataattactttccagtaggaagcttccagagatatttctttaggaagtaatggtttttgtagtggctttataggagaatacaaatttttaagtggagctaagagagaaatcttaaacatcaagagaaaccaaggaaaacagtaggtgtggtatcaatataggaaacaaataagtatttgtagcttttatgtccattttcagttgtcatttaaagaggtatagttcagaatagctcttgttaaggctgtcactgcttgtggatacattgtaacaaatgcttataaatcatttccaaactaatagaagtttgcttcatgttagttagtattataaaagcctctgacccttggcttttgaggctgtgtagagggcttgcatcactcagaatgaaacctttttagatatgttgggttgcagaaagcatttcctgtacagtcagaatgaaaacttgaattgggattattcatatagattaccaaaagtctgggcagagctgatattaccaccagccagttttcctactaactcttaactccaaaaccttcattgggttattgaagctttaggacttttgaatttcctactggaattgtgtatgaattccttctttcaagtgaactgatactagatttatttaagattagttatacatcttaagtattttttaagtggcatataatgaatggtctctacttttaaccagtctcataaaatgcctggggttcataggtgaagctggattgttgcaggaattctgcaattgttggcaaagcgaagggcagtttgactccttaattataaagttggatgtcatttgagaaactctgggaattggaagtagaacaaattcatactttccctataacttttaatttcttgtcatacattcagaaaacaagagatgtaaaattcataaaactgcttgtataaattcagaaaacgggattataaaagcaaagacaaattgtcttacgattctttgttctacttgagagattcaagtgttggagtaataaaaaataccagggactttcttttttttaataggttaatgccacctaatgtgggcttctcagaatgtgatggcaaacttccaaatatgatgtgggagccaaaagagaccaactggttttacaaaatattaagaacacaaaatttcccaactcatatatttgaatattcctaaaaaataataagtcaaaattgtgttggtgggctgggcacagtggctcacaactgtaataccagcactgtgggaggctgaggtgggaggattgcttaaggccaggagttcaagactagcctgggcaacttggtaagacctgatctctacaaaataaaaattttaaatttaaaaaattaaaaaaaaaaaattagccaagcatggtggcctggcgccttgtagtcccagctactcaggaagctgtgatgggaggattgcttgagcccaatgggtcgaggctgcagtgagccatgatcatgacactgcactccagcctgggcaacagagtgagactccatctcaaaaaaaaaaaaaaaaaagagaaaaaaaattgcattggccaacttggaggcttcagtgttattttgccaagaagaatgttcacttttgtcatctaattttacactgctccttcagcaaactgactttatggagagataaccctgtttacctttagaaagaaggaagttgtggattcctcagtcttactcccattactattggtcattcaacagcccatcttcccagaaggaaagatgtaacctgacttttgcgccagaataagaacaacaaacggaagaaaaaaactgagttttatagtagaagtttgtagttgaatgagcatgtagctcaaaatgaagttaaccacttaaacttgtcatatgggggaccaaaatttcttataataaaaagaactatatctgaaaataaagttggtgtttgtttaatttttctagcctattcaaatcaatctggtcatttatggtactttcctattagagaaaaataaaccctgtgattgtgatgcttaacttaattttctacagtgaatcagttaagtgggcttattttttctgctttagcaagtagataaaccagttcagacttggaacctgaggattctggaaatacacctttcttgagtttttggtttttttttttaaagattctgcagaataatttgggacattgccaggaatcagaatagtttactatctgaagtagtgcattcattttgctgttttttgtttttttgtttttaagacagataagctactttatgactacctctttttctgaagcagggtgggtggaggtcacctgtctcatttgctttgctgttttcagcatctttgctgcttattcttgttgacatggagtggggatgaggggtactacctatttctctagttacaaagtgagtagcatttgtgtttcttaggtgacagttgctaggtagaattgaattaaatatttgaaaactggacttcattcttgtgtgggtgaaatttttaccttctgttgttattgaagaacagagaattattgtcttagcgctctttaatcccaagtgacctttttgtgttaacatttctcaatatcaggcagagatcatatttaaacagtttcaatctcttcctatctgttatgcattcaaataatcattgttctcttgatgcaccaataaccagagagaatctgcccttgttcctgcccctgacaatctgttcacaagagaatatgatgtcagttcaataacagcatacatttcttgactggttgaatttcattaactatttggcttaagaagtttgccccttgatgtctgtgtatttgactgtgcttgggtatattatacttttcttactgattgagcagcattatttttatattctgcttttggaaatgatttacaggtgtcactacattttttttctactacaaataatgaaaaagtacctgcaaagaggctcatcttcctaaaaatggctatcataaatattgcattacaaagtaagaaatagaaattgaaaaatcgaattcatttatcaaagaacatcttttatactctaggtggatgaccagctactggggctctaccattggagacgtcccttccctcatgaaacttgctatctaattctttttttttttttttttttttagagacaggtttttgctcttccacccaggctgggatgcagtggcacaaacacagctcactgcagcctcaaactcctgggctcaagggatcctccttcctcagcctcctgagtagctgggaccataggctcacaacaccatgcctactaatttttaattttcttttctgttctcttttgagacagagtcttgccctgtcacccaggctggagtgcagtggcgcaatttcggctcattgcaacctccacctcctgggctcaagtgattctcgtgcctcagcctcctgagtagctgagactacaggcacatgccaccacatctggctaattttttatgtttttagtagagacggggtttcaccatgttagccaggctggtctcgaactcctgacctcaggtgatccacccacctcggcctcccaaagtgaatttttttttttttttttgtagagatggggtctcaccatcttatgtagctggtctcgaactcccaggctcaagcagtcgtcctgccttgacctctcaaagtgctgggattataggtgcgacccaccatgcccagcctctcattctttttaatgagctcagcttaaaatgtagcaggaatataagtattcacatttttaatactttgcaagatactttggaaattgataatctgaaggttgaagctctcagaactaatgttaacagaattgtccttgggagcaattcagctattcttcatttacggatttagtgattcttgagtcagttgtcttacaccaaatgtaatacatgaatcaggagggtttttctttgtttgctttttgtttttttaagagacgaggtctcactatgttacctgcgctggagggcagtggctgttcacaggcataatcatcatgtattacagacttgaaatcctgagcttaagcgattctactccctcagcctccaaaatagctgagaccatagtgcacacaactacgtctggctctgaatcaggagattttaaatgttctcaaagtatgtaatagctttttcagtcaggcatggtggctcacacctgtaatgccagcactttgggaggccaaagaggaaggaccgcatgagctcaggagttcaagacagtctgaacaacatagtgagaccccttctctacaacagaataagaataaccaggcatggtggtgagcactgtagtcccagctcctcaggagactgagatgggagcatcacttaagcccaggaataggaggctgccgtgaggtatgatcataccactgcactccagcctgggcgacagaataagaccctgtctcaaaaaacaaaactttttccctcctgttaaaatggaacttagatgtgactacatgctctgctgccttctaccatcaaagaagtgcccccttctttttttttttctttcttgttttttttttgagatggagtctcactctgctgcccaggctggagtgcagtggcgccatctcggctcacagcaacctccgcctcctgggttcaagcgattgttctgcctcagcctcccaagtagctgggattacaggcgcccaccaccacgccctgctaatttttgtatttttagtagagatggggtttcaccatattggccaggctggtctcgaactcctgacctcgtgatctgcccacctcggcctcccaaagtgctgggattgcaggcgtgagccactgtgcctggcggaagtgcccccttctatctaaggccaacctctccatttgagctctggatcccatctcctctcatctagtcagggttgtacctgcagttatctcatctctcctgctgcataggtaatttctctctcacaactagattggtcccatcaccatataaaactatctgccttaatataatcctttaaaaaaacgcttgaccccacgtccacctctagctgctacctgattcttttctcccttttcacagcaaaactccttgaaagtgctgtgtgtaattgctatttctactttctcacctttcattctttcctcaactactccagttgggcttttatccccatgatgcctctgaaatagctcttatcaaggttctcaaggagctctattttaccagattgaatagataattctcagttctcatcttgttaaaccctttggcagcctttgaaccagctgaccactcccttcttggatttttttttttaacattgtactcacctgtttttcttcttaactcattggctgttaattttcagtattctgtatggcttccctcctctgcttaactctcctgaataaggttcccaggagtctacttttcactgccttctctgtctacacactcttcctaggtcatctcatccaggcctcatctatacgctgacaactaagaaatctttttctctaacactgactacttctcagagttccaggcttgtatagcctgctgccaatttgatatttccatttggctaatatttactgagtgtttattgtgggccaggctatattctgagcacttcacatgaattatctcacctaaccttcatgaccattgtctgaagtatcactagtattcccatttcataggcaaggaaacacatatacattgaagcacttggatacctaataggtatctcttacttaccatatctaaaaagtcttgactttcttcctcaaaccttttccattcccagtctctttgtttcttaattattccaccaaaaatccagttgctcaggcctaacatgtaagatttatcgtcgatttatctcttttattcacatctcacatctatcccatcagcaaattctgtctgtattacatccaaaataagccctaaattcaactacctctcaacaactttgctaccaaaacctcagactctcccattatagtctcttggttggagttgcttatgttattacctcactaaagtttgtttctcacatagcaacagtaaactctggtatcaaatcctattccttcactttaaacctatctgtgtctccccacactgctaggataaatccagattccttactatggccaacaaagccacacgtaagctggcctctggtcaagcctacttctcgagcattgtctcttctcatctcatccattctgctatatagccacactagcctttttctgtctgtcatgcatgctgtgcctgttgctgtcttggggcctttgcacttgctctcaggctagaacactactccaccaaggtctttatatgtctgactttttctcatttaggcctaaccaggtttggcaagtttttttctgcaaagggccagatggcctctgttgaaactactccactctgttgttgtaagtgcaaaagcaaccataggcaatacagatgctccccaacttacgaaggggctacatcctgaaaaacccatacatcaaaaatgtcataagtcaaagatacgtttaatacacttacaagctcgtcgtaaagtcaaaaattgtaagtcagaccattgtaagtcagggactgtctgtccattaacaactgaacgtggccatgttccaatacaattttatttatgaacactgaaatttgaatttcatatagttttcatgtacacaaaatattcttttgactttaaaaaaatggttaattttttttttttttaattttaacttgcagaacaattgatggtgggccaaattcggcctgtggcccatagttttccagtcttcggtaaactattgccttagagaagcctttcctgtctaccctagcgaatataaccccacagctaacacctctccaccccccactcctgtcaattcttattgtcctagtgtcttttttcttcttagagacagggtttcactctgtcacccaggttggagcgcagtggctcagtcagttcactgcagcctcaaactcttgggctcacatgaacctcctgcctcagccttcctggtagctaggattacaggcgagagccaccatgcccagcccctagtgtcttttatttatttgttatatgtttattttctgtctctccattagattgtagcttcatggggcaggaattttgttagttctttacatgtatcttgagagtcaaacagtacctggcaatactcaataaatacttattgaatgattgagtgacagtcatatttgaattatgcctgtagcctgctatctggtcccccttttttaagtctttcttactctagttcattatatataccatttccagaataaacttcacagttaatgccttctctacatttgagaaccaatggtagcagtctgtattcattgcatttgctttgaccataccatacaagaattaacaaggttctgattatttcatttgtcttctatcttggccctactctggctaccccttttcagcctaatcagtttttaccaatcctccaatccttgcatctgattttcttccccctctctgccccttattattattatttttttttatttttatttttatttttatttatttatttttttttgaggcagggtctcactctgttatccaggctggagttcagtggcgcaatcatggctcactgcaaccttgacctcctgggctctggtgatcctcccatctcagacttctgagtagttgagactacaccacacccagctaatttttgtgtttttctttgtagagatggggtttcacattgttgcccaggctggtcttgaactgctgtctcaagcaagctgcctgcttcagcctcccaaagtgctaggattacaggcatgagccactgtgcccagccttggctacatttttaatacatttttaatttttttttagacaagtcatctccctttgttgcccaggctgatctcaaactcctggaatatcccactgcctcaggcccccaaagtgctaggattatagatgtgagccactgcacctggcctctccctgttactgttaatcagccattgctcattaccttcatgatctattttcttcagagctgcattctttaaaacttttagggccatgcatggtggctaacacctgtaatcccagcactttgggaggattgcttgagctcaggagtttcagaccagcctgggcaatatagtgagacctcatctctactaaaaatttaaaaaatgaaccttttttttttttgagacagagtctcacattgtcacccgggctggagtgcaatggcgtgaccttggtttactgcaacctccgcctcctgggctcaagcaattctcttgcttcagcctcccaagtagctgggattacaggcacctgccaccacgcccagctaattttttgtgtttttagtagagatggggtttcactatgttggccaggctggtctcaaactcctgacctcatgattcgcccaccttggcctcccaaagtgctaggattacaggcatgagccgccgcgcctggcatgcctatatatttctaagtatgtaggtattcctcagaactctgccatctaccctccttttctttcagtactatattctttccctgggtgactgaattcatacacagtttcagcattcatatattcattgagtcagatgtgttttcttcagatcattataccctttagacaacgtggataaacatttcaaattcagatgtctaaaatgatctctcttcccactcctttaaacctgtctcctttctgtgttcccagtcttggtaaataccaccataaacctaatcaacctaagccagacatccacaagtgttttattgattctttgcactcccttaaacctttatatcaaagtcttgtccattttgcctcctaatgtctataggatctgtccttttccccttaatccgtatggccactacagtcattttacaactgttcttcctgcctctacttctctactgctgtcatagcttttggcagcaaaaatccaaatctaatcatacttctctcctaccagagtcactaatctgctatagccttcaggatgaggtctacacgtcctcaaagataaacttcaaactcatgaaggcatataagacctttcatgatacacctcctgccttttttttttttttttttttttttttttgagacagagtcttgctctgtcacccaggctggagtgcagtggcatgatcttagctcactgcaacctctgccttctgggttcaagcgattctccgcctcagcctcctgagtagctgggactacaggtgcccaccaccacgcctggctaattttttttttgtattttttagtagagacagggtttcaccatgttggccaagctggtctcaaactcctgacctcatgatccacctgcgttggcctcccaaagtgctgggattacaggtgtgagccaccatgcctgaccgcctttttttcccttcaatatcttttgcccctttcccacatcagctaaggcctcagtcatccagaactatttttaatttcactccatgccacattcttttgtgtctctgtgcctttgtatgtgttattctctctgcttgcactacactcctcccccaccccccaccagctttatcatccttcgaaagattaagttttcatcctctctgcaatggccttcccgatcctttctccttgagtgggttaattgtctttctgctgtgctcctccagcagtgtcttcctctagcatagcaggcaacatacgatacttcattaatttactcatctgtttttaagattagcaggtccttaaagacagaagctgtcctttatctctgttttcataccgtagcctaggaatggccgatatatattttaatgagtgagtgaatgaatgaattggtacagtctgtcctcccaacctgagggcattctccctatgcatttttttttgagatgctttcaaatttattttattttggtttatttttgagacaggatctcactctgtcacccagcctggagtgcagtgtctcgatcacagttcactgcagcctgtatcttctggacttaagtgattctcccacctcaacctcccaagtagctgggactacaggcacccaccacacccagttaattttttctattttttatagaaagagggtttcactatgttggtctagaactaggctggtctacaactcctgggctcaagccatcctccctcctcggcctcccattgttaggatttcaggtgtgagccacctcgtcctgcccctatacattcttaaaagtaagaatcatattgtgtaattctttgaagtccctcagtattttctactatagtactattaccacagtaggtatttaatgttcttaaaacaagtttattgcatttcttttattttcattttacaaacatttattgggtgccaaatttgtgctagatattagaaatacaaaaatgaataggaaaactgtttctatcctcagagtacacactctaaagaagacaaatgtgtgaacacattttttaaaattccttctgctaatactagtaattatgtgagcatgtctttaaggtgcaacattaagaccttggtattttgaagcttgtagcagtagccacaaggggaaatgtgccagctgaagtgatagctacctggaataaattcccaaaggggaagtggtattctttttaaacttatcgctgccaagatgcacagtttgcctcctggatatttcttcaactttagttgttctcagtaattttgttagttctcctgtggcctcctcatttgatggaatgatatataatggtactagaagccttcaaaacaaagtatttcaaaaaacaagtgcatcaggagtgattttgatactgtctatggtattgatgttattttcaattgattcattgaaatttgttttgtaattgaagggatttgatttttcaaactcttttttttcccccctttgagacagagtcttgctctgttacccaggctggagtgcagtgcacaatctcagctcactgcaacctctgcctcctgggttcaagtgattcttgtgcatcagccacccaagaagctgggattaaaggcatgtaccactatgcccaccaaatttttatttttggtagagacagggtttcaccatgttggccaggctgatcttgaactctggcctcaagtgatccatccatctcagcctcccaaagtgctgggattacaggtgtgagccaccatgccaggccctgatttttcataagactaaaaattttggaaacagaagaatgctaagatatagctgctaaagggcatgtttgagatgcctaccacttaattaagtgctgtgaagtacctaggagtctcttgctagaaaaggaaggtgagggtgtgagcaaagtcatcctaggctgtattcatctgaggccaggagtattggagcttattcaatagaggaattctcaaagtagctctggagcctccatcttagcctggtaggtaaagaactctaggcgggtgatttttgctctgactatggtatattgaaaataatttttttttttttgaaatggagtcttgctccgttgcccaggctggagtacagtggcatgagctcttggctcactgcaacctctacccggccctcccaaccccccgccccgggttcaagcaattctccttcctcagcctcccgagtagctaggattacaggcgggcactaccacgcccggctaatttttgtatttttggtagagacagggtttcaccatgtctctggtcatgtcaggatggtctcaaactcctgacctcaagtgatctgcctgccttggcctcccaaagtgctgggattacaggcttgagccactgcctcaggcccaattgggaagaatttaagggaggaactaaaagctatgcattttagttggggatagggaagaaaacattacagtttatcagttgaaattttatcagatcagtggtattactagaaactgtgtcacatctagttactatagataatttaggtcttgattgcctaaactctgatttctagctctggagtgcctagttacaatactgaggaatggagatatacattgccatcctttggaagaattttgaaatttgaatatttctccatgaaccacatactaatatagaaggaagaatagactttttcttttttctgagatagggacttgctctgtcacccaggctggagtgcagtggcacgatctcagcccactgcaacctccgtcccccaggctcagggatcctcctacctcagcctcccgagtagctggaccacaggcatgcaccagcacacccagctatttttttgtatttttagtggagatgggggtctcaccatgttgcccagcctggtctcaaactccctgagctcaagcaatccacctgccttggcctcacaaaatgctgggtttacagtcaggagacaccacacccagccttcaagagttaagcaaaattttttattccagaatatgaatatgaattacacatagtattttatccttcagtaacattgtttttttagagacaggatctggctatgttgctcaggctggagtgcagtggattcacaggtgcaataataggggaccacagccttgaactcctggtctccagtgatccttctgtttcagcctcccaaatagttgggactacaggcgcacaccaccatacccagctattctttagtgacattttaatgcaactgatttttaaaaggaaggctgaaattgcacactgcctgtctgccttagatacttcttgggagcaggaatcatgtcttactcaatgttgtatctggaacatatagccctagggcaagtgtataaatgttttttgagtgaacaaatgaattaaatattgctttgtttgaaaagttgtcttagtagtacataattccttgaaacacagaatttcatgtatttttctaatataccttatattttatacacaaacattatgtttaatacttatttagggttcacttaggttcttttgtgggagaaatattcctattgcttcgtcactcacagaaataactggccactaaagaattaaagttttgccactaaaataaaatttctgaatattaagatatttatgaataacgtgaatttagtggtaaaggtatgcttggaagctctcaaataactggttaccccagagtggagatgcaggggtcagaaagaaattctacatgtttattatttttacaactagatttcacttaggaagtgacattacatagcttaatttgctgtcttaatcactggaagctaaatatgagttaacagtattttgcagtgctctacttggcaagggtgtttttctatctttgctggtaagaaaatgaaatattggtgatctagtctccaaggacatcagtgtcagcaaggtttaggttttgtggctatactgtcttggaatgctgtgctcatcagagtaggccaagttgaaaggaaaagtgtgtgatgaatggttgcctgagcccagttcccaggagtccctagtcatgtatagcatgatgtctcctgtaccctctctcttcagggctgtccaggcttatgatgccacgatgccaaatgtggatttaattgtagcttcttttgtcttttttatacacatattactgtagtcttttgatttctagataagtttaaatccttgggaagccaacactcttaccttgtttccaacctccagggatcccatgtgcttaaggagagtgatggagcaagatgagaagcctgttgctcatgatagtgcagtgaaaggaggacttttttgcagcaccctctttatttatttatttatttttgagacggagttttgctttatcacccaggctggagtgcagtggcgtgagcttttggctcaatgcaacctctgcctcccaggttcaagtaattctcgtgcctcagcctcccgagtagctgggactacaggcgcgtgccaccataactggataatttttgtatattttgtagagacggggtttcaccatgctggccaggctgatctcgaactcctggcctcaggtgacccacccatctctaccttccaaagtgctgggattacaggtgtgaaccaccatgcccggctgcagcaccctcttgtagccttctttcccagtgctttctcaacttggctttacttagtttttttgttttgttttgttttgttttgttttgttttttagggctcttacataggcttggaagttccaagttagaagactggagctctttaacataacaatgacagcttttgtttttggctaagctgtccggattatttaaacaatgggtacttattttttaaagcatgcttcaagaaatcaatcaatatttcaagtgcaaagaaagttcttgggtaaaagtatagttcattttgactacttatttttatttatttatttattttttgagacagagtctcgctctgtcgcccaggctggagtgcagtggtgcgatctcggctcactgcaggctccgcctcccgggttcacgccattctcctgcctcagcctcctgagtagctgggactacaggcgcccgccatcacgcccggctaatttttttgtattttttttagtagagacagggtttcaccgtgttagccaggatggtctcgatctcctgactttgtgatcctcccacgtcggcctcctaaagtcctgggattacaggcgtgagccactgcacccggcctgactacttattttttatttccttattccaagtacaagaccagaaggaaaacgaattaatgcttcctgtcattttggaaagtacttagaaactttaaatattggcagttaaactgcctgacagctcagtggaactcttgttttggaatacattgcagttaggattatatagttacattttgtaaaagtttgaaatatataaaaatgactcattaggttgttaataatgaacctaacagtgtgtatctcttacatttatctttattttttttttttaaataaagatggggtcttgctatgttgcccaggctggtcttgcactcctggggtcaagcaatcctcctaccttgtcctcccaaagtgctgggattacaggcatgagccactgcacccagcccatttcttttaaagattaataactttttattacctgttgaatactttacctattgattattatatgtatagttgcttgagctgtcaatcattgtagcatttggaacataaaatgcgtgtatttagcaatgtagtcccctagtaagtgttgggaaatccccagatgtctttgtgaaatgcatagattagcaggttgttccacgagtataattcaggaaaagaatgaattaatcagaaatttgaaggatctgaaaatggccatcatgtgacttttacagtagctaaaagaatagcaatttttgtactttagacaacttattcaattcctttaaatatttattgttttatattgtatctattatggtaggaaaactattctacagccagtttagacacttaggttctttgtagctaactgtgtgatcttgggcaagtcatttggccttttagagcttcattttcttcaaacacaacaataagaactactatgtgaggggacttcaaagaaaactcatggaaaaatacatattatgaaaaaactgcagaatttcaaaattttgtatgcaccaaaataaacttgcactaacttgtcataacatatctgaacaggatgtagtttgaggcactaagaaggataagacatcagtttgaaaagagcccctatcagagcaacataagttctgctaaaattgaagcaaaaacaaacataaaatttatggtgaagctgggtgaaagaatggtgaaatcattgatgctttacataaagtttatggggacaatgccccaaataaataattggatggctcattttaagaagggacaagatgatgttgaagatgaagcctgtagtagcagactgtccagtttgcaaggaaaaaattcatcttgttcatgccgtaattgaagaggaatgatgattaacagcacaaataatagccaacaccatagacatctcaattggttcagcttacacaattctgactgaaaaactaaagttggctgggcgtggtggctcacgcctgttatcccagcactttcagaggccaaggtgggtggatcacctgaggtgaggagttcgagaccagcctggccaacatgacgaaaccccatctccactaaaaatacaaaaataaccaggtgtagtagtgcatgcctgtagtcccagctacttgggaggttgagacaggagaatcacttgaacccaagaggcagaggttgcagtgagtgagccaagattgtgccattgcactccagcatgggtggcaagagggaaactctgtctcaaaaaaaaaaaaaaaaaacctaaagttgagcaactttctaccaaatgggtgccaaaaccattgcacccaaatcagctgcagacaagtgtagagcattcaatggaaattttaaacaagtggcagcaagatcctgaagcatgtctttgaagaattgtaacaggagatgaaacatggctttaccaatacgatcctgaaaacaaagcacaatcaaagtaatggctaccaggaggtagaagtggtccagtcaaagcaaaagcagactgtttaagagcaaaggtcatggcaacagttttttggggatgctcaaggcattttgcttgttgactttctggaggaccaaagaatgatagcatcagcttatttgaaagtgttttgagaaagttaaccaaagctttagtagaaaaatgcccaggaaagcttcaccagagtcctgctccatcatggcaatgtccctgctcattcctctcatcaaacaagggcaactttgtgagaattttcatgagaagtcattcagtatcattaagtatgctgatttgtctcctttgccttttttgtttcccaatcttaaaaatctatgaaggaggcggagcatctaggctgaggcaggagaatcgcttgaacccaggagacggaggttgcagtgagccaagattgtgccactgcactatagctaggtgacagagtgaaactcttatcttaaaaagaaaaaaaagaaatctatgaagggcacccatttttcttcagttaataatgtaaaaaagactgcattaaaatgtttcagttcccacgacccccagttctttagggatgggctaaatagctggtatcatggcttacaaaagtgtcttgaccttggagattatgttgagaaataaaatttatatttttaatttttatcttttaattccattttccatgaaccttttgaagtcccatcatatgtatgttgcctatagctttccaagtgatttcacataaattatttattccttacagtgctcaaataaaaaatgaaattgagggatagatacagtaagtgagttgtctaagattacatagtctgagagaatcagactgagaccctaaaccaacccttctctccccacatccagcactctcctcactggcatcacgtatgagaagactggattggccccctctacaattataatattctatgatttttttgtttctgaagtgatttgccattacctattttatttgctttttcctcaaaatatattttagggttactatttttaatgtcttttttttctgcctgaaagtacattttaaaagttaacagtatggaatttcattattgtgataagattttatattaattgtgctgttaggagttttggctgtttttgttttgttttgtttttttggtaacattgtagcctacaagtgtaaaccctgaaaatgattccagaaatttatttggggttcagattcacatgttgtaggttagttatatactaacttgttttaagatgaagagagataatttttttattttaaaattacttttagattttttttagattgggaggccagtatgggaggatcacttgagcccagaagtttgagaccagcctgggcaacatagtgagaccccgtctctgtaaataattttaaaattagctgagtgctggtacatgcctgtagtcccagctgcccaggaggctaaggcaggagcattgctagagcccaggagtttgaggctgcagtgagccgtgatcacaccactgcagtacagcctgagtgacagagtgagcactggcaaattttaaaattttctgtaaagactcactatgttgcccaggctagccttgaactcctggcctcaagcagtcctcccatattggcctctcaaggcgctgggattacaggtatgagctactgtgctggccaagagagaatttttcttattcacaaataatgttcacagtaagaatttacttaaaatttttttaaagtaaaaagaactggctgggcacagtggctcacgcctgtaaatcccagcactttgggaagccaaggtgggtggatcacttgaggccaggagttcaagaccagcctggccaacattgcaaaagcccatctctactaaaaatacaaaattagccaggtgtggtggcacacgcctgtaattccagctacttgggagggtgaggtatgagaatctcttgaacctgggaggctgaggtggcgccattgtactccagcctgggcgacagagcaagactctgcctcaaaaaaaacaaaacaaaacaaaacaaaaacaacaaaaaaccaacaaaaaaagaacttacgtgtaagaatttaaattagtgatgaaagaagaaactgtaaaaagtactccagtaagccaggcatagtggtgcatgtatgtagtccgagctatgcaggaggctgaggcaggagtatcacttgagaccaggaattaaagaccagcctgagcaaaatatgtaattaaaaaaaaaattactgtagtctgtgttccttaaatttaggtttcatacattcttagaattataatactttttcatggctgggcacagtggtgcatgcctgtaatcccagcactttgggaggccgaggtgggcagatcacttgaggtcaggagtttgagaccaacctgcccaacatggtaaaaccctgtctctactaaaaatacaaaaatgagctgagcatggtgacaagggcctctagtcttagctattcaggaggctgaggcaagagaatcgcttgaacccaggaggcggaggttgcagtgagctgagatcgcgccactgcactccagcctgggtgacagagcaagactccgtctcaaaaaaaaaaaaaaaattataatactttttcagatgtctttgaagaggagaatttcagccttttcttaaatagtccaatactttaatcttagcaatctcagagcaaaagcctttttagatgccagtaagacttttctctcagttgcctagtatgcaaaggctgggccttaaatgttttgctcctctaaagcatttaaatttaagagatgaacctgctaatttgtcctaaaagttatatatgtcttttaatatagtcatggctgaaaaatggctaagacagttagcacctgactctagttttaaattaactgagaaaataatccttcagaaaatcattgatgttgtccacatacatgtgttcttacctctcgagaggaaaatgttaatgcttttgtcattggaactcagtttgggacttaccactataaattggaggttccagaatgtctgttcttcattccttattttgttcttgttttatgtggattttgtttctggaatctgaaattctatcattctgtgtctgtctctggaaagaactcaatctctgaatcattgaatttctattaatcagtttgtttaaatagaccatctttcttgagaacttgtgcaaaataggttaaacaaatcctttttttttttatagagcaggttaaaattagaggtaagcagaagcttttgctttttgtcctttccaactataactgaaaataggatgcttccctaagttttagtaaaggatttcatcctatatgcagtcaattcatgatccctttcacaaacgctgctgcccaccattaagtctcttatcacaggcatttttaaaattataccataaaatgcatgttgagactctctggatctcaaatgtacagaaatcacatctaaatgtcaattcctgagttaaggaactgacaattatggcactttcagtctctattaatatttagaaggcaagagattattatattgtttatattactccttatgtgtctgtagacttaaatactttttgaaaagcatttgtttgttgtattggggctgtatgtttctgccattatacttatttgcttacctgatttaaagttgtcctttaattgttttgggctgtatctatagtttgaaattaggactatcctctgtgtactatgcaccaaagatgacatttcaatgcattgttcagttactacacagctcctatttgtctgtaataaagctgtatggctgggtccatttatttcaatattagttattttatagtatccattggaatgatgataattaatatataaaggcaacttttccaaattcatttgtgtctcctctgggcatttctttgggatgtgtttgtatgcacgtttttgcttctgattttaaaataattttcctttgttgtaggatgagcaattcttaggttttggctcagatgaagaagtcagagtgcgaagtcccacaaggtctccttcaggtacggccaattaagtgcatggtgccttttaagttttgtttgttaggagattgtggcttcctcttgccttctttacatgtaaaggatgctctaccatacttgggttaggaaatggctgatgagctagacttctttttatttatttatttatttattattgttatactttaagttttagggtacatgtgcacaatgtgcaagttagttacatatgtatacatgtgccatgctggtgcgctgcacccactaactcgtcatctagcattaggtatatctcccaatgctatccctcccccctccccccagctagacttctttatgggactcttatctatcaggccacattgggtttattctttctctctgggaactacttggggcatgggaagtaggtttccacagaattactgggaaatctggtaggcaaagtgaaggtaacctagtaagagtatcctcagatttacacattttgtgttatgtggtagtgtatatgtctttgggaataatttggccattattttttttggatgaaatttggtccactattgtcaaagaaccaaaaacaaaatattggcattatgtgaaacatttttacctgattcttgaaaggctgtattaaaataaaaaaatggaaaattagcaatatttgtcattattctcaccaacaaaatatctagaatatcttgaaattctagacttacaagcagtttcctaagagaagaccctcaatggaaataacatttaatggcttgcctaattcagttctgtataggagaaagctatgtatcttttgatgaaaatgcattccccatctgtgctgccattctgacttcatatatggttttctttgattttatgtggatagacactccagctaaatatgatattgttagctgtttctgctttttgacattgacttagcttgtgatgtgtgctagcattagggtctcacttaagagtcatcatatattatcatctaattcaaacatccaagttgacagtttttcttttcttaaagaggagtggtattgtcattctagttgggggcagttggccagtagtgtcccagtatctgtgctattcagacagtagcagtgttctctttaacatgtgatgaagtcttaaaacttcatataggaaaggaattagagagatcatctgggatttttgtttgtttgtttatagatgaaaaaatgaggtccatgaaatacatgagtaatgatttataaccagtttgagagttctttggatatgttgtggatcagggaagttagcagcagtgctgggactcttctctgttctgctgcttctacttatctaccaaaagagttttttaaaaagtaggatagaagaggttttcagaattgataaagccctctgattggccaggttcaagtctaccacaatggtaaggaatcttttgatgtatttccgggcaggagttgttttgtttgtttgttgtttttgtttttgtttttgagacggagtctcactctgtcacccaggctctgggcaggagttttattttgttaattcacaactttttcatggtagtttcctcttaagttttttttcatgactaccagtctaccttgaatgttgtcttgttttctaagaaaccatctcgatatgcttcattatttgagaaatgagacatggtttctctgctgtctcctagtttattacctttgttgtaattaggatatgttgagaaaggagctgtgaatccttaatctattaaaggaagtctcataaattaattgatgaggaatgcatttatatttagaaagctcaacaataaaacctttgttgacttctgttctgttagcaagcagttccattgtaaaaatgttcatctcttttggtgcctattaagggaagttttagtctcagaagaatgttatcaaaagggaaaagaagatttgataaaatagcctagtcttactactttttaaaatacaggtttatacaaggtgttttagaaacagtcttgttttcttgaatggcttgaaaagcagcaaactgagcttatttataaattggcaaattccttttatttagaatagaactttgatttaataagttgtcattttgctgttgacatcagttaaggttaaatctttttgcaacttgagactagctcaagaacctctaagcaggggagtagatttagtggacacattatgtcacttcactgattagttcacatgccactgagttcagtggtcttattctgatgtgtcataaatgaacatttttctattcagtaaaactttcttagtctactttggcaaaacagattgaaatatgggactctgagctgcccaaggagttggtatgttgatgattgaagagcagcgtattcaaatttgttcaaagccagaattctgaattgaaaagatgggatgactaactagaagcatattcttaaatgttaatcttggtggctaggatatggcgaggaagttcagatgttttttctttacaattcctttgaattcagaaaaaaccttcttgctcatctaaaattgtaagaaaatcagttttgtggattaattgttcaactgaaaactttttattatctttttgtatcaaaaaagtaattaaatgttctttcaggtggaatgttatttgctgacttctttgaggcaaattttgggtgaaaagaaactaagcacaattaagatgtttgattgactcattagactcaagttgaactcagtacaaaatggccagtgctaagttatattcagcttagttaaaacctaaactacacagctaaatatatgctcttcattgtttaatttctatacacagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacaggtactcttttccaccttgcctattaaaactaacagtttattgagccctttctatgggcaagttttaggctaagtggttcaattacatccagttatgagaaccaagaaaagtatggtggaggcagtggtatttgcagtagtccttcaaggaccagtaggattttgataggtagaaagtggcaggacataacattctaagtagagggaacagtgtgggtagaaatggaaaagtaagaaatatatttgaggaatactggatagctggattggcatctgtggaaaactggtgaactaaggctgaatgaactaaggttgggactatatcacagaggatgctgagttgtttgtaccttataagtttgatgtaattaaaccagggacttaattgtaaaggtacattttaatagtcaaattgttttactatccccgatagaatagaaaaccggaggggagcattctcttcctctgagtagtgagggattggagcaatagataatatgtttttgcagaatacaaatgagaagtactggccaggtgcgatggctcatgcctgtaatcccatcactttgggaggccaaggtgggcggatcacttgaggtcaggagtttgagaccagcctggcctggccaacacggtgaaacctcatctctactaaaaaaaaaaaaaaaattagctgggcgtggtgatgcatgcctctagtcccagctactggggagattgaggcacaagaatctcttgaaccccggaggtagagatggcagtgagctgagatcccgccactgcactccagcctgggccaatagagtaagtctctatctcaaaataaataaataaataaataaacaaacagattagaagcacttagccttgagccatggaacaggaaagctatagaattcagttagttaagatgatgccaaatatttttacaaagaccagcatttttgttttttttttattgttttgtttatttgtttaacaaagtaagctagtcactggccttttctgagaaaagttgctgatctttagggttttaaaaaaatcgtcatgtagtagatgcctatttatggcagcaaatcaggttaggttaagatggccataaacttatatttgtaatgttattcacgggctgggtacggtggcttacgcctgtaatcccagcactttgggaggccgaggcaggtggatcacgaggtcaggagatcgagaccatcctggctaacacggtgaaaccctgtctctactaaaaatccaaaaaattagccagacatggtggcatgcgcctgtagtcctagctactcgggaggctgaggcaggagaatcgcttgaacccgggaggcggaggttgcagtgagccgagatcacggcactacactccagcctgggtgacagggcgagactccgtctctaaaaaaataaataaataaaattaatgttattcaacctagggccatagttacatttactaattctgccagttgagaattgtagcaggaatgtgatgggacttatttttaacaccatgttggatgtttttgtgataggagcagcggctctttaaaatctgagacatttcttttggagccttttatactttctcttttttttgagacggaatttcgctcttgttgcccaggctggagtgcaatggcgtgatcttggctcactgcaacgtccgcctcccaggttcaagcaattctcctgcctcagcctcccaagtagctgggattacgggcatgcaccaccacgcccagctaattttgtatttttagtagagacagggtttctccatgttggtcaggctggtctcaaactcccgacctcaggtgatctacccgcctcggcctcccaaagtgctgggagttgcaggcgtgagccaccacctatactttcatttataagttatttcacccctacttctctgatgatcaaggaaatataagaaatagtttttggttagataagccgtatttataccacactgaactttttgataatatagactggcagcttgaattttgaggggaatttaaaatagtagtataattgggaatagaagcttagttgtttgtttgtttttaagatagggtctcactctgtcacccagggtggctcaagtgatcctcttgtcccagcctcctgagtagctagaactacaggtgtgtaccaccacgcccagccaatttttaaattttgtgtagagatgggttctcgctatgttgcccatactggtcttgaactcctggcctcaaatgatcttcccacctcaagctgttttttattttttgattagaggcctttttttgtgctgccaattaggatacagtaatagttgatttctgttttgatatgatttatcagctgggaataattagagttgtgtgttttgattctaaatcatactgaaattgattaagtataccttggcttcgttcagttataatttcaacatgtatggttgttattgtttttggattgcctcatattcagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatggtaggtcaagaaggtcaatcttggagtcggaacagacttttgatttgtttgttgattattctggggatgcccagtaggctcttcatagttagtaggtcctctgaaaaacagatggcaagaggggattaaatacatgaggattttattagaagaaatgcctgagaaggaaaacggggaggtagccagggaaggctgggagagctgtcagactgtgttgcccatctcacccccatgaaggagcaggggaaggaaggcagaatcttcctagactgctgtgcaggtgagaaagatttggcaaagctgtccaggagtctttgagtaaaagtggactgtcaggggagtgggaggcacattctcatggctgtcatatagttcttaagtgcagagtagccactcagaacaaatttagaggtttgaagaatccttagaagcatttggtttctattctcgattttagattagacttttgttttcagtatttggaattttgctttcatcaagatgcaagttattggctttttttttttttttttttttttttttgagacggagcctcattgtgttgcccaagctggagtacagtggtgcgatctcggctcactacagcctccacttcccaggttcaagcgattctcctgcctcagcctcctgagtatctaggattacaggcatgtgccaccatgcctggctaatttttgtatttttagtagagaggggttttgctatgttggccaggctggtctcaaacccctgacctcaggtgatctgcctggctcagcctcccaaagtgctaggattacaggcatgagccaccattcctggccaagttattggcatttttaaacatttaaataattatttaaaatagattctgagttctgtatataaatattttattttaatgtatttcatttttggagtaccaattaaaaccaggtttgaattcagtactcccttggaactaatgccacatttctttaacagacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagtaagtgggtgtttcactctgagatgttgacctctcaaccataaaggttgcttatttatccctagtttgttgcagagatacatcaggaaactgaatgtggttgtaattgagttgcaagacttgttacagttagattttgtggtgtgggctgtgcttaaataagaaatactctggggccatgctgtcattaatagaatgttctgcaacaatggaaatgttctattggaatagtagacaacaataatggaaatgtttagttcagtatgcagccattagccacatgtggctattgagcgcttgacatgtgattagtgtgactgaggaaccacactgtttatttcgtttaactttagccatgtgtaactagtggctaccatatcagactgtagctctggaggatttctacttaaaacctgacaactttatgtataatttttgttgggtctactgaaattatgttgacccaacaaaattatgacaattcaggaaacattggagataccttgcataaatatctgtgctttctcactctctcttagaatatgttcatgcatatggaatttttttttttaagagacagggtcttgctctgttgccaggctggagtgcagtgacatgatcatagctcactgccaacactgaactcctaggctccagtgatcctcctgccttggcctcccaaagtactgggattacaaacatgagccacagtgcttggcctcatatgaaatttctttttttaagaagttttgttttaatttttatgggtacatagtaggtatatatatttatggtatacataagatgttttgatacaggcatgcaatgcatcataatcatatcatgcagagtggggtatccattcccttaagcatttatcctttgtattacaaacaatccaattatactctttcagtcatttttaaatgtacaattaaattattatttactacaatcaccctgttgtgctatcaaatgctaagtcttattcattctttctgattatttttttgtacccattagccatcccctaatatggaattttttatgtggaaatttttattactctactttttctcctcttttttagtcagtttgtggaggtactttctgccatctggcatactttatttaaaatagatcgagatagtagcataaacagaaattttggtgattaagcatcttgtaaactactggcacaaataataggtgtcaatagatatttgctgaatgagtgagtcacatgcaagtgattaatataaagaacagttgggagaaatgctacattatttacttcaggggagataatttctaggagacaagaagtagttctgtgctttggtttggtctgaccttaaacaagaatcttgtctcagtcctgttagtggaaagaagtaaactaattcacagatcacaaaaaagtacatgatagcaagataaagttgcattaaatttaagagttaaagtggattcagtgcaattgtagacttcagattacatttgaattttattaaatctaaatttaggggtgaagtatatatcaaagccaccagatttaattatagcattatagtggtagacaaaggagttgtttgataattttagtctgttttgtgttaagattacttgatggatattaacatcgtaagagagtaggactgatgcgactacaagaaatactgactgatcattttctgtgtggtgctagtcagtgttggattacaagaaatttgagtcccatttcaaaaataatttgatatttgctccttttagatcctaaaggtaggtgaaattgctgatccagggattcaaaggctcagatttaatctgagtaatgagcagtccttttttcaactataaaaatgtgaacctgaatacagattcactgattgttgcagacaaaatgaacacttgtttcagtgcttttcttctaaatttaatttgtttcatggtttattcgttgttttcctaggatgagaaaatgtcagaatctacaatggatgccttccaaagcctacctgcagaagcaagctaaaggtagtgttgttaaaaaggtcttcccccaaatgctccttgcttaaatggtgtatagttgtatacacccagtagaagagaatacttttttttttaaagtacaactctttctcagggagtagattgttgaagctaggtaataggtacatgggggttgattggactatttcctgtattgggggatatttttgaaattttccataataaattttttaaatttatataaaaatcatagttcattatatttcctagagcaataaagtatacctatttcacctgatcaacttggcattaactttctttagcctttcaatgctaacttttaactgcaggaaactgagaatgttgtgtcacatttctacgcttctattttttaaatgtatttttttaacttatttttaatttttgtggatacatggcaggtgtatttatttatttgtttattgagacagagtctcactctgtctttcaggctggggtgcagtagcatgattatgactcactgtagcttcaacctcccacgctcaagccatcctcccacctcagcctccctagtagctgggactacaggtgcgcaccaccacgcccagctaatttttgtaaattttttttgcagagacacgattttgccatgttgcccaggctggtcttgaactcctgggctcaagcaatcctctcgccttggcctcccaatgtgctggaattacaggcatgagccaccactgcacctggccagcaggtgtatatatttatgggggtacatgagatatgttgatacaggcatacaatgggtaataatcacatcagggtacatgggatgtccattacctcaagcatttattctttgtgttacaaacaaactaattatactcttgtaattatttttaagggtacagtaaattattgttgactgtaatcaccctgttgtactatcaaatactagatctcattcacttctatctagctatatttttgtacccattaaccatccccactttccccctcaacctcactacccttcccagcctctcataactatcattctctctgtctctatctccataagttcaattgttttaatttttagctcccacaaatgagtgagagcatgtgatgtttgtctctctgtgtctggcttatttcacttaacataatgtcctctagttccatccatgttgtttcagatgataggatctcgttcttttttatggctgaatagtactccattgtggatatgtaccacattttctttatccattcatctgttgatggatgcttagattactttcaaatcttggctatcataaatagtgctgcaggaaacatgagagtgcagatatctctttgatatactgatttcctttattttggtatatacctagctgtgggattgctggatcatatggtggctctgtaattctattttaaataaaattattctcactatagacagatgatgttgttgtgtttttccctcagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtgagtgaggagggcaagaaggaattgctgaaccacaagtactaacaaaaaagcactgatgtctcaaacagcatttgaaagcaggaaatgtatgatttgaagtcttcagttcaagaaaatcagctctctttctaactattatgtttaataataaagaaacagaaacaaaaaaaacagttaaattggaggtattgttttaatttcctgttcgaagcctagagtttaaatagttttttttttttttttctaatggccctttcttcacaggtcagtcagtactaaagtagtcgttgccagcatctgactgcaatttattctgaattttttaggtccagagcagagcaaacagaaaaaagtggctccccgcccaagtatccctgtaaaacaaaaaccaaaagaaaaggtgaggagagatttgtttctctgccatttctcagggatgtattctattttgtagggaaaagccttatccttgacttctatgtagatggcagtggaatttcttaaaattaagaaacttcaagtttaggcttttagctgggcacggtggctcacgctggtaatcccaacacttagtgaggctgaggtgggaggattgcttgaggccagcagttcaagaccagcctgggcaacatagcaagaccctgtctttatttaaacaaaaaaaaaaaaaagaagaagaagaagaagttagccaggcatggtggcagttgcgtgtagtcccaggtactcaggaggctgagatagaaggattgtcttgagcccaggaattcaaggctgtagtgagctatgattgtaccactgcagtccagcctgggtgacaaagcaaaacactgtctccaaaaaaaatttaggcttggcaaggcgcagcggctcacgcctgtgatcccagcactttgggaagccgaagcaggcagatcacttgaggtcaggagttggagaccagcctggccaacatggtgaaaccctgtctctactgaaaatacaaaaattagccggttgtggtagtgggtgcttgtaatcctagctacttgggaggctgaggcaggggaattgcctgaacctgcgaggcggaggctgcagtgagccgagattgcatcattgcactctagcctggacaacagagctagactccatcccaaaaaaaaaaaaaaaagtagccgggcacggtggctcacgcctgtaatcccagcactttgggaggccgaggcgggcggatcatgagggcaggagatcgagaccatcctggctaacacggtgaaaccctgtctctactaaaaatacaaaaaaattagcccggcgaggtggcgggcgcctgtagtcccagctactcaggagagtgaggcaggagaatggcgtgaacccggggggcggagcctgcagtgagccgagatcgcgccactgcactccagcttgggtgacaccgagactccgtctcaaaaaaaaataaaaagtttaggctttagcctgtttcttttttggtttcttccttgttgcttttcccttctttgtggccccacatgttctagcctaggaatctgcttattctaaaggccatttggcgtaattattttttgaccccaacatcctttagcaattatttgtctgtaaaaatcacccttccctgtattcactatttttatttattatggataaagagatagtgtggtggctcacatctataatcccagcactttggggggccaaggcgggaggatcacttgagggcaggagctggagaccagcctgggcagcacagtgacacacagttgctataaaaaatttaaaaatcaactaggcatggtggcatgcacctgtagtcccagctactcttgagaagctgaggcaggaggatcacgagcccacaaggtctaggctgcagtgagctgtgactgtgccactgtattgcagcctaggcaacaaagcaagacccagtctcttttaaaaaaaaattcaaagattatttgtttatgttggaaacatgttttttagatctattaataaaatttgtcatttgcattattatctgttgcaaatgtgaaggcaaatagggtgtgattttgttctatattcatcttttgtctccttaggaaaaaccacctccggtcaataagcaggagaatgcaggcactttgaacatcctcagcactctctccaatggcaatagttctaagcaaaaaattccagcagatggagtccacaggatcagagtggactttaaggtaaaggtgttcagtgatcataaagtatattgagtgtcaaagactttaaataaagaaaatgctactaccaaaggtgttgaaagaggaaatcagcaccaactgggggaatgaataagaactcccattagcaggtgggtttagcgctgggagagctttggtcagtgttgttaggtcactgtttgtgaactgactgcagaacatacataatgaaacattcctatccatcctgagcagtatcagaggaagtaattccttcacatggaaagtatcaaaccatgatgattccttgagtcagcaaaactgtaagagaaattcaatcccagtgtattttcgcaatatattcaatatgaattgaacaactaggtgagccttttaatagtccgtgtctgagattaaaactttttaaagcagcagttatttttggactcattgaaatgaaatactctgacattgtgatgtcacactaattttatgcttttcatccttattttccatccaaagttgtgtaattgtaaaactttcctaagtgacctttctctctccacaggaggattgtgaagcagaaaatgtgtgggagatgggaggcttaggaatcttgacttctgttcctataacacccagggtggtttgctttctctgtgccagtagtgggcatgtagaggtaaggcatcctgcttctttgtaccccaggaagtacataaattatttttctgtggatgaaattactatagtctgttttgttggtatttagcaggtactattccctgtttaaaccagctaaagaaatgttttgaagtattttagagattttaggaaggaatctgctattagagtagcaaagttattgagagtgaaaagatcaataatcccatctctcttaaattcagtctttattagagttctgatctttctgttagatgtctaaataagagaaaaaattatacagtggtctattaaaagggatgctattgatggttattttatattgtatatcaaagcctcttcatctataaggagctcttaccaattaataagaaaaaggaatgacatccagaaaaaaaaataggcaaaagacagaaatagataattcacaaaattagaaataaatacatgttgggtggcagggggaggtgaagggagggtgtctgttttttagccctctagtgaccaaaaactggaaattaaagcatgataaaaaaagaatcctgaataaatggggactttctgttggtggaaagaaatatagattagttacaatctttctttctgagggaattatttggaaatatatatctatctttaaaataggtatatcctctaacatagcaattgcacttcaaacacttatggatataattagataaattggcaaatctgtagatataaagaagtgttcatttcaatattgctcataataataaaaaactggaaacaacccgaaagtccatctatagggagcatgggttaaaataagcatagggcatatagctgggcacggtggctcacgcctgtaatcccagcactttgggaggccaaggcaggcggatcacaaggtcaggagatccagaccatcctggctaacacagtgaaaccccgtctctattaaaaatacaaaaaaattagccgggtgtggtggcgggcgcctgtagtcccagctactcgagaggctgaggcaggagaacggcatgaacccgggaggtggagcttgcagtgagccgagatcgccccactgcactcccgcctgggcgacagagcaagactccgtctcaaaaaaaaataaaagtgtagggcatatataatggcaaatatgaagtcctaaagataatatatattaatattattaggttggtgcaaaagtaattgcagtaataacatggaaagatgtccatgacatatcactgagtgaaaagagcaggttacaagataatatataaagcacaatcccatcttagtttggaaaagtgtttttaaagtatatatctagaaaacaatctggaaggattcacaccaaaatattaagagtgtggttggattatgggtgacctttatttgtttctctggttttttttttttaatctttctgagttttttgcagtatgtaccacctttacaatgaggaaggaaaaagtagcacaattttaaataggaagcagtagtttgtcatttataagggacatatcctacatcctttacagttcttaaattcctggcagatacctctttggcttattacttaccacataagatatgtattcaaaggtggtaaagaaaatccacgtcgggtgcagtggctcacgcctgtaatcccagtactttgggaggctgacgcaggaggaccgcttgagctcaggagttcaagaccagcctgagcaccatagtgagacctcatctctactaaaaaaaaaataaaataccaggcatggtagcatgtgcctgtagtcccagctactctagtcccagctacttgggaggctgaggtgagaggatcacttgagcccaggagatcgaggctgcagtgagccattatcacgccactgcactccagcctgggcaactaagcaagaccctgtctcaaaaaaatttttaaaaatttaaaaaataagaaaatccaagctaggttgaaatctgaatgttgagcagtcagtgagacacaaactagctaagaaagtcaaccctgcccacttgccatttgaagttattactagcaaaattacaaattattgcctactattcatttactaagcaaatattctcttagtccctattacgaacaacttattgttctaagtgcagaagttcagatatcattgagactgagaatattcagtctacaagtgccaggggtctactgtatcctcttttccgtcttaatacagtgctttgcacccatatatatgccacccacaggaataactttttttatagcaccagtccttcaacttctgggattaaacagattttttttcagggtataattgttctgatctaaattctttatagttgtacatagcaatctcacagggttcctaaaatataaattagagaatagcatgctgcctgcactgcactcctaaagcatgaccagtgcttgataaactctcctccatgcgaattttttaaactttttatgttgacatgatttcagacttacaaaaaaactatgagttgtacagagaattctaagtacccctcacccaaattccctaagtgttaatatgtttctctgtgtgtatatattttacaaaataacaaataaaatacatatacacattttacctgtagatacacatgtatctaaaaatttgagaacaagttgcagacataaaccattttacctctaaatattttagtgtatatttttaaaaatcaaggacgttctcgtatttaaccatggtataattaccaaatcaggaaattaacacactggtacattactattatctgatctataggccttatttaggtttgaccaattgtcccaataattcctttatggcaaaagaaaattctggattatcctagttagtatttttgaaaatcctatatcaatatgaaaataacttatttctaaaattagaaatggaggctgggcgtggtggctcacgcctataatcccagcactttgggaggccgaggcaggcagatcacaaggtcaggagattgagaccatcctcgctaacacagtgaaaccccatctctactaaaaatacaaaaaattagccaggtgtggtggcacgcgcctgtgatcccagctactcaggagactgaggctggagaatcgcttgaacccaggaggcggaggttgcagtgagtcgagatcgcaccactgcaccccagcctgggcgacagcgagactccgtctcaaaaaaataaataaataaaaattaaaacaattaaaaaaataaaattacaaatggaaaggacaaaccagaccttacaactgtttcgtatattacagaaaacgtttaaaccctccctatttcccccaccccactcctttatattcccatagctctttgtttataccactcttaggtcacttagcatgttctgttaaatcttgtattatatttattttgttactttctatttccactggtattaccactttagtactctgaatctcccgcagtgtccaatactgtacttttttacatagtcattgcttaatgaatatgtattgaattaaatatatgccagtggactactaaaacccaaagtatataagaagggtatggttgattatgtttttctacatattatttgacatacttctatcttcccatgttcttactatagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaaggtacaaaacttggtaatagaactacagctgggcctctgtatcagtgggttctgtatccctggactcaaccaaccttggattgaatgtatctgggaaaaaatgagtagttgcctctgtactctatgtgaacagactttttcttgtcattatttcctaaacaatacagtataacaactatttacattgtattaggtatgataagtaatctagagataatttaaagtatatggtgggcggatcacttgaagccaggagttcgagaccagcctgagccaacatggtgaaaccccatctctactaaaaatacaaaaaattagccaggtgtggtggtgggcacctgtagtcccagctacttgggaggctgagggaggaaaatcgcttgaactttggaggcagaggttgcagtgagccactccagcctgtggtgcagtctgtcactccagcctgggtgacacagtgagactccatctcaaaaaaaaaaaaaaaaaaaaactatatgggaggatgtgcattttgttatatgcaaatgctgcaccattttgtctagggacttgggcatccatggactttggtatcctctgggggtcctggaaccaatcccccatggaaaccaaggatgactgtgcttagagtattgctttctttcttgatttgtatttctgtcttccagttaagattttgtatctatattatttctctttttacttagtctgtctttagcatttaattgggtgtaatcagttgcctattttgtgttttaattttgggactatagcagaaaacatgatgttgaataaaattccaaaaataagtcaaatctacctaatatgaatactcatcactgagtgcctttggcaggaaataaatctatctcaatgctttaattgggagtaaataatgtatgaggaaatttaaactcataattgtgtgctgtacttacttgccagtaaatgtgaaatggggtactaagtaataggtgttgggtgaaggtaatatgatgcttatctttttgccattatattttcttacagcagctgctggagtgtaataagtgccgaaacagctatcaccctgagtgcctgggaccaaactaccccaccaaacccacaaagaagaagaaagtctgggtgagttatacacatgatgctcttttatagagaaccaccatgtgactattggacttatgtaacttgtattacaaatatctatgcttgaggatgtcagtatgacaatctttttgcctcattactaggaaatcatctcagcagagaaattaaatctataaatggatgcatttaagatctttttagttaagtaaagatattaaaaacaagaaattcctattgaatttcttttcttcttttctagatctgtaccaagtgtgttcgctgtaagagctgtggatccacaactccaggcaaagggtgggatgcacagtggtctcatgatttctcactgtgtcatgattgcgccaagctctttgctaaaggtacccaaaaaagccagttttgccagctttcggaggttgtacttggtgttctggaggtgaactagactctagtgaaatgaaataaaaagtctcacacattatgtcaaggataccatttagacacatttcctaagttcctgtttagaacttagcaactagaaatgtcttgttagtttatacgggaagtgttaaggggacttttcattataactaaccacaaagaaatcctctaagctagtatttcccaaagtgtgatatatatattatatatttgattatttcagacattattttagttgctacccaaacattttctttcagtagttatattagaaaaaaatattaatataactaatacattaaacctgttatattactgacttaggataatcatataaagttcactgttttaagtaagataagcagatcagtttgaagaagttcattaagtaaaaaataatataggagatctctgtatataaagaaaatttatgaaggttatacagagtactgaatcttaggaagtgctcctctaagctctaatgtaaatgccctagaaataaggaaaaagcttacatgtactgtttctgacttccatattgccacttcttttaaatatttaaatatttcttacaaatgtgtgagaaacttctctcttccattcttttctattgttttatctttaaaatctacctcatgacctttataaatgaaaactagtaaactaaagaaaactagtagcatatgaagcttttctgtgagtattcgaggggctcagaataatcttgagactgcagatgtgtgaacattccacagtagatccatgctggtgttcatgatcccagaagaatatagatttagattgggttggtaaatgcaagtcgagggccgtaaaaacacgggtatgtgagccaaagcactgctgtaaactttgctttgctttcaggaaacttctgccctctctgtgacaaatgttatgatgatgatgactatgagagtaagatgatgcaatgtggaaagtgtgatcgctgggtccattccaaatgtgagaatctttcaggtacagaaggttggagtctttttatttcagttttcttctttctaggtactactacatttattagcctctagagcactttaaacctaaaattatggttgtgttgttatttgaaatctctaaatttattttttagtctctagaataagcagcattgtattatttgtgctcacttatcttgaatatatgcctttaaagtatttatttgctgtcctttgtgtgttccataacctgattctcaataaccaaattcaggattagtgttaattaataatgccactttttgagatcaatatgtgtcatatccatgaggacattaaaatcttaatgtggttcccaacatatggctttatagtaagttcagtggaatagtttcctcttcttcctctctctcattcttcagaggacctcatcatggtaggtttttgttttcttagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggtaggccaagtctcatttttttctgagagcttgttcttaggtagtctttacctagtgtttttcttttgttttacttcattctcctcacttaatttttagttacttgttttggctataaccattaggaaaatatttagagccaagaataggaccttctttagcgtaagaaataggaaggagctgtatcttcaaaggtcttgctgttacaatgagaaatttggactttatactctgaaggtgatagggagccagtgaagcacttcacccaagacagtaacctgatcagagttgcttcttagaaaaaatattgttctgactgagtggagaggaaggactggagacacctgagcctagaggcaggattcgtagttaggggacagttatagtaatcaactggaaaaacactttctgtttatgtaagttgtgaactttacacatttataaagtagtcattagaagaaccacacggggccgggcgcggtggctcacgcctgtaatcccagcacttcgggaggccgaggcgggcggatcacgaggtcaggagatcaagaccatcctggctaacacggtgaaaccccgtctctactaaaaatacaaaaaattagccaggcatggtagcggtcacctgtagtcccagctactcggcaggctgaggcaggagaatggcgtgaacctgggcggcggagcttgcagtaagccgagatcgcgccactgcactcaagcctgggtgacagagcgagagtccatctcaaaacaaaaaaaagaagaagaaccgcatggatcactttacctcagagctaagctgctgttttatcttttaatagagctccattttttgaataggaaaattagctgctttctatgttaaaaggaactgaacacaatttcagcttcttcatactaggtttggaattatcaagaaaagctcctaagttaccctagctaagctattacataacagtctcatttttaactttccttttctatttgagaaatctgattattttcatgttccttgggttttacaatattaatcattcagtaccatctttattaattttaatagaatttacatggacaccttggttttagtgttagataaaagcaacatatctttcctggcaataggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtggtatgtttctacagtgagccatcagaatttctagtgccaataaagcttctttggacctttggggcatgaaactgagtataagtaaatttaaaaatgaattgtattatatttagaaatgtcacgtggctttagatacctaaaaatgtatgagttattttagctttgtgtttcagaagaagggttgtgatagggaagataatgtcttaaaatagttcttttatttggctttcatctcagttttctgaaaattatttttatattaagaggaagcactaagaaactgttgatgtgggaaatgctaatatgaaattaattggttctccctccccttttgagatcagatctgaataatgtgcctttctttataaggtcttcatttgtagatagatgcctgttaattttatgattttaagtatgtataggaaatgattatttattatctcatgatctatatttgcgattctgttgtttatttttatttatttatttatttatttgagatggagtctcgctctgttacccaggctggcatgcagtgacatgatctcggctcactgcaacctctgcctcccgtaatcaagtgattctcctgcctcagcctcccaagtagctgggattacataagcatgtgccaccatgcctggctaattttgtatttttggcggagattgggtttcaccatgttggctaggctggtcatgaactcctgaccttaagtgatccacccacatcagcctcccaaagtgctgggattacaggcgtgagccactgtttatttattttaatccaaaataaaaactgtggacctgcttggataatttatcatgatacagccaatttgtttgcattcttacctcattagcctggcatctcttaattgccacaggttaatcgtgaattgaatctcaaaggtctcagccaaagagtattataccacattaaaatagggtgtgagttttctgttggatctctgtgctggatgattaaggagggaagaggaaatggttttcagagcacactgttttaagaataattaacattttgtttttgtatacagttggagttcagtgatgatattgtgaagatcattcaagcagccattaattcagatggaggacagccagaaattaaaaaagccaacagcatggtcaagtccttcttcattcgggtgaatgatattactaattcatgtttttaatgcttacctataagtaattaccctgtgaatacaatgaacttgttctcttctactttttgctttgtggtgtgtataaaacatctttggtttaatttgatcccctgattctttgagaggaacttggtgaggttgccagagtggatggatctttctcttggtggcctgaaattatcctcgtattaacagagaagctggtttgaagatttttcatgtggtatctaaatgagtgtttacatatttacattttgtttgtgttttcttttagcaaatggaacgtgtttttccatggttcagtgtcaaaaagtccaggttttgggagccaaataaagtatcaagcaagtaagtgaatttagcataacttttttttctcctcatcggctagaaatctgagagttctcatatttctagattgcagttttccaaaaggttttaatactagaaatgaattggttgaaatgccttttcggtgtggttttgaggactacatttaatgtttgttataagcaattgcctttttgttctttacttttatatttgttttattgtagggagcttggtttaattgtgacaaatgtacaatacatgtgtggtacagccatgtagctggccttgttataaatgggttctgtttgactgatagttcaaatggtgctttgtactgctcttgattttccatatgtaacctttaatttttattccagtaaattcttttgatttgattttatttatttatttatttttttttttttgagacggagtctcgttctgtcaccaggctggagtgcagtgacatgatctcggctcactacaacctccgcctccctggttcaagcgattctcctccctcagcctcccaagtagctgggaaaacaggcgggcaccaccatgcccagctaatttttgtattttaatagagactgggtttcaccattttggccaggatggtcttgatctcttgacctggtgatccgcctgcctcaccctcccaaaagtgctgggattacaggcatgagccaccatgcccggcctcttttgagtttttgatagggttatcatttgtttcagcaagtttaaccaagagtcatatgttgagatattttttaaaatattgagttctgtgtacttcagcaattttcaaacgctgtgacttgttcttatattctgtgaatggctcctacatggggcaacaggtgatatcaagaatttattttatacagttctaggtatactgtaggagttcaataaatgcttgttgaatcaattattttcagcagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtaagccaccaaaaggagagtcgtcacccatttccctctagatgcagatgattgacttcgtgaatccaattcactaaaattagatatacttggatatcagaaaggaattttcaggtcatccttaaatgtaataccatcattaattttgcttcacttgaggtgttaatgaggacttgatataaatactctggagtattgtaacatagatgatgaggtagcgtaactctgaacactttttgaaaagtggttattttataggctgtgggctatgtaagctgaattatttcttttttccttgaaatcagacatagtattgccaattttaactggatctcaaggtattgatgggagtcttttggatttcaaggtactgataggagtcgagaagacagtccagagctgaacccacccccaggcatagaagacaatagacagtgtgcgttatgtttgacttatggtgatgacagtgctaatgtaagtactttgcaacacagggccctagttaatacatactccaaaagaactgtttgtccttgtgtccatacttgatgactgggtgccatttatttaatgaacttacttataacttactaatttataacttttatttacctataacttataacttattaatttgtaacttattttttgtcacttagttcatggcacttggagttttttaatgactgattttgttgattaaaaggtgactgatttgccttaaattaaacccttgatgtctagtaatttctaatggaagttcctcaagaatattttgtgaaagttaataaaatctaagttgcatattaaaaagcttgtgtttcatataggatagcagaatcgttaagagcccgagttctgccgcctgcctgaatacatttctgtgcttaactgcctacttattgactttggcaagtagtttaacctctctgaccctcagtttcatctttaaaatgaagataataacgcttacctcagagtggctgtgaggattaaatgaaataatgtatgtaaagcctctatttggtgcctggcacacacagtaagctacaatttttttaaaagttttttgtgttttttgttttgttttgttttgtttttttgagcggagtttcgctcttgttgcccaggctggagtttcgctcttgttgcccaggctggagtgcaatggcgtgatctcggctcactacaacctccgcctcctatgttcaagcaattctcctgcctcagcctcccgagtagctgggattacaggcatgtgccaccatgcccggctaattttgtatttttagtagagacggagtttctccatgttggtcaggctggtctcaaactcccgaccccaggtgatccacccacctcatatcccaaagtggtgggattacaggcgtgagccaccgtgcccggccaaaagcttttaaataccatctgagagaactggctttgaaatacagtttatagatgtcactgcacatttttataaacttaccacctattgctctttttgtttgtttccttttgagaccaggtcttgctctgtcacccagactagagtacagtggcatgcttttggctcactgcaatctcggcttccggggctcaagtgatcctcctacctcagcctcctgagtagctgagaccacagatgcgcaccaccatgcctggctaatttttgttttgtttttgttgagacaaagtctccctatgttgcccaggctggtctcaaactcttgggctcaagcgatcctaccacttcagcctccaaaagtgctgggattacagacgtgaaccaccatacccagctcatttttttattctctagatttgtaaaatagtttcagtctatggaaaaagtaatcttgaaaagaaggaagtggaaacagagcaacgttgcaaaaagaattctgatttctgtgtgcctccctccattaaagaattatagttgctttcttgaggttatcttcactggaaaagctaatgccgaggaaaacctcctttggcattatattctttaggaaaaaagaaatctctttattttataggatgctggtcgtttactatatattggccaaaatgagtggacacatgtaaattgtgctttgtggtcagcggaagtgtttgaagatgatgacggatcactaaagaatgtgcatatggctgtgatcaggggcaagcagctggtaagaccttatgggtaaattttatgaaagagattccctctcagtttccagatattcttcctgtgggtgaatatggcctccctgatatttttcacagtgccatcagggtagttagccaacaagtattgatatacataattcaacagataaaatgataaattttatctgttttcaatttatcaatagataaaatgaattgtaggaactgtagaatgggatgagtctatagaggagacggtaaacgtcttaaaacatatgaaagtctgaataggactctgttctttttggatttttagagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtgagagagctttagttgctttaaaaaaaaaaaaaaagacttttttagagcagttttaggttcacagcaaaattgactggaaggtacagagatttcccatatgccccctgcacccacatatgcacagcctcccccatgatcagcatcccccaccagagtggtgcatttgttacagtggataaacctacactggacacatggttatcaccctgactcctgtagtttacatcagcattcactcttggtgttgtacattctgtgggtttggacaaatgtataatgatgtatatccaccattataccatcatatggagtattttcgctgccttaaacatcctctgtgctctgcctattcatccctgcctctccccaaccctgggcaaccactgatgtttttactatctccatagtcttgccatttgcagagtttcacatagttggaatcatatagtacatagccttttcagactggcttcttctgcatagcatttaagtttccttcaagtcttttcatggcttatttagttgctttttgaattatttcgaaatgcaaaagaaaaacaaaaatacagcaagatgataaactgttttgcttttctacttggtgttcctagaggcaccacctcttttgggaaatacagaagtgtcctgctaagtgaaacagaaggatgcttttgagatatgctatgtgccttccactctgagacagtcaggatcataagtataatgtgcaaagggacagcctattaacagctaccatgggttttatttaaggtggttcctgagaatggatttgaagttttcagaagagtgtttgtggactttgaaggaatcagcttgagaaggaagtttctcaatggcttggaaccagaaaatatccacatgatgattggtatgacctagccttggttattggggaaggctgtatatatcattggggaaatttctggtcctcagttataaaatgaccctcagccaggtgtggtgtctcacgcctgtaatcccagcactttgggaggctgaggcgggcagatcactggaggttcaggagttggagaacagcctggccaatgtggtgaaaccctgtctctactaaaaaaaattagctgggagtggtggtacatccctataatcccagctacttgggaggctgaggcacaggaatcacttgaaccccggaggcagaggctgcagtgagctgagattgcgccactgcattccagcctgggcgacagagtgagactctctcaaaaaaataaaatgacgctcataatcttctctaatcggttcttctttccttggtcagggtctatgacaatcgactgcttaggaattctaaatgatctctccgactgtgaagataagctctttcctattggatatcagtaagtagcactataaagagaagagagcagccccacaacctgaacacactgaagccatgtgcaggtcattaaatgtagaggcatacctgttagctactttaaactgctactaaaaattaatcacttattttgctagttctcggattcgtctgcttgtagattgggactatgttagcggaatccagttatagaaggaaagtattattgacataatttcagaattacttaaaaataaaaccttagtagaaaacacaaggtcagtctcttaagattcctccaaattccattcatctccatgcagaagtgcagattgtttttatggataaaacagctcatgccctgttcccaactttacagtttataagtccttctaaaactataaatccacacaataatgatcaaatttttcaataagaatttataatcttacctatatgaagtaagttgttaaaatgtctaacaagctaacaatataagttcaaaattccccttctaccactcccgcgttggagtctcattttgcaatatatgctccaacttactctgtattcctattcctatgacacagtctgtgctccacatttagctggcagcttttcacacaaaccagattccactagcattcagcagatttgaagcagttacatttctcttgtctcatggggctcttctcccaaaggaaacacctcaggtttgccctttgttttattttcaggccgtactttgtatacattgtaaggcaatagttcggtcctgaaggccaaaactaatttttgtaatggttaatatttttctttctcttgcttttaggatgttttactatatttggtgcctgcttatggtacaagaaaaaaagatcttaggctattttctgagaggctaagaaaaaccaaggacttcaaaaagcttggaacaacctaactaggggaatctatactaagaacccataaaataaagctaaactctgtaattaagagggccagggaacctaggataaagagaggttttgaaaaatgctagtttctgcttctatcctctcccttatgatgattttcccaaatctgtttacccaggtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacaggttagtcttgaatcaagatgggacttgaggctgggcacagtggctcacgcctgtaatcgcagcactttgggaggctgaggcaggtgaatcacttgaggccaggagttcaagaacagcctggccaacatggtgaaaccccatctctactaaaaatacaaaaaaattagccaggcatggtggcaggcacctgtaatcccagtaatcccagccactcaggaggcagaggcacaagaatcacttgaaccagggaggcagatgttgcagtcagccaagatcacgccactgccctccagcctgggtgacagagtgagactgtgtctcaaagaaaaaaaaaaaaagatgtgatggaacttgaattcgattcagggagtactatgattgaaagctgggggaaaagtcatttacttgggaagtctcatttgcttctagttttacatttacctgatagctgactttttattggttaatttgtttgatattttaattgggcctttttagttaagagtttttatttcctgccacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggtaaaagactttattgacctacttgacctaagaagatcagcccaaagactaatttgtaattctttcaggcaactttatcttggtgacttttactgattgaaaatgtagattccgggtgggtgaggtggctcatgcctgtaatcctagcactttgggaggccagggcaggtggatcacctgaggtcaggagttcaagaccagcctggccaacatggtgaaaccctatctctactaaaaattcaaaaattagccaggtgtggcggtgcatgcctgtaatcccagctacccaggaggctaaggcaggagaatcgctggaacccaggaggtggaggttgcagtaagccgagatcgcaccactgcactccagcttgggtgacagagtgagacactgtctcaaaaaagtaataataaataaatagaaaatgtagatttccagttacctataaatatatatatatatagtcaaatcattgaaaccagtgacttctacacatttgttctatctacaatagcatttattactttttctctcttgtttaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggtgagagatccaaatactagctaggctgggtctgtgggatttcatgttgtaaattaggggctgttgatgtggtagtccgggagagacactcttctgttcaagttgcattacctgggagttttccgggttttgactttttttctctctgagtggtgatttatgtaacaaaatgtagttccatccatgggcagtttgtctcttgaatagaaccacatctaatcactttttgctctgatttcaaacagtgttgctgtttgttcctgtttcttttttactgaggcttatactagaatgattattcttatcttgagggcaaagctccctcttgtagatccacagagtcctttttttaaaactttatcattgaaagccaagcacagtggctcatgtctgtaatcccagcactttggaaggctgaggcagaaggattgctggagctcaggagttcaagatcagtctgtgcaacatagtaagaccctgtctctacaaaaaattttttaaaacagctgggtgtggtgttgcacacctgtagccccagctattcaggaggctgaggtgggaggattgcttgagcccaagagttagaggctaaatgatccatggtcatgtcactgcactccagcctaggtggagtgcacctatgtagccaccactcggatcaagatacagaacatttctagcaacccacaagggtgtcttctcttataaggtcagtgccccctcaaagtaaccattattctaacctttatgaccttaggtcagttttgctggcttatagactttatcagatcctgatagagccatttctttcgactcacctccacattcagtacatatttactggtggtttgtcttgaaaagatacaaatgcctgtgttccaggactccaggagcagaggctgagcagcaggatacagctagcgtggagcagtcctcccagaaggagtgtgggcaacctgcagggtaagctgaagaattcgtcttttaagactaagctctcagttttgtccacctcatttaaaaaatagttcttccaggccgggcgcagtggctcacgcctgtaatcctagtagtctgggaggccgaggcaggtggatcacgaggttagatcgagaccatcctggctaacatggtgaaaccccgtctctactaaaaatacaaaaagaattagccgggcgtgatggcgggcgcctgtagtcccagccactcaggaggctgaggcaggagaagggcgtgaacccaggaggcggagcttgcagtgagctgagatcgcgccactgcactccagcctgggcgatagagcaagactccgtttccaaaaaaaaggtaaaaaatagttcttcctgattcacattgatttttgttttcttgccaaagttttttaaatgagaatagtacaggcttgtaaacaagtaaacaaaaaatataacaagaattatttaaataatggataatagtttcctatttgtccccctcacccccgcccaatctactccctagaggtggtcattgctaataatttgtttttatctatgcagacatctctctgcatataaagatataacgtggtatatatatgaatatgtatacacttttttacataaaaggaataatactgtacatactgttctgtatttggtttttcacttatgtacatctttctgtgccaatatatgtaggtgtgcttcactttttaaatcgctgccgccaattctattgtgtggatctacaatattttaatgagtcctctattgatatacatttggattgtttccagaatttatttagtttaaaaaagtgaaaactggggctggacacagtggctcatgcctgtaatcccaacactttgggaggctgaggcaggaggattgcttgagcccaggagtttgaaaccaaccttggcaacatagggagaccctctctctacaaaaattaaaagttaaccaggcatggtggtgcacatccacagtccaagctaaggcgggaggattgcttgagcctgggagttggaggatgcagcaagccgtgattgccactgcactccagcctggacagcaaagtgagaacctatctcaaaaaaaaaaaaaaaaaggtgaaaattgattgtggtttataagctcatgcagcttattttttagttttagttaagccagcttacttatttaagtaactttagaattgcttctgacaagtgtcctttcatttttttctaatactgagtatgagaagaatttcaagggcgcaatttacaactttaaaaacagaaacttaatgtcagtatttggtaaagaatctcacaaaagagttttatgttatgtaccatacagtggtgtggtggttgtattcattcaacaagttctacagaaagccccctgtggctcattttctagcagttattttgtataccacagctgtatagaaaattctgggttttttctttgaattgaagaactagctgatattatatcttacatttggtttttatttaggcaagtcgctgttcttccggaagttcaggtgacccaaaatccagcaaatgaacaagaaagtgcaggtatgtgggtgggtaaaaggttagaatcagagaatatcaatgctaaaaggattatgagaatcacccactttacctacttattttctacatttaaaaaaaaaaatctaagctccaaagaagttaagtgatttggcccacattggactgaaacttggcgcacctgtctctcggtgcagtgttcttccagtacatattgtgtgatcacctgtcagctaaggactcaagaccatacccatactcttctgctgtactggttttaccagcactgaggcttaaatagctagtaataacctgacttcactttttagttgttactaaagaaaactaagaaccatttttattagatagtcagattttggttacaataccagatacatctccatggcattttccatcagttctaatgaatttgattaggaaacaaatggtcacttcaagattagagagttctgggtataactctattgaggacagttgcttattgaaaaactatcagatcgtcatactagaaattctaccacagagagcataacttcatgtaaaaaaaaatctggttttagtcaccactttctagcaatgacctaggcaagctctttgagtcttgggtttgttatctataaatgggaataataaaccaactgtggaatgttgttaggcttagagatcatttatgtaaagtactctacatgtagtcagtgctcagtgagcatttgttactgcaaccactatctattttctccctattagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaaggtgagtggattaaatcaggttgacccatcagcagaagccctgtttcagctagagcttcattttctgagtattagcaccatttaggtggctgttttatgctagatggtagggggatacctggaggcatcatacattttccttgtccttgagaagtttgtcttattggagaaatagccatattttacatgaaaagttaatgatacagattatgttttcaacattgcacacaccttagcggagcccctgagaactctgcttccccctccagccttgttttttgccattccctcatgcgccttctgtgcccttctctctcccttgtgtgccttcacacgtgctttctcctctgcctggagttctctccctgccctcaatcacctggtgagctccagctcacccttcaagatccagctcagacggtcttccctgaccttctgaggtagctaagccctccctctccctccttttgaatcttacatgttcttctctcatagcttacattttgttttgtccgtgtttgtttacttttatcactcactcaacagcgagctctccataagggctggaattttattttcttattcatctttgtatcgcaagcatctaagtgttcatccacctttgaaggactagtaaatgttctctaggctgtaagtactagaagagttcaaagaagagaaaggtcaccatgggtgagttagggttatcaaaaacccatgaagataaatagaagattctattaaaggagaaaatggaatttgggttaggcaaagaagaatgcagggctctctaggaagaagaagggaggtaagcaaagttagaaaggcaggactgcatttggtgggtttagagtagtgtcaggtgagatggcattgaaatccatgtgaggtaatagtgaaagagaaaattgggaaggtggatagggcacaggttttagagggctttcagtgccaaaccttgaggactttgaaaacttgagggagtgaatagaagcagaatttcaggaaacataatgtgataagctctctatatgagacagattgagcatgaactggagatgctcaaagacgagagtttactaatgagagtattgctagagtagagatgtctggtaataaagcccacattcggtgggaaaagaaaggaaaggaaagaagaatgagtacacttggtggaatatggagaggggagagtcaaagatgaccctaaagattcaggcctgggtgactaaaacaaaagataatgcatggagaacaaaggagataagtaaggagtatgggggttccacagaagacattgatgtggagtgatgtaagaaatccatgtggaaatgcctagcagacaggaaaagatcacagaatcttgggttagagctggaaggaactgtaaggattttctagttctgcctcttaactttaaggaacagagaggttatgatcttcccacagtcctgcttaaatcattattactagtgctgttttgattaggggtacagggaacataaaaataccaaacattcaggtgtgagacccagacttccatcaagggatgtgaatgcgttggggattcagagttcatttcagaaggtctgactttccttagtgcttctgtgtcctccaacagaaagaagccctgctggggagtgtaccttttcggctcctttcacatgtaatgaactgacttaaactctaagaaaaataacaaaacactgctctaggagggcaagtgttcacactgtagggattctaagcagtgcttgtgcacatcattggtattaagaagggtttacgtgcatattttctggcttacgggttttctttatttcctttcagatgcctggaagtcattgacagataaagtccaggaagctcgatcaaatgcccgcctaaagcagctctcatttgcaggtaatggctggaggtgttattccactcctgtctcagaatattatggtaaattgttcgcctaaggcagagttgattctgtgaaaaaaaaatcagttaaaaatttttttcacagctttattgagatttaattcatataccatacagttcacccatctaaagcatacaattcagtggtttttaatatattcagagttgtataaccaccactactctataattctagaacattctcatcatccctaaaagaaaccccctattcattagcagtcattcctcagcccctggccaccacaaatctactttctgtctctatgtatttgattattctggacatttcatataaatgaaatcagacaatatgtagccttttgtgaccgtcttctttcactcaacagaatactttccaggttcttcccttctgttacatcttcccttccacatcagtacttcattcctttttattgccaaatattccattgtgtagatataccatatgttgcttatccattcattagtcagtggacatttgggttttttctattttctgctacgaataatgttgccacaaatattcatgttcaagttattgtgtagacatgtttttattttttttcagtatatacctcagagtggaatggctgggtcatatggtaactctttaactttttgaagtactgccaggttttttttccaaagtggctataccattttacatttccacctgcaatgcacgagtgttcccatttctccacctttgccaacacttacctgttttttgtttttttttttttattttagacattgtagtgtgaaatgttatcttttcttaaagttgaaatcatttaccattggtattagacttcatattaaatttaggcagcatacaaacttattaatacacttgttttgagcaaacactaaagattttaatcagtggatgctgtggctcacacctgtaatcccaacactttgggtgaccaaggcagaaggatcatttgaggccaggagttcaagaccagcctgggcttcatacagagaatacatctttacaaaaaataaaaatatatattagccggcaccgtggcatgcacacctgtactcccagctactctggaggctgaggcaggaggatcactggagcctaggagtatgagactgtattaagctatgatcttagcactgcactccagcctgaacgacagataaatactttgtcacaaaaaaaagaagaagaagaagaagaaggttttaattaagctaaggtagaaaccttccattgactttgttttatccatatctacctctcctacctcctttcagattgctcctggaaaggtgggtgaatgggtacttacaggaattttaacttttttttttttaggaatttaattttatcagtgatgttcttcctttaagagggaagggaaggaaaatatttggatgcactttagaaaatactaacatttgttcattttatgtgacaggtacatgcatggctattataacaccctgtgtatttttttatacttaaaatttttcagaacttttttaattaaaaaaaagagaaaaagacccaacaggcagtttatctcccacaaaatacaaatggcccatagcatgaaagggtactcaatctcagctggacacagtggctcacacctgaattccaacatcttgggaggattgtttgagtctaggagttcaagaccatcctgggcaatagagtgagacctcatctctatataaaaaaaaattgtttaaattaggcaggcatgatggctcatgcctgtggtcccagctacttgggaagctgatgtgggaggagcgcattgagcctgggaggtcaagcctacagtgagccaagattatggcactgcactccagcctgggtgacagaacaagaccctgtctcaaaaaaaaaaaaaaaaaaaaagaaaaagaaaaaaaagtcttgctcataatttttaaaattctaccccaaaaatataagtcacatccctttctttttctctgacatatcccttgttattctctcatgcaatgttaaaaagccctataactgagtctcctatctcacctccttgtaccctcagagtctccagaggtgcctcaaaatcttactattgcctactagttacagagtataatcttcaacccttacgtatttgttattagtaaatatttactgaccacttgtaaaatgcctggtaccatgttaaacacaggatacagtcgctgagtagcgacccagccctgctctttgaggtttcctgtctacggatccttacatggcgaggtcctcttcagccggattcatctgttcagtctcagctttccccacttccctcactgctcaagattctttgttctgcagccacactacactatttactgttccagatccatccatgtgtcttttttttttttttctccaagacagagtcttactctgtcacccaggctggagtgcagtggcgtgatctcggctcactgcaacctccatctcccaggttcaggtgattctcctgcttcagcctcctgagtagctgggactacaggcgcatgctaccacacccggctattttttgtattattattatttttttatttttatttttattttttgagacagagtttctttcctgttgcccaggctggagtgcaatggcgcaatctcggttcaccgcaacctccacctcccgaattcaagcgattctcctgcctcagcctcccgagtagctgggattacaggcatgtgccaccatgcctggctaattttgtatttttagtagagtcagggtttctccatcttggtaaggctggtcttgaactcctgacctcaggtaatctgcccgcctcagcctcccaaagtgctgggattacaggcgtgagccaccacgcccggcctaatttttgtatttttagtagagacggggtttcaccgtgctggtcaggctactctagaactcctgagcttgtgatctgcccacctcggcctcccaaagtgctgggatcacaggcgtgagccactgtgcccggcccatccatgtgtcttaaagtgtagcctataggtgtgaatcagaatccctgggcttggagctgagaaagctgaatttttaacatgtgcccccaagcaattcttattacttaccctaaatgtgctttcatatcagcataacatggttgatgcagttccctccaccaggacctatttcctccatctactctcttccctccaaattccctggtttacacaacaaactcctgttaatcctttaagactttgctcaaggtcacctcttttctttaaccttttttgatcattcttcctgtgcctacggaaatcccaactcttaactgatttaaagagtgagataatttatcatcttatataacagaaagtccagaggtagggacagacgtgtcaggattgattggtacaggagcttgcaatgtcatcaaatacctagattcttttcttctttccactttacgatctatagtaaaacttcatcttcaagctgatagcaaatggctgcagcagttcccacaataacattcagtcatcacagtgttcagaggaacaggagaggcttaggaacaaatggacatctcacagaccagaatttggtaccatgtccatttctttttctgtccttttttttttttttttttttttgagacagggtctcacactgttgcccaggctggagtgtgtagtggtgcaatcttggctcactgcaacctccgcctcccgggttcaagcaatactcctgcctcagcctcccgagtagctgggactacaggtacacgccaccacacccagctaatttttgtattttagtagagacgggatttcaccatgttggccaggatggtctcgaacttctgacctcaggtaatctacccaccttggcctcccaaagcgctgagagtacaggtacccagccccatgtccatttctaagccagtctctggcaaagggactgggattcccaggattgtcttagattaatcatctggggtggaaggtttagcctggaggttaaccacaatgacccttgtgttccccagtccaaaacctgtccattatactccatttccagtgctgccaccttgtccttaccctcatgcccttatattctagtggtgtatatgtatatgtaagtaccatgaagaagataacatggggaaatgaaatagagagtgacacagaggtgggtagttggtgacaggaaatctggaatctcttgatgaggcaacatttgagcttagacctgagtgatgatgagaagaagccaatcatgcatatacataaagcgaaagtcctcgaggcaagctagaaggctgaggaaggagagtttgagcttatagtgtgccaagatcatacctgtgaatagccacggcaccagctgagcaacacagtgaaactctcttaaaaaaaattaaattaaattaactatgttttctaaagtcctgacacagaggaaacagcagatgaaaaagtcctgaagtgggaatatctttgatgtgtttattgtctgtctcttccatgaagtaaaagctctatgaatacaggtaccttgcctgtcttgctcacctgtaagttcctaaggtcctgtctggcacagtggaaagatggaaagagtgcctgggatattttaggtgtgctgtaaatatttattgaatgaataaatgagtctcccacaagcagaacagattgttccttcttaagagttcccatagtactttatattataccttaatttggacacctgcacattgcatggtttgtatacgtctctgccttcctctgctgtgagctccttaagaacagacgggggcccacacataatgcatctttgttttcccattatcaacacaatattaatctcattgtaatctctctggtgagtgagagttgaacattcagtgtacatattaaaaggaactttctgtgaaaatatacttgagtatgtagtatgtttttcaatgtcttttttttttaacctaagaattcacagcaatctagaacttccaggaaaaaattattaaggaaaattagtggtctgtagaaaagagtttgccagctgggcgcggtggctcacgcctgtaatcccatcactttgggaggctgaggtgggcagatcacgaggtcaggagatcgacaccatcctggctaacacagtgaaaccccgtctctactaaaaaatacaaaaaattagccaggcgtggtggcgggcgcctgtagtcccagctactcgggaggctgaggcagcagaatggtgtgaacccaggaggcagagcttgcagtgagccaagatcgcaccactgtactccagcctgggcgacagggtgagactctgtctcaaaaaaaaaaaaaaaaagaaaagaaaagaaaaaagagtttgccattgccttatatggcttaagttcttatcttatacagttgtgttacatagtgttacatacctaagccaaattcttaagggaccaacagttgtgatcataagaatgtcacttatcaggggccagtgcagtggctcacacctgtaatcctacctagcaagttgggaggccaaggaaggaggatcactcgaggccaggagttcaagatcagcctgggcaacacagtaagaccctgtctccacaagaaatttaaaaattagccaaacacagtggcatatatgcctgtagtcccagctacctgggaggctgaggcgggagcagcttgagcccagaaattcaaggttacagtgagctatgatcatgctactgcactccagcctgggcaacaaagtgaaacctgtctcttagaaaaagaatattgcttatctagagacaacattctttttgtttgtttgtttgtttgtttttgagatgaggtctcactctgttgcccaagctggagtgcagtggcatgatcgtctgctttttcatctgctatttcctctgcaccaggacattacaccaaggttacatctctaaatatgcttcataatgcaaactgtatgtctgttggaattgcatatgtgcaattgcagtcctaatacaattacacttatgaaatggatacctgatccaaaattaacaccattactgtttctatatctattaataataccaaaccagtattcgtaaatgaaataatattgtttacttaataaaaatgtaaagaacattagctatttgctagtgtcaaaaagaagtgtggcagttgtaattgtgccctgtccctttaatggaaaaagccaaataattttaaaatgaaagcctttcaccatcaatgccagcagacttatataaatgttgttttcataaaataaaaataaataaaaaatgctcattaacagcatgagacggtgagtagaacaaagcagctactgagtgtattactccacacattcatcataacaacacaagagttctgtgttaggggtgtattaacattgcttttaaactttagtgaggctggctgggtgctgtggctcacacctgtaatcccagcactttgggaagctgaggcaggtggatcacctgaggtcaggagtttaagaccagcctggccaatatggtgaaaccttgtctctactaaaaatacaaaaaaattagctgggcatggtgacgtgcccctgtagtcccagctacttgggaggctgaggcaggagaattgcttgaacccaggaggtggagttgtagcgagctgagatcggaccactgcactccagcctgggtgacggagttagagtctgtctcaaaaaaaaaaaaaaagccgggcgcggtggctcacacctgtaatcccagcattttggaaggccaaggcgggtggatcacgaggtcaggagatcgagaccatcctggctaacatggtgaaactccgtctctactaaaaatacgaaaaaaattagccaggcgtggtggcggcgcccgtagtcccagctactcgggaggctgaggtaggagaatggcgtgaacccgggaggtggagcttgcagtgagctgagatcatgccactgcactccagcctgggtggcagagtgagactccatctcaaaaaaaaaaaaaaaaaaaaaagaaaattaaactttagtgaggtatctgggggaacataagcttatagaacctagataatccattcctagatggattatatttgtagttatgcagtccagagttcatatcttgtcaaatcatgtagccttgggagtgttacatcagttctctaagcctgtttgctcacctgaaaatgaagctagtaattcctgccctgtgtggtcattatgagcacgaaatgaaataacacgtgtatatagcattagcatatagcatttctgtgtaataaagcaaaatagtccatagtttggtggcatgcttttttcacttagccgtctatcacaaacattttccatattgatagatctgtatcagcatcattttaatggctatctgatgctaatttcgagctaatatgtactataattcaccctggagcagcctctggcagagtgactatagcataggcatttctgtaggaccatgctgtttcctgttgactgcgctcctcacttccctggtgcttctgattcttctaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggcaagttcccttcttttctgtcagcagttttgggtctcgattttcttatctcatgacactgtcatcttcccacataccctttgagatttccagttttaatgccatcatcctttactgctttattaaagcatttctctaaatatgttttaatcttttggccccaggaagtcagcatttgacatgtttaacttcctggcttctaaacatcgtcagcctcctgaatacaaccccaatgatgaagaagaggaggaggtacagctgaagtcagctcggtaagtcttgagtggggagcagtcattagaaactgctttccctctcctccagctggtcagggcactacgtaggaatttgtttgcatcagaatttcctggataagatttaaaaggactgaaaaccatttgtgttgaagtagcagtaggtgcctggtaaggagtgaggaatataaggtacagaggagaaattcaaagaactgtaagatgcctgttttctttaatgatagtatactctgtcagctttggttgtaccaccatagttgtcatggtcagaaagtactatatatactaaaaatgggactcattggccaggcacagtggctcatgcctgtaattccagcactttggaagtccgaggcggacagatcatgaggtcaggagttcgagaccagcctgaccaacatagtgaaaccctatctctactaaaaatacaaaaattagcccggcgtggtggcgcgcgcctgtagtcccacctactcagcaggctgaggcaagagaatcgcttgaacccaggaggcggaggttacagtgagccgagatcgcaccactggactccagcctgggcgacagagcgaaactccatctcaaaaaaaaaaggggggcgctcattttataaggcactcgttcagtttggcattaaacaaagagtgtactaattgtctctaggaaccttcgattcaagactcaaaacattatttcctgaaaaaaattcgttaatagtatgtcttatctcttaggagggcaactagcatggatctgccaatgcccatgcgcttccggcacttaaaaaagacttctaaggaggcagttggtgtctacaggtatgactaaaattctagaaagaattacagaaaacgaatgcagtttttcaaaatcaaagcagaccaaatgctggagtgaccttcctcactcagtaagtgaggattttacggacactatttattgaccctcatatcctgggatcctgcacctccttgtgttgaacaaggactttaacataataagcattaaaatattactgcttccagcgggtcacagaatggaaataactttcatctttggccatgtgttagatggccaaatcaagtgggtccaaatttttattttctcaagtatatgtccctcctggggaactaacagaccaggagaacttattcatgtattcacgcacttaaccttacttgcaaaatttgtgtctgacctcttttccatctttgtcctaggtctcccatccatggccggggtcttttctgtaagagaaacattgatgcaggtgagatggtgattgagtatgccggcaacgtcatccgctccatccagactgacaagcgggaaaagtattacgacagcaaggtaagtctcccacttgcactcacacagttcttttgttttgctgtagaaagggaccagtatgacccctggatcacaaaagaaatagtgtatgttatcaattcagagacctttcttaaaaaaataaactctgaaatttgtgaggggcccagtaaaaatacagaatccactctgaggattagtacagaaagttgctcttagaaggtttgtctgagtggctcctagtatcagaagcaaatagctatacaagttttaggtttctctctcctgcagagacattagaaacctctagactagtggcctgtaatctaggaaatcctcgtggaagcatcttgaaagatagtactgggagaaatctggaaattttactagaagaaactttctcagccgctataggtaacatcaagagaagattgggacatgttcttaaagctgagtttataagaaatgacaagttcttctcccttcttctgcatgtgcagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaa

SEQ ID NO: 37612 - DNA, 17014 bp, Homo sapiens
gacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattaatttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggtgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcatgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggccaagactgaagaaagtactgttgttctaatggtttcatagaaagttaatgccaccaccataggctcatgagaggccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtaaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccatctctgccaaaacaaacagaaaaatagtaaaagagagtctgcatcataataaagtgttcttttcccacctagttctggttttcctgagatacttatttccattctttctgtctgtctcttcaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaatccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggaccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggattt

SEQ ID NO: 37613 - DNA, 360569 bp, Homo sapiens
ggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcgtgagtacccgcgccgtccgcccgccaggctatgggtttctgcgccgcaccctcgcgccctccccagcagcggcaatcccagccccgcggcgccgctccggttgcagcttgcaccttactactctcgccttcccacccttcccatcccctgggacccaccccaatcctcctggggctgagtggctgggctggaccccgattcagtgatgcagacgtggacggtggaaagttaaaagggcgacctctgaagtcgcaggcagcgtgggctgagaaggagcagaaagggagcgtttatggggagcacaggaggcagagagggtctgtccttcaccaccggggctcgcctttcacgtccttcacggggcgtagggaggagggttgcaactcctgtggtttccagaagcccagccctgagccctgtagcccacaccatgcatgttcagggttgggggttccaggagtagtgagtgttcttttgagactgctgcagcaccgcggctgtttcgtcactcgctgtgacctcaggtgctgccccgagctccgaacttgtgccttgccctcgtgtgcgacgtagcgtggcgctgctcgcctcctagactgaacttcgtagtgcttctgccgaaaacccttgtggcccggaggggccgcggggagggtcagggagagatgagggtgggagtgtcaggggccccggggagatggaggagacccctgggcatcttttctgctctgaacagcccagggttcctactaaatggctctgtgccatctgcccgcagaggatcccacagactatcttcctcctccccggtgcactgtcgcccaaatttactggcacgtggacttaggtatgaactagtctgctaggcgggctgcagggaaacgacgaggaaggaagtctgggagacccctgggcgtctttgctgtccgttgacttcgcttttacgacacccaagggctcccaataaatagtcattctatgtcatctcccttccaagggcggtccccttggctccggatcgtccaaatctggcgacggcagaatcatttaggaacgacccaggaggtagacaggggcgctgggttggcgcgacggtcctttggcgcctagtcaggctgcgacgctcgcggcgaaggtgatgtcagcggctctgacttacgtaagaagcttcctaggttgctgccgcagctgcgccggtgcgcagtggcctaggagcgcgcggggcggaggcgctttggaggcatccttccctggggatttccgggcacctctgccccacagcccagctcagcctcccagcggtccctgcccgcccgcgtgttctctccctcttcccctcctcctccgaaaaaccctttgaaccccgtcccgggaattcactgcttttctgcaataacaatagtaataagcgtaatgaataaatgatgtgctcgatcggttttcgcagctataaaagacccggagttgggttaatgactggttgtttaaaagggcaattccggggatgagttctggaaagaattaggactgccgtaggccaagtcgtattttacttttgggacttgaaatgagcgctttaatcctgcctcctttttaccccaaaccacacagcagggacaggcccttcactttcaacagcgcaggtatctggggagtgcggttgtgggagtggtgatttcacttcaaaagaactggagggaagttttgcagactgttgagtggtgcatacatttcccgtgtgtgtgtgtgtgtgtgtgtgtgtgagacacacctctccttaagttagatttcacgcgaatgaaactcactgccagagcagaatgtgcccacttctttctctctttagatgcagcagtgggcagttatgtacctggaacgtgtcagagttctttcaagtccttttaactgtttggggtacaaactaatagttagtagagataagagaggatcttgagtgtgtgcatatagttggtgaatatatactctatacatatttgtacatgaataataaagatggggctgatttctacctgggatagatttaaaatctcatattattttaaattttattttctaaaatgctatctccacactttatgtccagatctctctcttctcttgttcatttaaatttgggatggcattgtttttgtttgatgtcataaaaggcattacctttgggagaaaaaacacactattatgtgtcttggtttaggtttcctagaatgcagagcctgagacaaggatttcgatgcaattaacttatttgggaagggttccctggaagcacagagagggggtagggaagtgagacaggaaagggaggaaagaggaaagccagtacaccatgtaagctggttagccctgtgggcaactggggttcaatccagctggcgaccctctgagcacacacctcaaatgtgttccactaatgattaaagaagctggagtatttatgcaccagcttcttcttcccacagatggaaggtagcacctggagcatgaactccatggcttctgggtcttgccccacatgtagtcccagcatgcacccagggccaggtagagagatgcaaaaagcctatgatgtgcacaggaatgttgacagaggtcctctggggagggcaaagtagctgtgggtcggtcactagcggcatcagctgcattatgcatctatctccctttagtattgctcaggcctaggggagtttgaaagggagaggaagcctaaaagtaaaacttactcttttttctcttcctttgagagtgccttcacaccacctgtatatccttgtcacctgatcctcattcccctgcgtaatctgcttgctatttcatccttggacagctgcttcctgttgccctgagacaggctggggggcttcttgcaggggcaacatgatctgatgtacactttggaagagtcactctggaagcaagtctggtggctagtaaaccagttagacactgtgactggtgatggtggctaggactagggaggtagctgtagagacggtgagaagtggttagattctgaatgcattttggaaataggattgccaagacttaactgatttgattgggtacaggttgtggaaaaaaaaaataatttaggatgactcctagtttgttgtttttgcttgaaaagcttaaataacttgtagactgtggctgggcacggtggctcacgcctgtaatcccagcactttgggaggccgaggcgggcagatcgcctgaggtcaggagttcgagaccagcctggccaacatggtgaaaccccgtctctactaaaaatacaaaaattagccaggcgtggtggcaggcgcctgtaatcccagctacttgggaggctgaggcaggagaaatgcttggatccgggaggcagaggttgcagttagccaagatcgcgccattgcactccagcgtgggcaacaagagtgagacttcatctcaaaataatagtaataataataactggtagaatgtattaccatttgtagaaatggggaaggctagtgggagagtgaatattttcttgtggagggaatggaatcaatagttttatatttgagccatgttaagtttgagatacctgatgtgtcttacataattacatgtgtgagttgagaggtccaggctggagatgtgaatgtgagacctaagcgtagagacagtttgtgaagccttggagctagacacagtgaagctagtaaagaaaaggaggccaggacttagcccagggcagtccaactttgaaagcttcacagggaaggagaaaggctgagaaaggacagccagaaagctagaaggagaatcagaagagtgtagtatggtgcaagccaggagatgtttccagaactggggagaagtcaacttggtcaagtgcttctgagaggaagataagcactgagaagaggctattgagtttggttacttgtaattaattagtggccttgagaggtgccatttcattggaggggtggagatgaacgccaaatcagaggtgttggagaaagaataggagaggtggagaggaaatagcaactacagagagctttttttttttttttcactctatcacccagactgggtacagtgacttgatcatgactcactgcagccttgaccgccccaggctcccatctcggccccccaagtagctaggactacaggtgtgcaccactacgctaggctaattttgttttttttcatagagacagggtttcgccatgttacccggggtggtctcgaactcttgcgctgaagcagtcctcacgcctcccaaagtgctgggattacaggcgtgagccaccgcacccagctctacagacaactcttgtaaggcgtttcactctgaaggggagtggagaaatggagcagtggctggaagggaatacagtatcaaggaaaaatgtcttaaaaggtattgatattttaggcatgttcagattccaagagaagggtgaattgatgatcctgggggagagaactgaataattatggatatcattgagaagccgagaggggatgagatgagagcaccatttcatccatggccgctggagggaagctgaaggatacgagcagggaggcaggtgggctggtgaactgctggtggtgggatggggtattcttctataaggggatctattttctctgtaaagtatggggtgaggtcatcagctgagagtgttggcaatgtgaggagagaagggagggtgttaataagttgtctcagggagggaacgtgaaggcattaaggaagtatattgggatgatcttactgtgttgagagccttctgagactgatggtcatcaatttgaagagtccaacttttcagtcactgaaacctgagactttggaaatacttcatgggctttgactccaggatgttcatctttagacattttaatgttgctggcattttggttgccgttgatttatttagttactgagttttaaaataaattttatattaaagtttaacattcccacagaaaagcgcacagaccataagtgttcgtcttggttgattttcacaaagtgaacagctcatgtaaacaccactcagatcaagaaataaaatgttactccacctgaaacatcctcccctcccttcaagccaccttcagtcaatatcccccttcccaaaagtaacaactctcccaatttctacccttatcaattagatgttcttgtttttgaagtttatataagtgaaatcatatatacttctttctagcattattcacttaacattatgtatgtaagattctttcatcttattgcatatatagctgattgttcattctcattgctgaataaaattccattgtgtgtacataccacaatttcttgatccattctcctgatgatggacatttgggttgtttccatttgggagctattgcgtgaacaattttttctacatgcttcttgatgaacttatgtatacacagttatttggtatgtatctaaaagaggaattgctggatcaaaggggatgatttgtttggctgaacagttttctacactggttgtaccaatttataaccctggaagtatatgaaagttctggttgctccacatcctcactgatattggtattgatgtttaaattgtagccactttggtggatgtgtaatgaaatctcatactggttttgatttgcatttctctaatggcttgtgagactgaacaccattttatataatttttaactacctagatattctcctttgtggattacttgttcaagatgtttgctcatttttatttctcttttctctctcttttttaacttttattttaggttcaggggtacatgtgcgggcttgatatataggtaaatcatgtgtcgtggtggtttggtatacaaattatttcatcgcccaggtaattgctcatttttcagtaaggttctttgcaccttttcttactgtcttacagatgtcttttatgtattttgaatatgagtcatttgtcagctgtatgtatttccaataccttctcttactctgtggcttgccttttcaatctcttagtgttatattttgagggcagaagttcttatttttgtatagtccagtttatcaatccttttctttatggttagtgtgtttttgtgttctcttctgtttgttcttaaacaaattcttcaccaacctcgaggtcatgaagatatctcaaaagttctagaaatttttcattttgcctttgtcatttagatccatgtttcatatggaattgatatttgcaaatggtgtgaggtagggctcaagattacttttttcccaaatatggatgcacaattggcctactgccacttattgaaaagaccatcatttccccattgtactgcagtgacacttttgttacctcccccacctatgacttttctagaactctgtgctaacctttatcttagcttttctcattctgtacagtagacattgttggtgccctgtctatattccatctctcatgctgaaggctacttactgcaaactcctgtaactctgcctggaacttttgttttgtactggcttatggaccatgcttggccttgcttgttgggaaggccagaggtgccagcaggttaatgcctcagaagcagcactcaaccaaatatggacagggagttggtggatgaatgcaccagtgccattactccttggataggagaactctgcagcattttctccaccatttctcagaattctcaagtaggactgagctccagttacccacagtgatgacttatttgatgacacatcctatctttgctgtcttcctttctccatctcacttcttcactcacctatgggtgtttctggagtcacctcccacataaactacttgcactcaaacctgtacttgcagtcatagggtctacttatgggggaactgcaaccaagacaatctatttaatctttaaactgtgaaggcaaagacctagggctgggggtatggtagagatgaagtttctcactctttttccttaaactatttagcccaggattattatattagccacacgcccagcccctcccagaacactctatagtgtgtgtattagtctgttctctcactgctataaaaaaactacctgagactgggtaatttataaagaaaagaggtttaattgactcacagttttgcaggctgtacaggagccatggccaggaaggcctaaggaaacttacaatcatggcaaaaggaaaagggaaagcaagcacatcttcacatggtggcaggagagagagcaagagtgaagggggaagtgctacacacgtttaaacaaccagctctcaagagaacttactcactgtcactagaacagcaagtggggaatctgcccccatgatccagtcacctcccaccgtgtccctcctcttacattggggattataattcaacatgagatatgggtggggatacagagccaaaccatatcagtgggtctggaaatagctgttactaccattagtggatgcacagtttgaatccctgtcttggcatgggagagcttcagtgcttcagcagtgagaagggtaacaaaaggaactcaaatctatgataatgaagacataccccctaaatttctccatgttctattgacaagcctttgagagtgttgtttattgccctttggaatgcataagtgacagccccaggagatccaaactacctatttgagaaggataattttcagccagagcagacacagaaactgctaacctctgaaaggaaccaggaggtaatacattgggtgaattgatcattttgggttggtgtggcaacactgatcatgggctcattctggttttggaaggatggtcctgcttttccttccctttctgttcagtctaccacttgtaaaaaaccttcacagtttggttagtgtgttctcttggatgtttctgtaattgtggttaagtttcttttcctcctggccctgctcagtgagcttctgtgaggcattatgagatcctaacagcttcattgaaagctgctttgaaacccatcacagaagagctgagaagaacacaatctttcaagggtttaataattcatggttgtaatttcctcataaccagtaacagcatcacatttctttctagacttttcttgttatactggattgggcttttaaatcaaaactcctgaattactttatctaagaaatccttgagattctgttggactgatattactaagatgataatgataaagatttctttcttcctgtgtgtggaggccttttctacacaatgccatcaggacagtgtaaagtccacataaactctcagaaacgtcttcagtctcagcacttctagtctagttttaatgggcattacttttaaaaggcaatgacatgtaaaaatctctcctattgtcccatgttagtcccagagtcttgaagattcactgattttgtatgacattttgaaattttagggtcaaggacaattttaaatatagttggaattttatttgatagttcagcttaatttctttttgctttattaaaaattgtggggcacaagattttgagggacattctattaaaaaatcataggaggagtaagactggaacaaacaatcacaaaaattcctgaacgtttttcttgcatcaagaattcttcatgaatcctatcttaataataagtggaaataaaaataatgaggtaggaatggttcctgaatgtaaggatctcattctggggttgaaatttgttgaaacaaagttttggagagcccacccaccagactaagcccagagggcagggaaactgtctactttatttttgtgaatgactaaaagagatatggtcaagttttgtttctgacatctctcaatccattaatgtacatgaggtttggctgtattgaatgagtaatctgaggacctgggcattcatgtgctaaaaaattgcttaattctgggaggccaaggtgggaggattgcttgaacccaggagttcgagactagactgggcaacatggtgaaaccccatctctacaaaaaatacaaaaattggccgggcatgatggtatgtgcccgtagtcccatctactcaggagtctgagatgggagggtcgcttaaatcaaggaggtggaggttgcagtaagccaagatcatgccactgcataccaacctgggtggcagagtaagactatatccagaaaaaatttttacttaattattattattttttattttgttttcattttttgtgtgttctaagcttaattggtgacacatgtgacatctcaaatcatgagattgctcctcagtttttaaaaacactacataatattcccctgcacaaacgtgctcaaagcatttaaccaccttttacccatatggtagcattttcttggttttagttattataaacaaatctcatacaaacagtttccatatatatatttgcttatatgtatgaatttttaagaatggtttcttaaaagtgtaattgctggatctaaagatatctgtgcctacatccttcaaagtgaaattaaccaagaataaagttaatttaacaagagtcctagaatcttggaatcatagagttgggaaagaccttagtacccatagaatcaaacttctcacccagagtgggaatcttttttaagatgtcccaaatggcagctcatctggtttccatgccctctgagactccagggagtgggaagtggccacccctgccccaactgtattgctggatagctcccattctcaaacagtccttatctacattgagagtgaatctgtctttttgtaatgcaagccttttcatctttgttctggtgtctcatgtcatacggaatctacctataactgcttttctagaacatcttttaagggtctggaggtcactgttatggcactgtctaagctttcttcatcccaggtaaaacaacttcaattccttcaaccaggcttcctaatgccaagtttccaggccattcccactctggttgtcctctaccacaggtgcagggcacaaatggacccattcctgtctttataagaatgtcccaggccaggcgtagtggctcatgcctctaatcccagcactttgggaggctgaagcaggtggatcacttgaggtcaggagttcaagaccagcctgaccaacatggtgaaaacccgtctctactaaaaaatacaaaaattagctgggcgtggtggcatgcgcctgtaatcccggctacttgggaggctgagacaggagaatcactttgaacccaggaggcggaggttgcagtgagccgagattgcaccattgcacgccagcctgggcagcaagagcaaaactctgtctcaaaaaaaaaaaaaaaaaaaaagaaaaagaaaaaaaagaatgtccctaatgtggtccttgttttaaccattgcatgacactgttggtgtaaaaatgctcttatggcccagcaaactcccttcctttatagtggcagtttttaacatgaggttttctttattccatgtgtgcagttggtgttttgaacttaaatttcacaagagtctcccattgtctctgttaaactgaatcttgcttgctttgctctttcatttccaatcagtggtgatggtttaaaatcttgattcaatgtgtcagctactgctcacagtattttgctctctgcatacaccatgaacaagattctatgctgtcacccacatcttcgataaaattattgttcagacggattcaaggccagagcccactggcaggcagtactagcaatgtttctccaagttgagatctattaatcaacattctttgggtatcattgttgcagcagccacaggtgcactcccctaccttcctgttcaaatcacatttctccaccttactcacaatatctatcatcacgagcaactgttaagtggtttgctgaaatcaagataccatatgtctgtagcattcttttgatctcccggtgtaattaccctactcaaaagggaaatgaggttaatctggctcaaactggactcaattccagcaatcagaggggccattttaattttcttatatataatgggtaaggagtttatttgggggaaatctgctttggcatgttggtcacagaataactgtaacgttggactacaaggggactctatgggtcttagagttcatttctctgactctagagtgtcagaatgcttttcccttcctttcttttaaggtacatggatgtccttgttctctgttccttaaggaaaggttgaaattcatgaccttttggcatttgctgaggctcagtttgagtaacattggcaagtgtctggtttaactaattgttgagaagcaagagaatatgtggttaagagagtagactctgaagctggactacatgggttcaaatcccagctccactccttcaaagctgtatgactctggacaatttattgaattttcttttcttcatctgctatggagtggagataaaagcagtactgattgcatcaggttgttgacaaaactaagaaagtcaaggtgtgcaggcactgagaactgtgctttgcacatggttagcctctgataattattggctattattggctattttattgatactataattggatcagagtaggaggtatgtgttaatttctttcaagtaggtgaaaacctgtgcctgaatctgtgaagtgctgggtcagggtaaagtatacagctgaccaagcaatgctgtgtgtctctgcatggtcaaagatgtctattaaggttcttttgttgttgttgttgttgttgtggcttctttttgttatgcagaaaagtagagaaaaaattgaccaataatcttattatccagattcattcatttattacacagcagtcactattctaggcccttgagtttcatcagtaaacaaaaagttaccaggaccttatgtttcaatggagagagacaaatcctaaataataaacacaatacatttgacgaaattacaaaacatgttaggaggtagtaagtgctgtgggcaaaaagaaactagagcaaggtgaaggtgatccagagatttggggcggggttactattttaaatggggtggtcaggtgggcctcactgaggaagtggcatttgagcaaagattggaaagaggtaagggtaaattacatagactgctggaggaagagtgttccagtggagagaaacagagctagtgcaaaggccctgaggtgagagcatgcctggtgtgatccggggatggcaaggaggccagggtggtggatgaggagttagcaaggaggagagtaggaggataagaggccagcaaggagaaatggcagtggggcggatcacctagggtctagtaggccattgtgaggactttgccttttgctccgagtggagtgggtagtcattgaaggcttttaagcccaggagaaacatgattgatttagagtttaaaaggatcactttgggtattgtggcaagaagagactgcgggagaggcaagaggggtagaagccaggagaccaagtaggaggcttttgcagtaatcctggtgagagacagtggtggtctggtaaaagtattgagaagtagagctgttgatggttgtttcatgtctggggctaggcatgcaactcatacagaagggtacaacattgaaaagaacaagaaagccctcctctccgctctcactctgccagacttgctccagacttttgcaaaaccattgaatgttgaggaagtaggcacttctcctacggtcttgttgattaatctgctgtcttggaaaaatttaaaaagtgtcctaactaatactctttttaaaaaatcaagatataatttacatgcagtgaaatgtacagatcttgatgagttttaacagctgtatccacctgcataacatacaaccctattaagatagagaacattctcctcacaccaggcaggtaatactactttcaggtaggaaagcagtatttgaactctgatagcctagcactatcccctaccaaggttgttgtgtgaacatgggcacagaagaagataattccatggggggcttctgggctttcgaccaagactaagaattagtgattccatttataagatatccaagacaaattgaaatagtggagtttcctcacttttggtctgatggtgttgggctgtttatgacatcatcgtgctggattttagggagaatcaggtttttgacaaggataaaaatctagcctcagaggtgccaggggtaacttagaagtaggagccttttattttcttatttatttatttatttatttatttattttttgagacagagtctcgccctgtcatccaggctggagtacagtggtgcaatctcagctcactgcaacctctgcccaccgggttcaagcaattctcctgtgtcagcctcccaagtagctgaaattatgggtgcctgccaccacgcccagctcatttttgtagttttagtagagatggggttttgccatgttggccaggctggtctcgaactcctgacctcaagtgatctgcccgcctcggcctcccaaagtgctgggattacaggcgtgagccaccgcacctggccagtaggagccttttctacgataaagctaaaataacatttttaaaaaaaatgaaaaaaaaaaaagaccttgatactctctggtacatttctaagtagcaggaaatactgatttgcaaactgtgttttcagctcatgctgatgcttgaagcctggatggaggacaaaattgcttagaattggatttatgactgtcctatctaagtgcattcagatgtgtgaaataagaagccctattctagagttcagttactcttgatttttcctactagaaatctaagggaaggaagaggtagtagctgtgaggacaaatgacagcccatgagatctaatgttcattagaatataacatcaatatttatgtttctctccagtctacatctggactctgttccttgagcctgtatttatattttaataatgcgaggaaagctttattttccttttaaattttgtgtcagagttctgctacctcagcccaccccctccccacccctgaagtgattcatttacaagatggcgcatgtttattgagagtttgattctagagattaacttcaagaagtgcatcatgaagtgcagcaggaataaataccacagaaatccttttccatgtgagaagtcatagggctttctgctgcataaacaggagagacggaggcttcaaagtttgcggcaatgtgggggagaagtgggaaaacctagaagagacattgggaagggttccctggaagattttcaaacagtatcacttgtgttaaatgcctttggtatgagaaaagagatgttggaaccctgctcaggtatcagatgtcacccagtactcatctggcaaacttttagcctttgctaattaaaactaatccaattgcatgaagaaaaatatattgcgtaagcttgcctcttgtgtggctttattttaaccctttgccccatatcctaataccagcgaatctcaggctggttatagggtagaagacgataatgagaaatggggttcacttacaaataaatttcagtcaagacaatgagtggagcaggctgttaagaatattggcttgtaaatgtaaaattgaagcccttctgggttttcttgattgatttgtcaattcaaaggttttagtggctgttgagtgggaaggaaaattaaaacaaacaaacaaacagacagacagacaccctcttttaattatcaatttatgctttgctgtctttccaagttgctttgtgtgcttctctgtggcccggccagcctggttggatcaagctttgcatttttaaatcttaggttcaaggtttgttctctgagggactggagttttgtcatgatcacatgcttgtgttcctaacctgaatgaactttctagttaagagtatatctcagtctttgattctctcagttccaccacttaccagctgtgtgaccttggacaaattcttacctcagtttgcatatctgtgaaatggagatactattggtactcattttatagagttgtgtagattaagtgattaatccatggacagtgccagcagtgtatggcatatacacagtatacatactatgggctaatacatgtaagccattgatagtactacttttgttgttgttttatcattattattatcaagaggcttgggtaaaggatgtaggtataaaaatggataaaacccagccctgtgacttctgaaccagtgtaaacgttttggtcagctggatccatggtgaaatgggaagagaagaatgctgcccattttctgacttggctcgtctaactcatgttgtgaagcactgcaagaacaatttagcatctggctgccatgacactctcattcttggggagtgtgtacttctgctgatgggtggaggaggtctggatgtgaatatttgccatcatggaagtggtggtgtagaaatgcaagcacccatgcgtttgctttgtgagactgtctgtatcttttcctataatgacgatatcctctcctataatgacatgtcttctctttgtagtcagatatcaggcatggaacagctagcagaggggagattatggatctggcatggcagagaatgcctaggtgttcaccaactccttcccttttgctcctgggtgcatggctagactacatttcccagcctcccttgcagttagttgcaactttgtgacagagttctgtccaatggaatgtggaagtaataattgctccaattgtaggaaggccatataaaagctcctaagcaaccctctgtagtttgtttctgtagtttgtttcttccccactctgctggctgcatgcagagggttcaacagatgattccgaggccctaagggatggtagggccaccgtatggaaagagcctgggttcctgaatcaccacatgaaaggctatctgccaacacttgatttgatttcatgtgaggaacaagtaaacttttattgtgagatttaggggatatttgttacagcagttagccaaccatgactaacacagaggtacagtgctgggagcaaaaaggaccagttttcctgaaaatgcgcagatgacaaagttactccaaagtatttgatgttccttctctgaataaaggatgtactaaactgcagagttttcttttttgagagatacagaattcctatgtgtgaccggaagccatgtaacagctttccttgagtaagcaaatggaaataaaaacttgttagcagagttccagtttctagagaaatgttgctaccaaaagaattcattctgcctctctccctttctctctctcttcatatataagtgatatagattgatttgtgacatgcttaaaacctaattataatgcaaataacgaatgtgcacaaatcatgtgtgtacagcctcaatgaatttttgcaaactgaacacagatttaaaactagtacctgggacaagatacagaacattttcagccctctagaaatcctgccaatgttctcttctgatcctgccttcccaagggtagccatcatcctgacctctgacagcatagattacattggcctgttttggaatcatatagtatgtgccttttctatatctagatttctatatgtaaattatatttcatgatccattcatgttgttgcatgtagttgtagttcatttattttcattgctgtatagtattcctttgtatgagtataccatggtatgggcatctggataatttccattgtgggctattttgaataatgctgctgtgaatattctagttcctgtcttttgctgaatatacctacacatttctgttgggttaaaaacttctttccttgaagttttacaaaactttgttcctcaataagacatttcaaggctgtgacaatgactgttcttattccttgctgtacctagactttctgatctacaccaagcaaaagctttgatctgtttttctgtaatgtaaaagattatcactgatgtttaataacaaagttctggtgcctaaaatagcgaaaacccgatctacttaaaaggaatccccccagctttaaaaaaacattggagcatagttgtggggccttttgattcacagacagtggctcctcacaaagccatgtttcaaatcacttgcaaactctgtgtaattggcgtttgacattggaatctttattggcactgcttcagctcttcctctgtgaggagaatcctcttggattttcaaattgcatcctttccttggggaaacagtggaggaggaagagtgatgagttctctaatcacttggttggattagccttagagttatcgggagttgccttctgtaagtgcccctactatcaaggtttcatggaaaatctaggcaaggcagaacttcctcagaaggacaagagacaaagaagtggggaggccctcctatccatagctgagagggtttattcttgtggttctgctgtcagagccttggatgtctgatctgagatggagcaaccccagctagacagaactttgtagatttgggggtttaaaaggcctcaagcaaattctaaaactttctttgaaccccctggcataggctcagtttccctgactccgttgctgagtttgaaatactggactcaatgaatagtacgacattccgcccccccaccgcaccctcagccccacagggtccctcactgtttggtttgaaatgaccatgattggagaattgaggggtgaatgttttagtctgagcctttcccttcaagcatatcaggaatatctgaaacatctttgaggccaaagcagaccgaaggctgccttgtgttttgattgaacgtttagttcactttgggcttgaggtgtgtgatgcctttacagttaagtctgaaaaaatggtcgtgaaaagcccctgggggacctggctgctgagtgacacacagctgggcctttgaaagtgggcttttatgataaatttgaacatggttttagaccttactataagtgcttcaatttttttcccctaactacagaataagtgagctgatttttccatgagggaattgctttggaacattaaccaagattttcttcaaatatagaggtgactatgtaatttgcttgtgccttttaaaaactgatggaggcctagtgaggcatctctgtgaagtcagaagttagacaagggatgcttttcttcacttgccaggtgtggaatgcaaatgagcttcatgcagaataagaggcctttaaaaatccaggttgcctttgaggacctggtaactcttgtttcgatccactgcttctcccaggttgcctatcttttctgtaggtgacagctaagaccatggcctacactttgttttccttcaaccccctaacttcttcctatggccaaccccacccccagtttttggaagatcgctgattttttgtcttagatgactgagtgttatcaacaggattctaaatgtgttgaggcagatacgaaacaaattcacacataccaccccgacatttcgtgtgtgactgccttctgctagtacaatgtcacgttatttcacaagcccctcaaaattctgtgatggaaatattataatattcttttgatagatgaggaaatgaaggctccactagtggctttaagaccacagtgttaaaaaattgtctggtcttggattcaaatgtggttcttgcatcttcagtttgggcacctcctctgctctaccctgcttctctctgtcagcctactactcttcctcccatcaccaccaccttatggccactgaggtgacattctccctcccagtttatgatggagaaacagaggcaaagaaaaaaaaaaaagacatgaggacaatatccaggtgcaactttgaatactcaaaagggctgggattagaacatctaagcaaaaaggctcatgaatcaagaggtacttctggtgcagccagagcaggcatacaactgggttataagttaacacgtgtatttgggtgaggctgtggctgtatgtctggttctaattagttgcttagttttcccccaaaataaataggaacatgctgattgtctaaaataagtcattcactatagcaggagtcattttatatatcaaggcctttactatctaaagccaaaacattcacctcatggacacacaagtttcttttctagctcagtggtcacccttttgtattctctaaggttgcttgaaggctggtgtaaatgaactgtgggggaccccaattcaggaacgaatcaacccaaattataatagattgccatttttttcatttattcagataggccaagatgaaaaaatgataatggtcaagtttggggtgggcataagggtaattttagacactactgatggaacaataaattagtatactttttctggtaggcagttggcatacacaaaaagctgtatgccaaagatgttatttcagaatttgatctaagaaaataattgcaaaagtaaataacagaaaataatatataaacacttcagtgctgcttataagtaagaaatattggaaatatcctaaatgattaacaatagaaaattggctgaacaaacaacattactgtgcattggtatagcaaacaacattacaactcattggtacagtgaaatactttatcaccattaaaatgattatacaaatggatatttattagcccagaaatatgtttatgatacattccaaagttaaaatgacttgttaccaaatactgtgcattttattgcatgtttattaagaagatataagaatacaggaaaaaatctctggaagggtatataccaaatcagtattttaaaaacatattttgatcatgatccactatgagaaatacattttacatttgtgagtcagtagacacatgtagctgaaacaatagtttattaacaatacttgtattttcttgtgtggtacgttctgatatatttatttatttattttctcttttttaccgtattatcctatcctttcctttcttaccctattctactttattctaattctatttcttttctcttctcctttcttttgtttcattttttaaaatgctagtcatgacctattaagttgattttatgatctcctaatgagccacaaaccacagtttgaaaaactgctctcaaatgttaacagtagttatgtctagcaggtggtaaataactctgttttgtgaggagacaagattactgtgacttctctgtgttacttatatgatccaaaaactaatgaaaatttgaaaaatggtataataattccatttataaacaaagtgatgcccacagctttttaggaagatactgattgtataaagtaagatgcctactctgctctacagttattgggcactcagaatgttctgggaactttaaagaacattatggcaggaaaaatatatccactgagacacatagtttaaataatagaacaataagaaaatacaacatgactttacatattcaaactcaaaagatcatcaggcatccatacatattgctttaccccagcaatgttgcatcatgtctatgggatttatttctatttctgatccagattgcattttttttcatactcattccccaccttaaaaaaaaagctactaaattcaccagacttctttctggccagattatcttggcttacagtactgttgaagttagcctcttttaaagctaaagataagtttaaatggaaggtagtcattaaaaacttagatcaggaagcaaaagctttaaaggaggatgggaagaatctctggctagagccagtacacttccctatgggcttcctgctttcagcacagagctggaaatctgcagaacaaccccaggagcccctcccggcatggccacacaaccaaccgggtggcatgttaagtgagctttccctgggtcttctctgggaaaaccttgatgaataacaaattccacagaaatgatgcaacatcactggggtaaagtgatgtgtattggtgcttggtgatcttctgagtttgaaggtgtaatattatgttttattttcttgttctttgggcaccatgagctaactgcccatgagggagggtgatctgctgggttgtggttggggagaggctggctggcattttcagggaaagagtatggagagagatgcttcctgcctttgaaaggaattaatgataggagataaccggggttgcttttcacgatgtagtaatttagttacttttctttcagactttatgctgagagtaacttggcgttgctaaaaatgtaatttggagccctggccttctgctcatggagaaggctaagttcatcctacctttgaaacattgtgaataacatatcaaagttattcatgtgctcattgatttattcattgattatgcaataactatccattcatgtggttgtttgctcatccattcatccatccatctatctatccatccatccacccatttttccaggtatccatttacatggtatttcttggctagatgctgtgtgttgagggatgtggtaatcactggggtgggagaagggactccataaggaagaagctgtctgtgtagttgagttgttcactgtctggtgaagcagataggcaagtaaacaaataattgccacaaagagtgggcagtgatacaaaagggaccaacctgtcttgattcatgtgaaactacttctcctcttcaggcctacaatcatggaatgttaacctgagagaggccttagagaaactgaagaagataatgttttccagactttatctcaagatccctgaggtgccattccagggtgtgaaggtgggagtaggagagaggaatgagaggaaagctgaacagaagttctggagctttctccagaaccagaacagattccttttcatctatttcatatattgaggttgcttgtaacctatcatttgaggaaaagggttggctgtttaataataattgcaaagcacttgaccagtcccccatctttccttgtttctcttgtttaaagatcgagactcaaaaatgtaaagtgattggctcaaagttgtaaaatcagcatgtgaacaatccaggaataagacttggtcttctaacttcatgtggacattgcctctgtatcagttagcttttgctgtgtaacaaataaccctaaaaatcagtggctttaaacaaccactgtttacttagcccataattctatgagttggcaatttgggctggactcagctgggtagctcttctagtttcagctgggcttgttcttgtctgtgatgagttactggttggctggcaagtcacctgagaactgactggtctaaagtggtcttacctctcagggttggctgggtgttggccagagtaattgggttactgagttgatagtctctcttctttagcagaatttcaacagagcagggaagcatgcacagcctcttgaggcccaggcttagggctggtcaaagcaaatcacgagaccagttaacacttagggagtgaagaaatagactctacttcttgactggagaatttcaaggtttttggacacaaggagaggagaattgttgccttttttgctatctaccacaagaatactaagttattgctatatcttttcttcttaatttggacattggaaaaatacatgtttgaaacgctatctaattccaaagccatttttacaaggatctgaaagcatggctctttctatagaccatggggattcctgcctacttgagttttctcttttttcttttcttttttttttcagacaaggtcttgctctgttgcccaggccggagtgcagtggtactatctcagcttactgcgacctccacctcccgggttcaagtgattctcctgcctcagcctcctgagtagctgggattacaggtgcacaccaccacggctggctaatttttgtatttttagtagagacagggtttcaccatgttggccaggctagtctagaactcctgacctcaagtgatccacccgccgtggcctcccaaagtgctggaattacaggcgtgagccaccatgcccgacccctacttgagttttcaaattgtttatatttgagacaggtgatagttactgcttgtggtaagggacactgtaccctaagaacattcctgctttactcccagtcacagtctttccatcaacaactcttcctatggaaaggaaccttcagctcttgattctgttaggtgtctctgagggataaatttatcctcatcatttccacaaacatttattgttgagtgactcttacgtatcatgcacctctctagatattgaagatacaaataagtctaagatagacccctaacttcaggtaactcacagtctggcagggaaggaagaaagatacggattgttacagtgaaataagatggggaagatggctggaaattgaattttttcagtggtcattgttttctttgtaataagaaggtgtggttgtatgatcacccaaatggatgtaggaatggcatttgacaaaattcagatcttttcatgacaaaaacacttaacaaactaggagtagaagggaatttcctcaatctgatgaagtacatctatgaaagacttacagctgacatcatacttaacagtgaaagattgaatgctttccccctaagattggaaacaagacaggctgtccattcttgccaattatatttaatattatgctgcagattctagccagagcaattggaagaaaaagaaataaaggcatccaattggaaaagcagaagtaaaagcatctttactcacagatgacataatcttgtatgtagaaaattctaaggaatccacaaaaattattagaactaataaatgagtttaggaagcttttaggatacaagatcaatacacaaaattcaactgtattctatacactagcaatgaacaatcagaaaaagaaattaagaaaacaattctaaggccaggtgtggtggctcatgcctgtaatcccagcactctgggaggctgaagtgggtggattacgaggtcaggatttcgagaccagcctggccaagatgatgaaacctcgtctctactaaaaatacaaaaattagctgggtgcagtggcagacgcctgtaatcccagctacttgggaagctgaggcaggagaatcacttgaacccgggaagcagaggttgcagtgagcccagattgtgccactgcactgtagcttgggtgacagagcaagactccatgtcaaaaagaaaaaaaaaaagagagagaatgagaagaaaacaattctatttacaatagcatcaaaaataataagatatttaggaattaatttaacaaaaaaagtgcaagactcatgcactgaaaaacatcaaagttcattgaaggaacataaagaagattaaataaatagaaagacatcttgcgttcgcggatcagaagattcaacgtttgcgagatggctatactccctaaatcaatatacagattcaatgcaatccatatcaaaatcccagctgacttttttgcagtaattgacaaagtgatcctaaaattaatgtggaaagggaaggaacccaaaatagccaaaaaacagtcttgaaaaagaaggacaaagtgggagaactcacacttcccagttttgaaacttattacaaaactacagtaatcaagacagtgtggagctggtgtaaggatgcagatatagatcaatggaacagagtcaaaactccagaaataagtttttacatttatgatcagttgattatcgataagggtgccaagacaattcaatggggggaaacaatagtcttttcaacaaatggtgctgggacagctgaatatccacatgcaaaagaatgaggttgggccccctccttatatcatcacaacatttaactcaaaagcagtcatagctttaaacttaagagttaaaactataaagctcttataagcaaagtaagtctttatgaccttggatagggcaattaattcttagatatgaatcttacagtacaagtgacaaaagaaaaaataaataggacttcatagaaataaagaactttgtccttcaaaggatgccataaacaaagtgaaaagtcaacccacaaaatgggagaaagtatttgcaggtcatttacctgaaaaggcactttgtattagtttcctagggctgctgtgactacttaccacaaactggggtggcataagacaacagaagttaattttctcatttcaggaggctggaagtccaaaatcatggtgttaacaaggccatgctctctctgaaggttttatgaaagaatccttccttgcctgtctcttgtcttctggtggttgccagaaattcttggtgttccttggctttcagacatatgattacattctgtctccatctttgcatggtgctgtcttctcagtgtgtctttacatggccttattataaggataacagtcattggagctagggctcaccctaatccagtgtgtccttatcttaaattgattacatctgcaaagaccctattaccaagtgaggtcatattcacaagtactggggattggactttaacatatcatttcaaggtgcacaattcaacccataacaggcttgtatccagaatacataaagaaagtatataactcaacaataaaaagacaacctaattttttaagtgggcaaaagatttgaatagatattactccaaagaagacataaaaatggccataagcacatgaaaagatgctcaacatcactagtcaccaaggcaatgcaaatcaaaaccacaacgagataccacatcatcatacccattgggaaggataaaataaaaaaggcagacaatagtaagtgttggtgagaatctgaagaaattggaaccgttatacattgctggggaacagtttggcagttcctcaagatgttaaatgtagagttaccatatgactcaacaaattcactcctaaatatatatacaagagatctgaaaacatattctcacacaaaaacatgtacattgctgatcatagcagcactattcatagtaggcaaaatgttgaaatagtacagatgtccatcaaccaatgaatggataaagaaaatgtgggatatccatgcaataaaacattgtcaataaaaaggtgactaaaggcaataaagattattgatacatgctacaacatggatgacctttgaaaacatgctaagtgaaagaacacatttgcatgatcttaatgatatgaaatatccagaacagataaatttatagacagagagtagattagtggttgtctagggctgggaagaagggaatgggaagtgactgctaatgagtatggagtttcttttaggggtgatgaaaatattctaaaattagatagtgataatggttgtgcaactccgtgaatataccaaaaaccatcaaattacacattttaaagagtgaatttcatctcaataaagctgttaaaaaataagatgatgtcctttaccaagagtagagggtattagggggcttgaggaaaatgttgaagatttgaaattcccattcaaaagaataagagagggagctgttttagtcatattaggctagctactgtaataaacagactccaactttcagtggctgaacacaagaaaactttatttctctcatacagttgtctgatcttggtcaggtgaccatcctcaatggctctcctccaaatagtgactcagggacccaggttctttccatcttttgtctctgctatctttttggtccttggtcttttggatctttaggtcctgggcctccccacccatatgctggatggggaaagagaatggaggattgaacctgggagggttttatggaacaggcctggaggtaactttctttacttccactcacattcttttggccagaactcagtcacatggccacacctaactgcaggagagattggcacatacagtctacttatgtgtccaggaggaaaagataaacaggtttgctgaacagctagccagcttctgctacaagggctgaccaaggacaaagaacgattgcaggctccaagcccagcttgaggtggcatgttttcgtggctgagagcagggctggatcattttctcccactgttcttggtggaacattcataggttgaaagtactactatggggcacattcctgctggtaaatgtagcccagtctccaccagtaatatctggtgatggaataaacactagagcaaccttgaacactttggcatctcacccacagaatgagaaatgtagccatgctgtccacactgtcattcaaaggggagcaggagatgaatgtgggaaataaactgctatttctttgcacttggacaagggttgaataaaaataagactctgtccccttttaaggttgtgctttaaatagaaatctgccccaggcccttcttgatcttttttttcctggctccctctctcttagtgtccttcactcctggccacatctgctcctttgtggctgaggggcctgagttctccttgggaaccagattgcctggtggatccctcagattgaagccccctccccacttaccttttcataagtttctagtgctacccggacaggtgcagctattttagttatatttctatagtggttgtgcctgcccttctagacagctgccacttgtctttctgacagactgtttgcttgtgtgtggctgctaatgctgtagtaaaaatcacctcgctgtcctgtccttgttttcagaggcacttgtctcttggtgtaatgctggatgtttaatgggcattgtttataaggagtataagacggaatagtatagcctcttgctttgtgtcgtaattccctctgggcttactgaaaaggatgctgggagttaggccaggctggcaggaagagggatataaattagaaagggagggagcaccagggccagagagaagtgattctgttaagagtgggccctcagaaaaggtggccaaaggtctaaataacaatgaccaaagtgtgcagtaaggagggtgggatccgggttggtgtcaatgtctaagagtctgaagcactatattggtttctggaagagattttcaactggtgagtatgtttgccttgccttattctcccctaatccattctctacactcctgcagagtgaaatcttgcaaggtacaattcctagttcacattcttccatggcttcttataataatatctaaatgaactggttttcaagaccatatgagcctggtcccagcctctctccagcctaatctctccttctgcctccctagattcattgccatggccccagttctaagattcttctgtttccttcttatacgccaagctctctagcacctcatacagctccctctggtcccaactttgataccacttttttcctggtagctttcctgactaaccctccccattgagttagttgcccgtaacactctgtctctctctctctctctctctctctctccgtggcaattatctcactctattgcaattacctgctcatttttgtgctcttccactaaactggaaacttcataggatcagggaccatgacttagtccactttgtactcccaattctatagtcagaataggctaatttctgtaataaagaaccccaaaagtctcagtatctgaagacaacagaagttttatgtcttacccacatggaattcaatgtgggtgttcagtagataaccttctacactgttattcggcaattaggcccctttcattttgtagttttcttatctcctagggctgtcctctctttccaagcctgcatctgacagacagatggaagaagagggaatggagaattgtataggaaggtttttaatgggctctgcctggaagttgggtactaaacccccactcatattccattggctggaactcagccatatgactgcatatacctgcaggagctgctggaaaatgtcatctagccatgagcaggcttggtgagcaagtagtgggtctctgcatgccaccagttagtgcctgcctggaatgtggtaggagctgagtgaatatttgttgaatgagtgaactttggattctaggtttcatcttgattcttaggtgattcagtttaatcatcaggagggacatgtgatgactaatcacagtggatttcagggctctgggcaccttggaagggttacggataatgatagagagaagagtagtgctgcctaagagtccagctcccagtgaggtgctttccttcaaatccaacagggaaagagatttttaaaaattaatcttgaattttcattttttggagaggacaaaggaggaggtaacagagaagaggagtgaggactgcttcctggattttgtagactgtgacagtgtcagctttttccacacgtgcctcgtaggttgatggaagcagtgtgtgacatgctggtgcatgcacccagctgcctgtccctcccctgcctgagagagaacaggtgtgtaatagcacacgtgacgtgtccactctctgtttcacagttagagcatccctgaggccatgcttcctcaactgaaacatccactcaggcttcacccacaatccagttccctatgggtggaagagaactcattccccaggtgggtaggcagaagcaagagaaccacgttgtgagagctagcatggaccaacaatttagtttgaaaatttgcctccaaagacaacttctggatgagctgggatataataacttcttatcgtgggtggctcttcagaattttctaaagcactttcccacaccttatctcatttcatccttgtaacaacatggtgaggtaagaaagccaagagttattatgtcagtcttacagatgataaaaccgaggctcaaagtagctcagacgactttcccaagaccacgtggctgcttttcctctcctgccatttccaccccaaacccccttgtccacattggtaaagtagtttctagaagatgtcctcttagtttgcagtcagggagactggaaaatatgtctcatgactgaccttatccctcaacactggccatttattttcctgtctaaacaagcgggtctgcaagaagctaccacaaaatcctcccctatgtttacatctctgtgagctgtggatccatgccttccagtgtccccttcgattgttggtggagaaaaccaagacagctaaaatgtttcccaggttgcagcaccacacatctcagctagttacagcagtgtctaggtggagttgtgccatgggactctttttcattaaaacaaaacaaaacaaaacaaaacaccacggagctaggatgttttaataaatgtctgtgtgtgcgcttgctaggacacactactgttgcactctcaggaatcattaacgctgtctcccaaccttactcagacagaaagctgacgttaccttgccatcctacctaattaaagatgaaggctatagtttccccagtctattatagtctagtttctgtattttgccattgcagaggaagagggagaagctaaaggttgactgtgatgtgggaggatgcagccaggggcaaagagggtgaggatgagttgcttacctcacagaacctaacaccaaatttttagcatcaaaatcctaacagcagaaagaaagtttccctgtggaagaaggactgggccatgtcaattcccaaaccttccatccttccttcctcccaacggctcaggtatacctgagaaacctacatctgctggcatcatctcccatgcattgtttttgcagaagcagagcatgaccgacatctaataatatctatgttggtatctgtctcagcaaatcctttctgtattaaaagattaatgtagtaaatccagagttacagggagattgtggtgtttcctcttctggtgtcagagtgttgtttttttaatactatattttgttttcctttttcaccctcccttctcatccctataaaccatattttgaagcccttctccaattgcttgattttcctaatagtaataaaaagcctagacagtttggatggcatctgtaccacctcttttagggattataacccaatttttctccaacagtgaacttatgggtcttttatgatctggctttaggtctcttgaatgaggctgacatgaggatgtaaggcttgaatcataagattttaggaaaggctctgaaaagcaagctctttctgaggagtgttgattttttttgggggaagattattttgccagtgttcaggtaagaattcacatttgcttctgttactagtcatgatagctgaatggtgtgcttcattcagatactgtgtagtgatcacttactttgaattgcatattaagacatgtgaccatataaccttttatttgaaccaagcaatttacatggtggagctgaagattggttgttactggttcatttttagtgagcactgactgtttctaagactctatcttggtcagactctctcttgaggtctcccagggtaagtcagccagactgagagtgacccaagaagatggggcaacattctgaagaaaatagaaaatagtgctgtcatgtggtgaagaggccagggagcatttgtttccccatgcccctacccaccccgttatttattgattctgctcataacgtaacagtatatgtatttttgttgttgttgttgttgttggagacagggtctcactgtcacccaggctggagtacagtgatgtgatctcctctcactgcaacctccacctcctggactcagtcctcctacctcagcctctctagtagctgggaatacaggcatgtgccaccatacctggctaatttttgtattttttgtagagatggggttttgccatgttgcccaggctggacttgaactcctgggctcaagcgactctcccacctcggcctcccaaagttctggggttacaggcatgagccactgtacctgcctgaacagtatatgcacctctataaagaatgatcagatgatcaatattaatgtattgcttgattcaactcccagcgtgatgtttaatagcacatggtgggtgctcagtagatgtttgtggtattgaagcaatgtgtttattctatgtgttttccactagattatgagttctttggagtcagggcccatgtgtcctttgtctttgtgtccccagccccatccccagtgcccagtacataaggagtatttgttgagctcccacaaaacaacatccgtctgtcaaggattgttcaaatccctccttccaacttgttctcccttctcccttaggataagctcttttcttttattctagtgcctcagccctgagagaattttttttccaagtaattaccaactcatgtcatcggatgcccatttgactagtcccagtatgtattagtctactagggctgccatagaaagtaccatagattagactatttaaacaacagaaattaattcctcatggttctggaggctgagaagtccaagatcaaggtgactgccaattcagtttctggtgagggcccttttcttgtcttgtagataactgcgttcttgctgtatcctcacatgttagacagagagagggagaaaccgacggagagaggagagagagagagagagagagagagcaagggagcatacaggctccctggtgtctcttctgataaagatgctaattcacctggatcagagctccaccctcatgaacttgtttaaccttaatcacttccttagagcccccgtctccaaatacagccccactgggggttagggcttcagcatatgaaatttgggtacaaacaatcagttcataacacaaggtacttgttgcccactgtaacatctgctgtttcccgaacaagacaaaggtgatgataattaaacatggtactagactattcatgttaaaaagcatagtactgtgtgtgaagcatcttaaatgagtcaggcaggagcacttaatgaaaatctatggtcaattgaacataggtttactgtgcccttgtcttttccttccattatgttttttttttttttttaaattactattccatggggattctcctaagcttgtcaattacagacaggtgctcttgttttggagccagagcagcagttgtaaaaaggtgaaactggaaggtcaggataagctgggttatgccatgacaataaacatctcccaaatctcaatggctcatataacaaatgtttctttctcccctacgctacatgtctaaggggtgtcaccaggggtgctctgttagttgtaattgttcttggatctggactgatggaggcttcattctgacacgtgtcacaaaggagaatatagtaaattgtatactggctccaaagttttcacctagaagtgccacataccacttttgctcatccttcattggctaaagcaagtcacatggccacatccaacctcaaagaagtaggtgaaacaatcttactaagaaggaggagagctaaagctttcctttggcaaatggcactgattaatactataatggggtaataatgaggcctaggtaaacagggtaggacttgagcaaaacttgtggcacaaatgagaaattttatgtacttaatgcttttttagaaaaatgctgcttccaaaacagctctaacatccaggatttcttgcctagccagtatttctgtgcctagagtgagattcagagaatgaaacccttttttactgagatcctgagagttgcctttcaagtgtccatagagtataaataacaatagcctcaaagaaacaattaaaggctctccgggtggcttatctcagatccactgagaaatgaaaacccccaaacatgccagaacactaaaaaaatggctgtgtctgagggtggtctccttgtcatgataaagctttctcctcatccttctgaaaatgataccaccctcatgttagcaacagtatcgctgtctggaaaggggctggctgaatctggtgggattactttgagttgcataaacacagattgaattaagcatggcgagttgatgatggggagtgtagaaagagtcaggaccttgcgttgggataataactagttcattatctgcccagataaaggtcgtacaggcttttagcaacagcatggaaaggaaaccagattgacctttctgacggcaactctctgctttttttttttttttttttttccagaccttagaacaccagtgagtaaagaaatccgtgtccctcctgacacctttcctttccctttcctggcgttcccaaaatgcaggccttcatttccattggttttgaaatggctgcctttgtttaaattacttataatagaacgttcctggaaaactctcacataagcccatgagcagatgttagtatcttatatgcctccaattttatatgctatatcacacctcttccttgctccaaaattttgcctttgcatcaaaaaaggcaaaaatcctattatttagtcaaaggaaacttctgcttcttgggctatatcttccaaatttctttaaaagagctcattatgaatcatttggaaggagccagcacaccatattgtctttgtgtgaaacttagaaagcagtgtggtgtgggtggagatacgtccaactataaagagaaattatagttacaagtggctttcaagacattaaggatattttggagtcctaaattaagcaatggcaggttaatcttttcccaagaggtggtgattttggctaagtatcataaaagggttatcccaatgttttcaacgtggtttcaagtgaatgatcatctcttattcatttttcataatcattttaatatgccacatatgttccaaaatgggttggcaaatttattttctttctgctaccttagaaatcttgtcaataaaatgaagcctagtaatatggatttcttacgtagctataatttttctttgtgagggagttaagatgtgtacttcagtaagaggaatgggctgtgttgaatgccagatcataatgaggcctcctggcgccaataaattacacttgctctaggttgactagccatggaatgaggtcatgtatccttgatccagatcatgaatgtgacagcctgcatctacatacagtataacccaatccttgctaccgtactatatttcatcacagtctgtgtcaccttcagggcgtgggtttgacagaagatgacagtagtgatgcatattatgctcaatccttagcctcaaacagcaaaaggccttacatttagattttttttaaaaaaagaagacaattttatatcacctacagataattaacaggctctgtgtgaaaaatgaaattagaaatattgaacttagaaatagaggaaaaaatgaaatattccttgaaatatatccaggtagtgtagaataacccatgaccatattctgtaagattttccttttcctggctccctaccctatgtttatattcaccccaaatgcacttttaatcacagctttttctccatgagcaagtaattttttttgaaataagataatctgttttgtaaggggtaagtgattgttttatccaggaaagatgtatttcacaatggtattagaattatgtgtagtttcatacttttggtaacaggagatttttagatgaatgttcagccacccctgattatttatatagctccctgaagtttgcagtgacatagaatgaagtgataaagaatgatggtaaatgtcattatggtgttaagtgtatcttttcatatgaaatagtgagaaaagccttgtgcatatatgaagctcttgaactatggatgagtaacattagtgtggctccatttcaatgatatttatatacttaaataatgtattcttttataatatatattatatattaagataatatatatgtattctatcatcatatcaagaacatagctcaaaaatgttttcaaagaaattgagattgaaaacaagcgttgctgggtgcagtggctcatgcctgtaatcccagcactttgggaggtcgaggccggcagatcagttgaacccaggagttcaagaccagcctgggcaacatggcaaaaccccgtctctactaaaaataagaaaaaatcagctgggtgtggtggcatgcacctgtagtcccagctactcaggaggctggggtgggagaatcacctgagcccaggaagtcaaggctgcagtgagctgtgatcacgtcactgcactccagcctggtcaatgggagtgagaccctgtcttaagaagaaagagagagagagagagaaaacaaaggcagcaattatgctaagtctcaaaagttccttttaactgaatgcttagtgtgtcctgatatttaacatcactttccaataatctgaaaaaaagtctagtgcttgttgactcaaacttgaacaatgtttgcatgctgactgatgtgtgagtcagaaggtatccattatcttaatcaaagattcacaattttttttctgtaaagatccagagggtaaatatcttgagcattgcagatcatgaagtctctgtcatagctctttgtcactgagtgcgaaagcagccatagacaatacgtaaatgagtgagcatggctgtgttccaatgaaagtttataaaaaacaggtggtgggtcaatttggcttgtgggctgaagtttgtcagcctccgatcttaactatgaagcttttaaacttagcctaattgaaaaacgatttccatatggcacctagtagaatatgtgactacctgtgtatttagcgcttgtgtgtgtgtgcgtgcacacacgcacacacatacacacaagaatgaaggtttacatgcctttttgagatcagtctggaaaaactcctgtacatgtaattttgtcttacagtcaataaatatgttccattttctaaataaatagtccgattctctgtgggattgtggctaccttatccaattaaagtttatgtagcgttgtcattgttatcatttctcctctcaagttcattgcatcatgatcatatgggttgcttaattattactctttagtggtgatgatgctattcacatggacttttttaatgtgggctgtgcaagttgcttttgttatgagtcattctctcttgatgtcattagctgttttaaactaggcattaattgaaatgaaaccacaagcttggttagattgattaatcgtttcagaacctattcaaaatacttttctttcttcccagaaaaagaaactatagtcatttgcccagaaatgggagagaatcatgcttttccaaaggcgaagactgtttgttttgaaaagtggatttattgggatgataaatctggcttgtactatctgctcacctgtttgtcctcgggggagctatcactctattaatccttttacactggaaatgttgaaatgatagacagtttcaaaagttgcacccccaaaaaaagcagataaacataaacaaatcttactcttctactttggatatgctttgaatcagcatgctggggcacttccttataagaggaaggcaattaaacaagagctttggtcttttgtaaccaggtcctgccttgtatttgggaagctctgtcgtatagagaatcaggctgcaggtcttaccttctaaactctcagctttaacttttctttcctgttttttattttttttcaaagaaataactgatctttccacatctaaactgcaggtgcagacaggcacacaaaatgacactgtcccaaggtccaggctacttcttctggacatttgatctgccaggtcaaatttccaggaggactggcccagacaatgtcaagatgagaatttcttcccttactgctttctgtgcaattgattgcagcatctctgcaaaaccactgacattctcttaaccttagtttgcttttttgtgaaatgagtgaatcccagtacaaggcagcagcaaacaaaggtgtaaaaatcacctgaggcaggaaggccagaaacgaatcccggtggcttgaggtacagttgtgcattcataaattccatcagcatgtttggtcatgaatgtcagtgtgacatttcagtcatttaaatcattgacgatcatgtacttttatgtgcaatttgcttctaaaaatatgtgggctttccaggcttttatttcataatgttccctccctcccccgtctccgcgccagtgaaacaattaggtaatatgttttagagaatgcctcttcttagcttgggcctgttttctctaagacgttactagcagtttgctcattagcagtgacaaggaaatggcaccagagatgctttcctgagaggtctccctgcactgggacctggaaggtgagccactgggtggctgagaccctgggagttttagcatgacggcaaaggggaacaagaattttcctagcctatgatgttttcaagtatccactctgaaaacgatgaattagatgaattctactttaggataggcaacacagagagaaagacagacagaccttccccctccttgcccccttccacagaggcagaggaaagaaagattagaggcagagcagcaagggttcaagaatggaggacagaaaggcagaagagaaaatggtgaggctgcagttctctgttgcccttggcaacactgcatgggggcgggggttggctggtatcttggtactgagcctgccctgccctgccccgggaggttgtgggatatcacataggggtggagacctcgctggggacagctgagcagatgacaagtctgcaccaagaacaagcaaatgttctctgccgggacactggctctatctgtctggctccttccaggaccttttgaacttgttccctgggacacggtatagcccgcttgtggctcctctagatatttgtttttcctaagtgcattgatctatcagagtaaaaactagccaaaaataagaatggggaatgaatcaatcctctggactcctctctcctctgtgttcccgagtctcaatggtatcagatggccagttgcaaacatttacttctgactgagtgccctgatttctttagtctcttatcttctccccttccctccctcatttccttatcccttttcccctctgccctcctctctccacagctttggtaagaaatagccagccttgaattcaagcataattgctcggcaggggggacttccttgaaaaaacctcaaatttttgggctgtaacagtggaaatctgtttgaacccttgaacttcctttattgttgaaatgaccacctacagaaacatgctgggggaaagtagcagaagcacagtggtcccttttatgggaaaaacagtagctggaattatttcacttttgcaagaattctgtaatgaggaggcatttctgaagggagagtatggcacaaacattccacaagttggagatgtctggactgagattgggatattgtaataatcgatgtttctgggcttagaaacagagtcttcattctttttttgaccacaagcataaaagctggtaactgtagcatttctgtctacttttgttgccatttgcatgggctcgctctgggtactggagattttcaggcacacaagctgcaatagaaaggcggctggtatttgcctcttagaaagtaaagttggcatgctatgatttgtattttccaaccaacaggctgtgtggactttttcctcggttcactcaggcaccaggatatcttccatttatggatgccctgttcactcagtgtgccagagagggcttgtgcatgggtggacatacactgataaatctgggaagtcgttgctttcagtctctctctcaccctcatcctctctccaccctaccccccaacgttttcatcttaaaccaaaaatcagagtatgccatttatctgcttaacaaatgcctataaccctcacctatacaagataaagttcaaactccttagcaaggtgtaggtctgaacccagctcacttttcccaactcatctctttacacttccctgcttcccctggactccagcacatgtgatgtgcaggtctccagatctaccatgtttatttcacttcattgcatgtgctgttgctcctgctgcttaaaataccttttcttctctttttcactgcaaacaactcctactcagacttccaagcacaagtgaaatataacttcctctgtgaagtcttccctaacttcatctgctcactccatccactttgctgctaaaatgttttcatatttacagatatttctcttaacagtacttactgcatgggactgtaatcaaatgttacatgcctgttgcagtctgctgcaagcctggtgagggccggggccatatggtattctgttttggattcttagggcccagcatagcacctggcatctagtaagtgttcagtaaatattttctgaatgagtggttgggatccattaggaaaatgtaggagtatgtgtgtgtgtgtgtgtgtgtgtgtgtgagagagagagagagagagagagacaaactagggagtgcgtgttttgagttggaaggcagttactgcgattggtgtaaattgttatctagttacaaaagagtcatagttttctttcaatgagccttgtaaaagggggtgttctcttcaagaaatagaaagataattacattcaccctctttattacccttctggacaaacacttcaatattgttatgtgatgacacaatgcttctgtatttgtgggtctgtgtgaatttaagaaaacagaatacacacacacacacacacacacacacacagagtctgagtttcaaagacacaaaaactaagatttttttttaaattgaagtattgcataccagggtcagaaattttttttctgtaaaggaccagatagtaaatactttaggctttgtgggacatttagtctttgtcacagctactcaaagtctgctgttgtaaagaaaaagcagccatagacaatatgtaatttacaagaacatattttttaaaaggttttttaaaattaacatacaaactctctacatttaaatagtgaacattcagtaatgattttatctgaaaaattattcttttcctgaaaccttttcaattatataaaccatgttagggtagataagcagagcagcaggagcaaatgcactaagattgggtgattgcatcagaaccactttggtttcatgtcatcatgtcaaccacaaaacttgtgataaaactcttccacctgcaaaaagtaaaacaaaatgcaatataaaatccaagtttttagcaataattttactaacttatggccttcagggtccattttgtcatttacagtgattaatcattggcttatctgagaaagaaattttttctgcattactgttccttattggcattgtgttaatcagaccaatcctaattgggcattaaagacatgttcatagaagttacagtgtggtcaagatatctgcatattctgtagaatgttctgtgaacagtctagtgacttacatttggatgagaaataaaagaccacggattttgtgtgtcaatgttgtacctttggttaattttgctattttccattttgtcggtgatggcttccatttgcagccacatttggagatgcctcattttaagcaactcaggtcaggattatgcttgacacccaagagcatgttcatgaaagaacttcaaaaattgcaaagtcctggaaaagcataggcttcatttttattatttatcatgaagctgctcaaatctcctcttaagcatgaagcctgatattttcactgcagaatatttggaaggtgctgtccttgtccatcaaggactctttccaacaaaaccaagtagcaagacattaatgcaaaaagagaaggtaaacaatgagctagatggcaaatgtatgtgtgaatgccttaatgttatgagagagcaagatggtgcattcagagaactcattcattctctgaatgttggagacgttttactattgcttacttaaaaataggctagaagtctagagataacctcttcatcatcctgaaatggactggcccctctgggtaatttcctcctacatttctgggagaaattttacaactacagtttcttcagctgggcctacctggagaatgtccccagcggtcccaaatctaatctgtcaaaacaggatagtttctttctcctcattcttggctgccttcaatccaatgccaaggaggccagaaattccctcaacttcttacaggttcgggctactttgcagaaaagataaatctctattatctgaggatttgtgcatcctcaaatctctatgtggcgttagagcctatgacatttttttttgcaaagacctggtgcaatggtccttcccagtgcattttcacaaggcttctctttgtgatgatgtttattcagcccatttaatttggaagtgaaggaaagaggagaaatgaaaagaaactgtgggcacgagagagtcaaagaatgaataaggaaaactaagggacggaggaaaagaagaaggaaaagaaagaacagctctaacagcaaagagcaagtagaggagaatattgatgtcaggctggagactgataaacgttaagtttcacagctaaggctctcagagcagagaccactccttccttctcttgtgtatgtatttgtggatagaaccaaaaaggaatgggattattctgctgtagatattcttgtcgcagttttatcttagtgtctttatagtttaacatatatcctttccttttattaaatgcatcgtaaaatcagcaagctttgctatagactttcataaacagaattttccctttttggtatggagcctggaaatctgaaggacatggtactgcttacgggcagatcatttgtttaaactcttcaacggcctgccgtcagcaccaggaacatttttaaatcgggttctgagctgttaatctttggtttgcactaaaattctcaattgaaacatttttctttttcaagtggaccttctgaatctggacataaacttctaccgtctagtgtgtttctcagaataggaacatttaaagaaagcttttgggtgactgctatttctggattgaagtgagaacaaaaatgtagacaaaatgcacatgtagacaacatgaaaaaaataactgttgtctttaatgctgtgggaagcctgggtggtatttgccctgaattgtgtcaatttatgtaatattgcttaaacttggtctgctgcttgaagaaccatatatgtgcccatgtgtgcatatatatgatagaaagagagaatatttctagatttagtgtataaagaataatggcctagaagttctagaaagtgcgaatccattagtcatggccgtgaatcgcccacctcaaggatctgttgccaaccaactgtaaggtatgtaccatgaaaagctaaaattgtttcctgatatcactttaaaaggtaaggtatatgatagcttcttttctagaaagtcataattttgaattatcaaagtgccttgcttataaatacttttggaataagtaattctgtctttcctaatatttctagatattgggagcaaattcgtgtttaccttatgtgtatccctcatggatttttccatttccattgtattaactgtgactttcttcagcaaatctggtggttgtagatttattttaattctccgtgccatagtattctacctcagcatgcaatctgctgattccttcccctttctaaaatgagcttgcattttaatttttaaaattagtattaaccaggtaataaatattaactgagtaccgactatgaacctgactctgagaaatgtcataatgagatatttaatgacaacagtttgagaagctaaaaaataatttgccaaagcatataatttatttgctagtgctttgttcattcatccattcacccattaacctgacttccatcttcttattccctatctgctcatccgtccacccctgcacccatgcacttatccaagaatccattcattaatttattcactcatccatttattcacacactcatccacccatccacccatctatgaatccacccgtcaattcattcttccatccactcacttactgaactatccatgtacccatccacccatctattcatccactcatccattcttgcacccatctacccatctactcattcacccatccaccagtccacccatccattcagccacccatccacacttccacccattcacttgtccattcatccatccatctgtcgttcaccagacagatgctgaaggcctttgatggtcttgcacttatcttggcattttaaatataaagttggcaaagtagttcctgtcttcttaaagctcaaaatccaagcaaggagacagaccacataaaaaatatttgtaaatattttgaacttctttatagaaaagcagtcttcaacctcacagtggcctaatctcagtaaatgtgtattggcattctttaatagttatcattaaaaaaatactaagttctcctttggcaactgtatattgttttcctgcattcttctgacttcttacttagagttataatatttttataatgatctgtaatggtatgcttttaaaatggaaataagaaatatagagacaggtgttacatgaagggggctactaaaatgtaggaattcatttgggggacagatgagaatttactggttttaaaagtacttgccatcttttttttttcagtagcaggaaactaatgatttctttttattcttgggagggagagggcaggggtggtttcttaattatgaagtgcaattgtttagatttttaagtagtgttattcctgttatgagctgcccaggcagccacatcaaaagcagctctacgtgtgtgtgtgtgtgtgtgcgcgcacacacacacacacacgccagcctggattgtggagacagacctggtctctcagacctggatttaatttcattgcttgaaggagaaataagttggtgtgttctttctggcggagagtcattttttcctgccttgttttctagctttcaagtctgtatttgcattttaattaagaaagaagacaactgttggaaatgaaatttggatgaaagctgtgaatatttatcatttgaacaagtggtgttaacataagtctacctgttgaaaacaatggttttaaacttttatactgtggctgattttttcttttttgtactttttgtttattttattttattttatttttgagacagagtcttgctctgtcgcccatgctggagtgcagtggtgtgatcttggcttactgcaacctctgcctcccaggttcaagcaattctcctgcctcagcctcccaagtagctgggattacagctgtgcgccaccacacctggctaatttttgtatttttagtagagacagggtttcaccatgttggccaggctggtcttgaactcctgacctcaggtgatccgcccacctcagcttcccaaagtgctaggattacaggcgtgagccaccgcgcccggcctctactttttatttttaattaatgttttccttttcaaaaaatgagatataactgacatacagtaatgtgaataaatcttaagtgtatggcttgacaaattttgatgtgtgtacacatctatgggaccacaaatcagatacagatatagaacatttccagtgatccaaaaagttccttcatgcacctttttcagtcaatactcatacctcgcctttcacaacagtaactactattcagacctctgttatcatagatttattttgtttgtttttgaacttcatataaatggaatcgtacaataataatatgtatcttttgtgttgggttcttttgatcaatattatgcctatgagacttctaaagtaaataaaccttatgcttttattcacagactggggtaacaaaactatcaggattctacttaggttctaaaaaagtggaattgctaactgagttgttgttagttgggtttgtctgactttgttttggcaacaggagttggtcccagtgatagggcagctaatgattcaatccatcaatctataggtttttatcgaaaaccctctatatgcttagcatgtgtctcttctcgatggttcttttcaaatccagggtttcccaccctcagcactactgacatttggggctggatcattctttgctgtggagctgtctgtgcactgtaggatgtttagccacacccctgttctccactcactgggtaccagtggtatctactcctcttttgtccagttatgacaccaaaaatgttttcagatattgccaatatccctggtgaggcaaaattaccctcagttgagagtcactgtcataaacctactgccactgctttctacattttatttcacaaacttttttgggtactttctgataagaagaacctatgagacactttggacgagtagggaaggtgggctccaagttctttatttgttatgtacttggttgagtgaagcacacagttttcatttctaggggtgggtaatattatgaaaaaaaggtagaaattggtaagatttgatgatagctactgacagggtaactgggtcaaacttcaaagtggcaattctgaaaatgcactagcagtctgaatctccaagtgatttttagacgttttgaaaaatccaagaaattctaagaccaccacagtttggaaccatgccttgagtaataggcctgggatagacatgaaattcctacactgcatttaattaggaggttttgatcagggttccaactggcatttgcagctgatgtttgattaagagaaagtcctgtctcaaaatatgagaaaacttgaataataaaagcactgtgccaatggcttttcatgtatttgtttagaacctgccttggttccaggaaggatttaatgtggatttctatcattgcatgtgctgtcttcatcaatggtttaaaatatcaaccagggtgaagatataagagaggaatatcgaatcattgcttagaagaagacttgagcaggcatctcctcctcctccatctaagcttcaaaagaggcctcccctaaccagacagtccagtgagataatgaattaattagagacttggaagggttagcatgagagccttgtctgtcttgcctctggccctctgtctgctcggctagatcctggttaggagcttttggcagtcctcaggttggggatgagataccttggcaggcttgagtgggcatcaaagacaccaggaaggatcccagcccagtttctggcaattctatctgtcactgggttttatgcctgtgttcaaaatattccatttctccatctgtaaaatggagataatccttcctcaccttgcagggatgttgggaggattaattagctagtgttcctcaagtgctttgaagatgaaaaggcttgtggaagtgctaagtattaaggcaaggcagcgaatgcctgctggaagtgctcttcctttcctcatcctcttgtcagcagttgtgtttctcttgccttttctgcatatttcacagaccaaagtgctggcatggtaggtaggacaatgcatggatcagcacagaacaaagacagtaatgccttattttatgccttgctactaacttggcttatcagttggcatgacctctgaagatctttttgctctgaatgttttaatcatcaagttctggtggttatccaaggtgatcctaatctactttggggtggagggaggaagtggtgtcaggagagatcaaaccaggccaccttgagctgaaagctctgaaggagaaggattccttgaaatggaggtaatttttgaattataataagtgagaagactgcaagggagacaagctgagggacaaatgctctgtgcttttctcctcactttcacaaacaggaggagaacttccactgacctagcagtagtttgctcctccaggctgtcatgtcttctgatcatgtcttttatgaggtgaatttctcctcatgaaagactagactttaaggagagattctgtgcaggtccctacagtgtggagatggattgattgggcctacagattgcagctaatcaattcatcctttgcttcccaaaggtttatgcatttgggtggagttcacaatgagtggtctgggtgcagggccgtgtggagaagcatgtccaccgctcttgccccggtggcttctttagataatcttgcaatcttcacaggttcttttctaggtatgttattgtttggaataactcccttgagtttggaagaagaaaaggaatagtaccaggtttactcaatcatttgttagtttgcttgttatcttaaaaaattctataaaattcttttgagaagtttctctgctcattgatcttgaaaatctccttgctttagagaatggatgtgctcctcatatgctaaggataaaccagattttggtaaatcaggttatcttaggggtcccaggtgagtttgccattttaacgatgcttagagtgaatccttgtataagggaaagtatcttgtatattctgtatcctttaggaactcacgtctgttgactttatcagatgttggggtggtggtgaggctaaagaccaataggcgacatatggcaggatcttccctccaagtgaccctctggaaagggctatacttacttaattttggtggagctcatcatagggtcaggaaaccagggagaaagctgagcaactggtatttatagatctttctctttaaatcaggtttgctcatgatttgtctggtctttattcttctccatgtctgaaactgagttccttggattcccttctcttcaaagccctcttggcaaccttctgaggaatggcagagttcattctgatccacgtccggtgagcgtagctcaaccgtgatggagcttgacctgtcaaattcacagaaaaatgtccgttacatattccagctgttccttaaacatgctccctaagagctagttccatttgttagctgtcagaacgatgtggaggaattgctccagacccttggatgtcatcaaccacttttgtttatacaccagttattttctctattagcaaatcaatgtttggcaaaaagaaagcacaggctaagaacttttcctgatgagttgctgccccagccttggaactcttctcagccaaaaaaaaaaaaaaaaaaaaaaaaaaaaaaaaaaaaaaaaaaaaaaaaagaaagaaagaaagaaagaaagaaattgaggaggaattcagttttacatgttttccttcctgcttacatgaacagaggaggcctacctgaagctgaatccaagcactgcctttgacgttggtaaagatggggctctgagctcacatatcaccttggaaactggatcctgttactgctgggaaaggaatgcttggttgccaaaagcattaagatagggaatgtggattccacctctcagtgctcctgccttggatcaattaggtaggatactacccagagatacagacatgatggaccaagtaacttctccaaactttgattctctctggatcccatggatatgggaactgtgatgtccaggagatccagagagaatcagagtttcagtgagtgaaacctagagtgtgtgctgctaggattttcctcataaacctgggtgttttattcttgtgggccagaaagttatttcattcctaaacccgtgatgtagacttctcagaaattccagtggtgtggaggatccagcttctatcagctcacaagagctgattgcacatatctctccccaactgctgttcagtggcatcaagttggtagcttgaaatctgccatgatgagagtatttacactatagaaattggcaaatatggcaaataagggtccccaccacccatgcttgtgaaacatcttccagcacaccaaggaaattatcctaacacgtaacatcacttatgggggctgtttagcttcaggggaggaaatcccctttgctctgatctcattgtgtgtacctgctttgcataggcagactaccccttgttctctcatctattaaactcgacctgagagagagcttcatgagatgggttgtgtgacaggagatcactagggtaatgagtctgttcctttcgctgctcagctatatgacaggttattttacctctctaggcctcagcttcctcttcactataataaaagtaatttagatcattaaataattgctaagtttccttgtagcttcgacattctgcaatttgatgagtgcttggctgctggaaaatgtcatgtgtttcaaaggcttggggcacatgcacatcattcacagtgaccagctgagctctctcattttctttctggatcttggactcccagtaattctacttttatctggacttctatcttcagcatgaatgagcagggtgcctctaagtgagaagcataattgattagttccttccatctgggggtgtcaaagcactttcaagtcagtagtcagtatccatcatggttgctctgcagggaagactgcctgagagtgcctgttttgcaagggacatatcacagtggtggaccaaggacccagaattattgacttgtcttttaatcagaaaaggggctacttcctggtcttaaagaagttccagctttgagattaatctgctgtctataaccccagatcacttggcatgctcggcctggctgacctgctgacagaacttgatatatttcccatctctctgacatggagataaacctgaataggattttgctagttcagaggatttggggatacatgtttaggtaaagttttcctataaaattccttaaaagaggtgtggtgtgggtttttgttgggaattgaggctacacttaatggaatgtggaagagaccaaatccacctttatggggtgcctggatggaaaaggtgtactgataggaagttgggactgaccacagacttgggctgctttgtgattttgcttacagtcttgccaagacctagcatctgccaaaatacgtgtctctgggccctctctaccgaaatgtacacattgacatgcaccaactcatgccgctgttgttatgattgtgtttatgaagccatttactcttgaatcaagaacctgagtgacttgctgagtgtttgtaggtttattgtccactctgccagctgactgggctgtgtgtgttcaatggctgaagccatgattcccacagctgaaggtttggtccattgagtctgccaccataaagcacaagctatgtgaagggctggaaaagaaataaattcttctgggattaactccaaagcagaagtacagttctgtcttgcacagataatagaggctgggttcaaacttcttggggtcagactgccagctgtgacccacattggaggtctaccatcttttcttgttggaatacttcctaagaatatattttttaaaaaatcaagcaccccttgtgtattttacatttgatatctgaattttctaatcgtaagttgaattcatcacaaaagtatattttccagcacattgtgtattctcacagctcaaagtctgatgcacgggtcagcaacatcagcatcccctggcagcttgttagaaatgcagaatcttgggtctctctccagccccactaaatcagaataagcattttaataagattcccaggtgattcacatgcacatttaagtctgaggagcactggtgtatatcatatacatgctttaagtatatcttcattaaaacctttcaatttatgaaaaaattattagatcagggtacgtgacctaactgcaaagtcatttcttattgtcaaaccatcagccaagccagattaacttttagtcagtataaagaaaggggtttcttcattgattcaggtgaatgtgttaacatgtgtacttggccaatcttcatccttctgagttctggttttaggataagtaggcagctggctggccagatagatatataaggcacaaagctgtgctatgaatttgttgcctgaataaaatatggcactgtggccttcaaatttttttgaaatgttctttctttgccctgggaattttccttctaaagtgatgctgactcaaatgatacctcggtttggggctggggagatttttactccttaggaaaatgcatcctcataagattgagaataggtgggcaatttccctttctttattaaaggaggaggaaggcagctgtgaaaaagggaatatggagaagcagagctgccacagagatggcaggtcagctttgggaggcatgcatatggaagcagaaaatatggaaactgaatctcttaaagctatccatatacctacatactgccagaaagtctctggggaccccagtggtaggtgagcccaagtttaagaaagttgagttggagaatcaattaatgcccttttggaacttcctggtttccagcctttttatctccttgaatgcacatgtctctctctctctctctttctctctctgtgtgtgtgtgtttataaataagagtcattaagccccaattcaccacaaccaaagcttttgcctgttccctcatctcctcttgaattccaactgcaattaaatttatcaaatatttatttaatccaactgcgcatcaggcactacaccaggcattggtgatgttgagatgaccaatggagacaacaatagtcattgttgataacgaagacgcacacacttgtggaattctatagagattttcagaagaagggatggcaagcaacttccaatgttatccttggaaatcaactccttattaggggggaagttcctaaagaaaggataatgaagtctgctaaagaaaagatgcatctgcctgtgtgtactgggggatgtgtgtgtgtgtgtgtgtgtgtgtgtgtgtgtgcacacgtgcgcgcgcgctatacagatcaaaccattgcagacctgcaatgttttccaagtgctttaatgtttaattctctttgatttgatccacggcgtcatcaagtattcctgcgggcaattccaaggtgtctgaggacccttgctgggtatcaaaatccagtaagacctttggagaaattgaagaaggggaactttattggtttttaggccagtcttataatttaattctgttttttgtctgaaacacacatgcacggaatcttttatcgtctgttaggcatgtgtcctaccaatcacaagacttaagatgagaaaaataagcaaatgtttgatggagagaaaacagccgttggaatcctgtggctgttcccacactggggggatcaggcaaacccaggatccatgcattagaaaagaatggtgcagagagagctattgtcccctttgagctgtggcccatagtaaattgttgactctgatcctagggtcaggttattgctgagttgctgttagcattaataattatataatggccttcccatttttctaccccatgtggatcattttgggtgtttgtggtgagaatgttctctaggtggcatcacggaacttctcaccagtgctgtttgggggacccttgggcccagtctcctccttccatgcctgacattgcagcttgacctacagcacttgctgccttttccccctcactgtaaccactttggttaacttggctgaaggctgcaagcctcatgaaagaggttcatggctatgaacacccaaaatgatctcagattcagattatgcacatatttttccttccttccttccttccttccttccttccttccttcctttcctccatccctccctccctccctgccttccttccttctttctccttccttcccttcttccttcccttctttccctcccctccctcccttccttccttgcttccttccttccttccctccctccctccctcccctctttctttttctttctttctttctttctttctttctttctttctttctttctttctttctttcctttctttctttctttttcttctctttctttctttctttttcttctttctttctttccttctttctttcttttttctttctttctcctttctttctccttccttccttccttcctttctttctctctctctctttctttccttatttattgggtgctaaacatttatagcgtaaaatgtttattttaaaaaacatttaaaaataacagctttattaagatatagttcacccatttaaagcgtacagtttagtggtttttagtgtattcacacagttgtgtagccattactacatccatttgtagtcactccccatttactcctccccgcagcctctgacaaccaccgatgtactttttgttttcaaagatttgcctattctggacatttcatataaatgcagtcacacaatatgtgatccttggtgtctgacttctttcccttagcatgatgttttcaaggttcatttatgttgtagcatgtatcagtatttcattcctttttatggattaaatacattccattctatggatatactacattttatttgtccatttattcattgatggacatttgagctgttcccacctttttgctattatgaatagtgatgctatgaatatttgtgtgcaagtctttgtgtggacatatgttctcatttcttctcttatatacctaaggagtggaatttctgggtcatatgataactccatgtttaacccttggaggaatagattatgcatttttgacttgttattgtcccatgaggtctgaagttaggaaaggtagggagaataacttcttatggggtagacatcaatggatctcagcagtgcccaggctggcagtgccatttttatgagtgtaacaagtttatcttcttcagccctttgaggcctcattttccagagactactggccctcctgggtctgtgaccctggccagaactaggattttttatttttaacctctcataagggattcctacgaaatatgacccactagagtgcttggtggactgtcaactctgtatctgtggggaacaaaatccagctgttcagcttggttagctgctgtctcatctggaactgcctttcctaggtttatttccccaaacaatggcccaagttgtaggcttgtggttgccagccccctttaatttggtccttagttgcatagtctgttatttgtgctgtgactggctgtgattgaaggggtatgctttttcctaaactcaacagtgtagtaagatgcttggtggactccaataattcatctatcccatggagaatgtgaggagtgtgtgtagtgatggtgaggggcatggcacactgaggggaaagtacctttaaaacagaatactgaatttaatatcagatcaggctgatgttaaacctctgctttccatatgagaacactttcccaggggatttaattgtaaaatgacaaaagggtcttagtgcaatttcactgacaaatggccttctggtgtggatttccatgacgcaagcagagccaactaagagcttcgtcacttatgttcctggagcacatagaacaattttctcccattttgttgaacttacttgaacttggggtagaatacctccctggacttatactaccagcaggtttaggctcccagtttcatttatgtgtcttcatcccatgtatagcagtggctcccaccattggcaaagactgaacttgaaatgccttgctctggaattcaagaccatccgtgatttagagtatagtggataaggatgacagctatgaagctacactacccagggggtaaacacagctttgtgtgaccctggacaaacaatttaacttttctaatctgtggaatagaaataagaatactacctacctcatgtggttgttgggaggattaaataggttgacaaatgtaatatattagaaaggtgcttagtcagtgcttagctgtgtttgttgttattcttatcctatgttctgtccactcatggctgttggccctgctcagataccatctcttctatgaagctgtgcctgagtgtgtcttccttactgctttgtacacagtaccaaacatagtgcctagcatgtaatagatactcaataaatatttgttgaatgaacaatgaatgaatatttgttgaatgaatgcattttcccacttgggagcaatccactcttcctctatgcttttatatcactttgcctctacctcgttttatggagttttctacatttaacctttattttagctaattatgctttagatgcaaccccttctccagaaggtcagcccttggataatagtgcctgggtcaattgttttggtatttcctgttaggacttgcatggagggcaataaatatttggtaaataattcatcccctttggaaacaatgttcttaaaccattaaattgctaggtgttttttttttttaattaaccgaacacaaacacagagacatatgcatgcagagacagtatccctctaacaatttcatgacatgttgccttcttttttgttttcctaaaggaagtgataaaggtaaaagttgaagaggtgggcgacagtgggagccagagactcaaaataaataaaaatgtgagttcagttcaaagaacaggttgatattaaagttttattggagttcaacaatttcagaaaatacataggtttcattcttctttgaattccttcaaatgttatttttgctcccccttttttttttgagacggagtctcgctctgttgcccaggctggagttcagtggcgcaatctcggctcactgcaagctctccctcccaggttcacgccattctcctgcctcagcctcccgagtagctgggactacaggcgcccgccaccacgcccggctacttttttttttttttttttttttttttgtatttttagtagagacggggtttcaccatgttagccaggatggtcttgatctcctgacattgtgatctgcccacctcggcctcccatagtgctcccccttttaaataaaagctcacaaagccccttggttgtctgaaaaataatggaatatttgacttgagttctgggattggaagctagtcactgttgctgtgcttctttggttcatagctggaaatgctgtggttgtctagtggggagctgggcctgcctattctagggcatggctggttagagagaatgagaagtcacttggctggtggtccaacagatcagagcagagttagtccacacacaggccaggctccttcctggatgcctagaggaaaggtggcaggtcaaagggagatggatgccaactggcacctgaaaggatccctgcacttggtttaggatcagataacatttgaccaaactggaaagtagagaagtaagttttactgaactctttcacacatattctaggggaagaagctgtgtgcctgaaaaacaggaatatggagtggttcaaggtgatttttcttcactttgacctttgaatttatggattatatgtaccctgaagttttggtaaattggtgcagttttaaaaaatgtatattatccacgataaactaacttctacaacatccccaaacctcagtgacttaacccaataagtgttatttcccactcataccaatgtgggctagcagcgggtggagaagggtgctaggctacatatggtcactcaagaacccaggcttcttccatcttgtggcttcattctctctcgggccttggagtcctccactggatgtcgaattcagccagcagcccaaggatgagagcaagtgagtgtaggggagtgcaaaggcagtttttatgggctttgcctggaaatggcatttatcacttccatccacattccacttggcagccttaggccacacctagtcacagggagtttggaagctgtggtctagcagtgtgtccagaggaaaggcaaatggtttggtggaaaactagtcaatctctgccagaaaaactcaactggaaacttcccctctcagttggcgtaaggagaaacagaatattttactgtagtttagaaaatgcttgattcaaaaattgctaccaatgtgtcctggggaaagacccagtgctgaagacaccaagcacattcattcattcaaacaatttttttttttttttttttttggacagagtcttgctctgtcacccaggctggagtgcagtggcgcgatcttggttcactgcaagctccgcctcccgggttcacgccattcttctgcctcagcctcctgggtagctgggactacaggtgcccaccaccacgcccagctaattttttgtatttttagtagagacggggtttcactgtgttaaccaggatggtctcaatctcctgatctcgtgatccacctgccttggcctcccaaagtgctgggattatagccgtgagccaccacgcccggcctcaaacaattttttattaagcacctactctggcccaggcattaggttgggtgtgagggccttgatggcaagcaatacccagaagcagctcctgccttcttggagctggcatctgttggaagccaggcaattgaatgaacaaattccatatactatgagggcaatgtgaggaaaactaggggtgttatggaagctcatagctggagccctgggccaggctgggagagccagagaagcttctagaaagaagtgacatttccactgacacccaaaaggaggcatatgaagagttcatcagctgaaggaaggcagggcagtggatatgtgccaggcagagggaaaagctcagtggttttcggccttgactgtactttggagccacatgaggtagactgggccaattaactcagaatcttgggtggggtgagggatggcagagtaggtccagatatcagttttgtttggttttaaaagaaactttccaggtgatcctgatgtgcaaccagggtcaagagtcattagaatggcaggctcaaagagaggccaggaggagtaaagcacctagctgttatgtgagagactgaaggctttccaggttgctgaaggcatcccaaagtgagatgtggcatgggatgggtggggagcagggcaaaagggggaaaatggttcattgaggagaagccacttcccaggcactctttcctgtgtgtggagacagggatcctttttccccagagctccaagcctggtgggccttcacaagcagtgaggttctgcctgcgggctctaattatctcctcccctgcccttggtgatttggggagggaaagacaagcacaaggattgggaatgtgaaaacctgcctctccgtctgagttcttaagcagaaaagggccaaagggcaagccctgctccagagttgctgttgtttgtgtttcactggggttgggcaagttgcagcatcagaattgtcagcttatggttcagcaggctagtgagcggagttacaaagaatccagtgggatttatctggtcagcatggggtcctgcacataatggaggagtccactggctgttgtttctgcctcctcttgggcctatcagtctttgccaccatcaggagaaccgtggagaccctcaggtcccaggcctgcatactaaacaggcttgggtttggcaggactcatgctgccttccccaggccacattgttttgctcatgtgtttggaatcccctgaaatccttgctatcaaagatgcctgtgcccacctaagaggagttaccttaaaatgaaaagcaaacaactttgctcttatttagaaagcatgaaaccagtgccttaaccttatggttttatcattcaaactacagagttggaaaaagtgtgtgtttttttgttgttgttgtttgtttgtttgtttttaaaaaaaacttcaaaaagttggggctgggtgttgaattgaagtcagggttgtgtctctcagaaggttgtgacgttttgggggaaacaccccaaatatagaggatagcttgtttaagaataaaactgaaggaaaaacttagacccattcttaactatttttctcacaaaatccccaatcgttattgggtttttctcagagatttaaagaaaagccctccctttatctgagctctgtcgtctcatgggggcctcttgggcatgcatttttctagacaccttggacacttggtgtggaaacaaatgtttggaaatgatctatatctggatgctttcctcataaatatatatggatatatagaaactactttaaaaataaaattttagtgattatttctgtgtcatatactgcagccattttgccgggagattcttgataaatatttaggctaaaaaaaaaaaaaaaagaaagaaatcaagccacctctccccttggtggtttcctgctgcaggggaccagctgtggcaatatggagcctgacttgtatcttttcagatatgtgagtgtaatatccagctgaatgcctgggtttccatcaccacacaggaaaaaaaatctgctggaatccaagaagtccaggagagtcaccttgggttctgtgccagaaacaacctctcttacctcaaagttctcccatttgacagctggggaaacagaagacctgagactccaagtgccttttccaaagttatgcaactagttagtgacaaagctaggaccggaaacctggtctcttgatgctcggggaaagctcattacctcagcagagatggcaggtaggtttcctattgcatgccatcatcacttgatagtagctcaacactatgtggaagcactgtgttgagaaggatgctgcagcttgatattcacacacccggaaaacatgcggtgggccattagcttggtctgcctgaggtacaggtgagaggattcgttgcactttgtgtgtgtctccagctgttataccatgctgtgttttgattttttaagtaccataggttcaagagttcttgttgccctcccctcctggtgcaagcccaagcttctttaggatgacctgacagacacacatgcacacacacattgtagtccaaaagcaccaggaaaacctttcattgtttagaagaattagacgcctcacactaggaggttttgatgcgttcctcaactttgacacattgaggttacattgtctctctcttcttaccatttgttctccttccagtcacccatttctctggtaggcaggctcttcaggcaagggtcacaaagtgctgtaccttccctccttgggaaatggggcccagatccaggacaggaatgagatccctgggcctcttccagggaggcttcagtttccggtgtcatagtgatcaactccctggcatctttttagatcacaatttgggaagcagttgacattcgggttttcctcatcagccagtagcacttcctgtaagttttgattgaattgcctaaccacactaagcctcagttttcccatctgtaaaatagagatagtgatagtttccacatcacaggactgtcatgaggattcaataacacatataaagtactttgcaagtgtccaacaaatgttccctattatttttaagtcacagatacaagcccttgaggaagcatcagttgtgtatgctaattttgtgtgtgctgtgtgtgagcatttcaaagagagggagggagaggaagagcaaacgagcgagctagtggtctgtgcctaggatacatttcaaaacatcatgctgtatgtgataaatacgatttttatttttcaattaaaaataaattttttaaaagatgtagtgacacgtggagaattgccatcaggtatgcgggtttgtgtattgtttaggctggtgcatttgaaactttagtgcatatgtggatcatctagggatcttatttaaaatgcagattcagtagatctgggctcagggcctgggattctgcatttctcacaagctcccaggggatgccagttgtgttggtctgtgaaccccactttcagaagcaagagtttcaggggctgatgctgtcctttacatttggaataaccagaaacttcatggccccacggccagttagctggatcgctgtatccagcaactgatacctactgtagaaaaaatactgaagcacaactctgaagagccagatcctagtcctgagaggcagcgagtgagtcattttcctccctaggcctcggcagctttctcatctttaaaggaggtggggaaggtgctctgagaccttgctgttcccagagtggttctcggcccagcattattgggccaccacagatctcctgcaccctaaactgcatttgaacaagttccccaggagattcgcttgcacattagcattggaaaagcactggtctaagattcctttcagctagaagattctgtgaatctgaaaagttctaattctagctctggtgacagaaatctacaaaaacaaatcactccaattataaaatggggatgtcttcagcaagaaatagttctccaacactctccttggtgatatacagagatggccaaactaacgaaatttaatctgaaccagcatttgcctgaatttggttgggaggggagagtgttgaggatcctgatagaaattggaaatgaggcactggataccatatttagattctgtggcttctctagacccagggaaggtgttatggatagtgttggggaagcacgttgtctggagtaatgcccttcaccatcactgacacctctctagggacctcagtgaatttcagcatgatctccccatctttccagagaagtcccagacctagcatcagttcctccatcttccttcaaaattggtgcacattgacagaatggggagaaagatagcaggggtggggggtggggcatgtgcccataggtctacatcctaaggtcaccttctgctctttgaaggggattgaggcaaagagtgaaaaatttgtgttctgttgaatccaaaaggaagaagcaaaattgtcccaagacttctgttccatggaggaatttttttaactataaaaatatcatatatatatgaaaaagagaatgctataagaaacaccaccaagattaagaaataaactattacaaagaaaactgtgattgtagatttcttcctaatagcatcaccttcttcaaccacaccctgaaatttggtgttagtaactcccagccatgtcctcatattttaatatatatttatatattcctaagcagcatttggtattattgtgcatgttctaaaatttgtagaccttgttttgtactgtttgtatctttctgcagcttgttgtttttgctcaacgttatgtatggagatttattcatattgttacttgtagctcccattgattcctttttaattgctatatagagttcattatatgaaactacttcagtttatctattctcctattgatagacacttcagatgcttctagtttttcttcctccaaacaatgctagaatgaacatacattgcttttgtgtgtatatgtgtgagcttttcacagagtgtgttgtgacccattcatagatcatgaacttgaacaaatgggttgcaaatagtattttagaaaatgacatagaatcaacggctttggaaaatgtcagaatatgttgcacatggtaagagtagttactgtttcattaaacttgtctcaatgacaaagtaagaaaatttactttgacacccagttaaaatggaaacgaggccaggcgtggtggctcacacctgtaatcccagcactttgggaggctgaggcaggtggattgtttgaggtcaggagttcgagaccagcctggccaacgtggtgaaacccccgtctctactaaaaatacaataattagctggcttggtggcccatgcctgtaatcccagctactcagaggccaaggtgggagaattgcttgaacccaggaggcagaggttgcagcaagccgagattgtgcctgtgtactccagcctaggcaaccaagcaagactcagtcttaaaaaaaaaaaaaaaaaaaaaaaaaaaggaaaccagtttaatgatacagtaaccagtaactactttcaccatatgggtcacagtcaacaaatgtgaaagttccagggtgggagatacacctaaagatggactcactgggttgaaggccatgtatgtctttggctttgtgggagattgccaaattgctctttcaagtgtaccagttcacaagtctgggagattttacatcacaaagtccaaagaaaagaaatggacctcaaggacagatggaagccagagattgagtgagaagaaaataaagcttaaaattgccaccttgcttgctcttcttgtatgcctcttcaccctaagtaaacattatgggttttcatgaccttgtaaatttgcttttaatcttaaaaaagaaaaaagtttggaagtttggaaggaaattccttgttttcctgtctctctggcctcagttcaggaaggggcgaactggaaggaggtcagaaataagcaacccctttcctttttggaatccattaataacaagtttgaggtgagctgtggctaacctttgctctctagctgccgtttgcagtttttcaaagttagacaaagatttctctggatcagagtcaatggtgccattgttgctgtttgttttaaaattaagcagggatttggggagcccaaggagctatcctcccataggtcatctctctgggggactgggtcagtttctgttctggttccaaaccctcccaggaaggccaggctctcagtgactgcccctcacccaccactcccagctgtgaactgtgttctgtctgacttataccctattttcctggaaatgtgtattcttttccactctgcattgcacaagtaagacctagtgatataaagatggcagacgttggggaagagggagctcccgagtcctcagcctggcccctcctccgtgctggtcctggtgctctgcacctaccatccgtaatctcaattcatcctcgcaatacccttttctatagatgagaagactgaggctcagagaggttggatgacttccccaggtcagtcatccagtaagatgtaactcctaatctttatagagtactttctacatgccaggcattattctaagcaccttacacgattctctttaaatcctcatctcattccaataagagtaggtgtcattattatctcaattatatagatgaaactgagatactgagagggtgagaatgttactgaattgtggcttgagtagtcatctaatattttggcgcttgacactttctattttctgaatgtcagtaattagtgacttggttttcctgccctgtactgtatcatgggtaatgccccttcccaccttcccatctccctcctttcctccttccagtttttccttccttccttccttccttcgttccttccttccagcatttaccaataggcaagggaggtgttctctgtcccatgggaacctgagacaagcatgaacagcacaggggaagaagtgtggtcacaatgacagtgaccatatgtagttaagggccaaaatgagtgaatggcgcagagatcagaaaaggaggagctgggtgagccttgcaggaagtcttatggatttcaccagtgaatttctactcacttaagccagtggttcttaaacttgaatgagcgtcggaatcacctggaggacttgtttaaacaagatgtttgggctcaccacccctgtccccaagtttctgatttagtaggtctggagggaggcctgagaatttgcattagtaataagcttctgctgctgctatttcaggaacaacacttggaaaatcactgacataaacaataagtaagattttgtaagtggcaagataaaggaaatgagtgtgatctgtgtattagtcaggataggttaactgtcataacaaataaatgctaaagtctttgtggtgtagcacagtaatatttgatctcttgctcatgttacagtccagtgtgggttgatagaagagtgctctgctccatgcagtcattctaaggaccaaactccttctaccattgactctgccacaccccagtgccaaagagccctgaattgagccagcagatgacagaggaaaatatggcagatttggcaggtttttatgggtcagacctaaaggagaaacacatcacttctgcccacttgccgttggctggaactcagttacacacctctacttaactgcaagaaagtctgggaaatgtgtcccagccacgaggttccacatggaacttggtttgactagagaggagcattcaacattcacgttgagagaataaatggatgtttcatgttcttccaaggaaatttgcatcagacaattcgggtcattatttagcataattatagcatagattagagtagggggcaaatcaccagatttaggcccagatgctctttattcgaaagcaaaatagctgactgtaaagttacataacttctcagtacctgtttatttatttctctataaaaactgggataagatatatgtgaaaatcactagcctggtgctaagcacataaaaacagagtagttattcccgtgttttctgcattcagatggacagacagtgacaagctattgtggccctgagagccccttcatgtggacagctgtgggattcacagtttaaaggacatgggcacaacctgatctcagcagttgcatggctattctaaagactgctacactgatgtctcagatgtaccataggaaatcaggccatgccagcaaggcccaagggaacgcataggcctcagaccacaggattcattaagtacttggtttctggagtcatactccctagaatcaacactattacccagctagatgactttggcctttggacctcagttttctcatgtgtaagaaaacatgaatcatattactatgttatagagttgttgtgacaacagaatgagaaaaagccagcgactatatactgagaaatattttcgtaaatttcctagcctcctgtggtattctaccatgtctttctcttggcatggttagctgaggccaatatagatagaggttctttgagcgtgtaaacatgctattctctgtttggtcttaggacggccacctggtgctttccagagccctgtcctctccccatagcttgactgtccatgaatgattctgggtcccctgagctgtccatggacatgaaagcagtctgagggaggaggtggtgaggaatactctgagctctttcttaaggctgcacctacatgcttgattagtggcccaccactgagtgagcccagcagtggagatgagtctcctgggctccttgatggcagtagcaataccgctaaggttccccacctccccattgcaaatttccttcattccatcttgtaatttgctcccttgaggtctgggccctttaaaagcctttccctctgccttgttcaaatggtgcaattgtgggtgattgaaaccacatttttatacgtgtcgaaatcagttcagcccttagaaagaaatcttaatataaattggatcatatatcctaagtggatgccaccagctaattcgtttgttagacatttcagctacatgggattaagtgagtgtttactcttaagcagttacatgtgggcttcattaatacacacactctggcatggcttgtgcctaatatcttgtcaaataagggagtgtatagaagtaagggagcccttacttccccagtggaatcagcctctcttagctaccagggtgggactgagggaggtgactggctctctctgacttggtgttccagaaacttggtgtcttgcacttccattagcttctctgtaaagcagaggagggcaaaatgagagcccacacatatgcattagtacaaaggggacatggatctggaaactcattgtgtgcaagcaggcacaaggggctagaaaaatatctattttggaaaatgtttctgcccctaattgaaattaggcttcctgcagctcctgacaggctgtggtccatacccttactaggccaggttgggtcagggaccaacagcaccacattcttgagtcccaccctagaccaactgaaacagaatctaattttaatgtccagtgtatgtgcattaaagtttaagaagtgcttctctaagccatttattctcaaacttagctgcacgttggatataactggagggtttattaaaatgctggtgcctgagtcccattccagacattcagaagtaattggtatagactgtgcctgagcatcacattgggatgtctaaaagctccttaggtgattctaatatacagccaaagttggggagcactactgtcactggctgtgcctcaagtttccccccatattttagtgcattgcaatgcctggtttgtagttggctgggaggatttggggaggcaaccctgggaatttacccagcacaccacaggcacccagaggcctctcttccttcctgccttcaccacatttccttctgtccttcctgacttcccatttgtctacttcctgaagagtttctttggcccaatatgtgagagtgttgggaaatggtgctgagaagggttctggaagtcttatgcatttttttttttccatccagaactgtcttgttggctttgtgtttttgcaatgttgtagcaagagcatcatttacttatgatggcttttatttcacccccagtttatactattttttttggtactaccagccagtgagcactgaaatgtgggggaaaatgagtttggaaatgcttccttcctggtgcgtgtgctgggatgcagacttgtatctgaaattttggatatgtgctatcggctggttgtggtgtagatcagagccccaaagggcacatcgagcatttcatttggccaccagattgtcttttacaacagaggaggtaaggtattttaaacaggatctgtgttaggctgggaagcccacacaagatgggaaagactcatttctcctaggtccttccccctaagtacaactagaaaccctggaaataaagcaaaaaaataaataatgctaatagtatctacttgccccaagggtaaatgctgccctaacttctgacatcatagtgttatcttgcctctttttgtgttttaggtaaatggaatcatttagtttgtgctaaatgattttttgtgtgtctggctttttccattcagtgttatgtttttgagattcacccatgttgttgtgtgtagctgcagattgttctagggaagaattttgaccaaacattgatcttggactcttggcagagttaagacttgagtaaaactgaatcttgtggcagtttttactttttctcttagtatagaagcataaaacctattaaatgaacagaattttaaaaataaagatcattgttctttaacaaacaattgctgtctttgcattttctctttcctccaaaatcgctgaggtctcgacttactcactgctaaaaaaaaaaaaggggggggggactctgtatatttttaaatgaagagtgctgtttttacctaaatcaatctggcctggtatatgacaacatttaaaaaaaaaaaaaaaacaacaactcaaagatagagcctaaaaacttgccgaccaagcaagtaattacgctgaacccccttgggcccccttggatactctctaattagatgtcctgggtcctcccaattcttagtcttttaatatctgtttttcctcttctcatatttggaccttatgtcttccgtttagtttctcaattcatccaaaaccgtatccaggccatcatcaatgattctatatgacaaatgctccttctaacaaccccacgatatcaccccttaccacaaaatcttccttcagcttaatctctcccactctaggttcccacgccgccccaatcctgctcaaagcagccctgagaaacatcgcccattatctctccataccaccccccaaaatttttgctgccccaacacttcaacactattttgttttatttttcttattaatataagaagacaggaatgtcaggcctctgagcccaagctcagccatcatatcccctgtgacccgcacgtatacatccagatggcctgaagtaactgaagaatcacaacagaagtgaaaatggtttgttcctgccttaactgatgacattaccttgtgaaattccttctcctggctcatcctggctcaaaagctcccctactgagcaccttgtgacccccgcccctgcccgccagtgaacaaccccctttgactaattttcctttacctatccaaatcctataaaatggccccacccctatctcctttcgctaactctcttttcagactcagcccacctgcacccaggtgaaataaacagcctttttgcccaaaaaaaaaaaaaaatcaataaaataaaactaataacaataatctccaactctgtcacccagagaaaatcactgttaatattttggtgtatatccttcgggttttgttctgtacatgttttaataaaagtggcttatagtctacatattgctttgtaaattgatttttttcacttattagagcaagaatatatttctgtgtcaccaaatattcttttacaacatcccctttaattattgcagagtttcttttttggataacaaaattaggcttaatatatcttaaacttcttttttttgcatgaactttatgagttgcttcagctttcactgtcataaaaatgcaatcagtaagtaacattgccaactctttaattttggcctaaatggcgcatttgactgcacctggcttgtgggtgccaattggtgtttgctgggtggtgagaagctgggtaagatagttgtcaagataggtctccatgtgtttctgaaatgaaggccaatattaattgtctactgtcttgatttctgcttattttcagaaagccaggagctaaggggtgatgtttcactgacttacctttagggtagggattatgaattttctctttcccatctgccccaaaatcaaattgtgtctgctaggcattaggatcacaagattctaactctgaaagcacttctttttaattttacgaaataattcaattctgttaactagcacctgtgagcgttggttgattttttttttcccccctctttttaccacaagaaattaagtgggaattagatatctaattattatgcagttttctaactgagggcgaaagggacaggtggacattgtagtttttattagtgatgctattggagtgtttataaaacacagaactgttttggaaaacttcaaagtattttaagccaataagctcactaatgatgaggaaaaggaaataaaatttcattgtttttatatacatgcaatggccaaagtccaagtaattttggctaatatcaacatttgctggctagcactttgaaaacaaatagacacagtattagcaagattttgagtcaacaataaaaatttggactttggccacacacacacacacacgcacacacacacgcacacacacacacacacacacacacacacacacagaggattttctggttctttcttctttaattgtaaaacaagaagaaataactagatctgaaattcttttgagatctaaagaagtataactatttttgcttagaaagacctttccttatttcatacgatatgttactggccatcctgggatttcagagtcttttagctccatcgctgttccattcccaagtcccctccttgttgaactgatctgtaagattgggttttgagttgcttccttctgacccttttatgtatagcagtatattttcatcccatggtaacctcctgggtgaaatgttggagacagatatattacaggatatttgtaattatactagaagatgttttagtgggaaagttccttacttatgatcacagcatctctgaaaactttcactgctgtctagaaaaaaaatctttagagttgtcaaatatattccctttagagccaaggacatcttgatactacctaatgccacttccctatttctctctagcttggagatctgggacatttcatagatgtcatggaattctaaaagtcaacagaatttgtaagatgatactctgggatgatttgattttgtacctagtatttgctctaatgagaattcgagtaatccaactgcctttctcctttcatgaatgcccactgtggctgggggcccatgaatcaggtctcccatcaggaattatggccatttggtgacttccagctcacatagtgccatctcagaatgagtgaacccggtgtgcactcagggagggagacatttgagttctccagacctacttaaggcaaatatgttccttatgaatgaggttcctctccttgttttacacttcctttactttgatctcttgcctctggtttttaatgagcaggagctttgtaggaaggtgaggagaatttttgtcatctatagcctgagcagaggggagttgaaggtgaatatgtgtgggcatatacacacacatgtatgtaagtatatgtgcatatatatgtgtgcatctgtgagcatgtggttgtatgtgcacactgcacgtttgctggtctaggcattaagggtattgtctagatgataataataataatatctaatctttatgaagtaccatgtttcaggcagtgctctaagcatttaatgcctacaatatctatggcagcaggtactgtcgttgtctccatttttcagatgaggaaactgaggcacagaggtatgaagaaatttacctgaggtcacacagctagaaaatgagaaagctaggcttcagacccaggttggctgtttccagctcctaacttgcccactcaactgaaagggaagtccctatgggacgcaagacctcccccatcttgctccagataaagctgaatcttgttataattcagctcattgccccatggcagtgggtctgatgtcctacagagcagaactagaagtggattttggatacctgagaacctagagctgtagtgttcgtgcattagggtcagaagacctgagtgtagcatgttgatgtgtttggggacctgtcatcctatctaaggctgcatttctgataggaaagagaaaggtggcatatcagttacgtgaagttcaaaaccaagcaaagtcctcctctgagatacaggtcagaagagtgattatcttgggagaggcctgaagaagtttgctggagcactgggaatattccatatttggacctgaatgaccttaacatggctgtgtacttaagttttatgcactttactgtatgtaagtgatatctcaattaaaaagtacataaaaatggaggcatttaaattgacttgtgccactattgtagaagcagtgtgagggatgccaggggagaggaatagatatatttgatgcagatttaaaggaaaaatcagtcaggtgtttagagatgtagatagctcttaatctgtaagaaccagaagtgatttccaggaagacataattgcttatatccggaagacaataattttattgctcttaatttcatctttattttttttatttgtattttggcttctaatccccctgagcatttgtgtgtttgccctgccttcatttgattctggctctgccttttaaaacagttgctgctgccacctctcccaagttctgaaagatttacaaatgtttgaacagagaaacaaagacagaaaatgggagacatgctctggtttgctgcaaatggcttttcctgccaagctgcggggaatggtatttgggccagctttgccttcctaattggaaccatagctccttggattgccttcagattgaaaacttgagggtctgccactctgcaaggaccatttcatgctgggacactacgtaccaggattctcactttcattggcctttaagagagaacagcagagttccctaatcagtttggctaacacttgaaaggggagtagcaaacttctaattttttgtaggttttatacttctctgctactctcttcatgcccctctcccccagagctgtaataataataccagctaacgtttattgatagcttactctgtgcctgatgtcactctaagcattttgcatgtgttaattcatttaatcctcaccaactctggaagctggtattgctgttgctcaatatagatgaagaaattaggcacagagagatgaagtcagtggtccaagatcacacagctggttaagtgacagagccagcatttgaacacagtctcgttccagagtctgagctcttattcactgtctaaataaaattgattccctgggccgggcgtggtggctcacgcctgtaataatagcactttgggaggccgaggcaggtggatcacctgaggtcaggagttcgagacgagcctggccaacatggcaaaaccctgtctctactaaaaatacaaaaataagctgggcatggtggcgcatgcttgtaatctcaggtacttgggaggctgaggcaggagaatcgcttgaacctgggaggcagaggttgcagtgagccaggatcatgccactgcactccagcctgggcaacaagagagaaactccgtctaaaaaacaaaacaagaaaaaaaacttgatttcctggtgaggtgatctccacagctgtctttatacaagctagacccgccccattcagccgctagcaaaagatggctattaagtacttgaaatggggctagttgggagtgagatgtgatgtgctgtatgtgtaaaatacgcatttggtttcaaatagtacaacaaaaagaatgtacaatatttcttaataagtttttatattgattacatgttgaaaaatattttggatatattaggttaaatgtaataaattattaattttacctgtttctttttagttttcttaatgtggctactagaaaagctaacattacatgtgcgactcatattgtatttctgtttgtttctagtgctgagctagaccttccttccaatctgctccaaatacagtaaaattttgttctagcatagtcatgggtaaaatggacttgggagtaacataccacatattaaattcctattttccaccaccatcaccttgctgaccatttacaatttgacagttttttatatatgagggaaaaaatccaaacctttaatgaatgcgtgtcatgcaccaattatagtaccacgtcctttcacataattaattgcatttaatctttgtgacttttctattaggtccgtatcatcagctccattttacaaacagggaaattgaggtttagtttagcaacttgtctagatttctattactaataagggggaagagcaaggtttagatataggtcagctgactccagttctaatagcaattctccccccaaatggtctatctcttatagtatgtatctcattctgcattgtgtttgagatagttctgcatgctttaccctcttatatttgttaaatccttatgaaaaggtagtgtaacctataggagatcacagtcaatattcagtgaaccgaattgctttaacatatgttgtatgaaagacctaattctaatattctcctatggagtttggtatttgccccattattttcctcttaattgctgtggctagattactaaacccgcatccttaaattgctattttatgtctctatggcttcctgagtctttggagccctgttgatttatgtaattctttgatttaataaatatttattaagtatatactatgggacatttactgtgccaagccatgggaatccataggagaccaacaattcctgaagggtccttgccctcaaggaacttacggttaattgggaggtagatacatgtaaataggcaattgtgatgaacatggttcctgccttgatagcagtaggtgaaagggtttcgggggcacattgttgaagcacctcacccaatctagaggatatatgaaggcttctcaaaagaggggaaggaaatgcaaagtttcgtttccagtttagtgaaaataaaaatatgatttttttctctaacgccctgaattttattcatgaaattttgctatgtagataggaagtggaggctttacagagacaggaactaaaggataatctaaatctggggcctccccggtgaccctgcagtggggcctatggtctccagtgcagtactccaccattccctgggctcagtatctttctgtgttttttttttttgtttttgtttttgtttttgtttttccctgtaattaccctgagtcaaattctgggctttcctctgtactttctttcagctttgacttccaactgtaattgcatttttgcagtgtgtctcagttcacattctccaggagagcatgagagagagaggctgtctgatctagatcattttaaaaattattattttcaagccacatcattggctgcttaccaggcaatagttaggttgcccttgaatctggtgctcacccttggtccaatcaactatagcatgagaagggtcaggaacagttggcagaaaagaaaaaagctgccaaagtcactcttctatgtgcatgtcttttctgagctgtggtaggttgggcagtttatccagggatgtggcatggcaggccactgacctggaaagttcttttaatacctagagaaacaatataatggatgacaagtgagcaagttggaaaaatccacaagcctgtctctttaattgtaccaggggcggtccctggatcccttgctttgagattatttagctgtagttaaaccaggcttgtagtgccatgtcccagaacataatcttttcttcattgtcaggggctcagaatgttatttcaatatttagaaatttccctccccccaccaccaaaaattggctgttgacatacagtctcattgatataggtagctcactgagttccttttgagcagtctatccatgtggcttgtctctaggaccaggggacaaaggttgatcctaacctgaaatccacaccccccacccaaaggacctgtgcatagaaggcatggggttcaggaaaaaatgacatctttagtttcactaattttgaactggaatttagcatttccttccattacaaataaagacaaaaatcacagtagtgttagctgtacctgtaacttggtcactagcagaaatcatagacatttctgtatcatgttgtggttcctatagagatctcattattacctcaaaattatgatggtataagactcactactagatcttgttattcaatgcattgataaacaagcgcacattttactgtatgacaaatttgctgtttagtatttggataactttattttgatacaattgatttgctttataatcccatgtagtttaccttatacatttaaaataactgttctgacaaggggtccattggcttcaccagctttccaaaggggccaacacacagcaaaggtttggaacccctgctcaaggatgtaatcctttgatgaacaaactcatcatggaggtcactgctcactctaggagttcctactgatatgtatcagtctgagagagggaaatcctgaagctgaaatcttacagtgatcctggggaggatgattcaggtgatttgtagtcaagagacaaagctatgcaagtagaacagtaacttaaagaagatggcagcagggggcctttaattaaagccatcctgatgcacccacacccatggtatgtctatgtctatgagtgtgctccacagagtgcatatcttcttgtctgattgttaatcagccccacatgtttgtattgttattgaatgatatgagtccttaagttgatgcttccctttcctggattagaaggaagtagagcaggcaaattttgtataggagcccaactctgagtctttggagccctgttgatttataggctatttgatagcattgaagctcattggttaaccagtcctttcccactagaaagccaagtaaaggaagatgctgggtagatgggatgaaggaataaactcagggcagaagagaccacagaaaacatgggctacagcaagtcaagaactcctcatggacaccatctggtcagtggtcctagtcactggcaatcccaggtggacattcacataggctacttctgaggttctcccggtacctgactcagagctactgactccctttctattctagtcacaagcaatccattcgctcattctgctagtggagatttacaagctcagttcagcagctgaatgttggctagaaggccacttggtgaaaagaactcaagtttggaataaggaaaccgaagttctaacttttactgttctagtgacagctctgtgatcttgcgggagtcatattgtctctgtccacttcagtttattcatctgttaaatgagttcagtattaagttgccttctagaattcctgtgagcatcaaagggtatgaaaacacttgaagaagaacaaaattttatgagtgcacaagggaatatcgtaaggcatctacggactccatcataagagcttcatgtcaatttcttcttgctgtctttccatttggtgttcattgaagagaagggcctgagggactgagtttgtttctgtgcctagaataccgctaatggtcatctgtcaaattgcaataagagagtttaattttatgttcaatcagagcagggttcctgttggtttctacctcttagaggttgagctccaagcttaagcatgaggaatatgtgcagatttccttctttacatgggtttaatatggctatcccagagggtgccagaggggagagagggttataggtaatagtgaaaagtaaagtggaattgccctttaatttcccctctactacttttgtcaggggctggcatccccagcaactgtgagctggaatcccagggctttggaaggatcaaatgtagtttctcatacaaaaaaatactagaaatgttggtgttggaagaagagtttcacaagactaatagctacccctggttacctcccaatagctaagacagctcctcttcctccttctcctcctcctcatcatcatggtcattaacatcaccaccaccatttactatcaccaacatcatcaccattatcatgataacatattccatagctcattcctatgccagagaactgtgccaggtgttatgtacatagtctcatttagctccaacaaccatactcaattgaacataggcaactgaggcttagagaagccaagtggcttgactaaggacacagctggtcaagtggtagaactggaaattgagcaggtctgcttgaacccaaagcgcatgccctcaactagcatactacatatagtctctttggcacttgataaacctgtgacgaacacacgagcaaatggataaaagaataaataccagaggatggaaaaaaaggactagggttcacggtagtggatttactggagtgtcatttgttctatcattgtctcctcactttccatcccaaatattattaaaccctgttgtcctgttcttgtaaatctcaactcagagttgagctgcttttgcttgatgtggcagttgaacccctccctaaatgccaccatgttgctactacagggctcttgaaccatggactgcaaggtggtgtgtaatttgtagctaaggcaggcaaaatggagttcttcacaaaatttcctggagatatttgcaggcaagcagccccttcctgagaggaaggaatttagaatttacaaaggggctgtgaggtgcattttattacctgtcacctcagcctgccagataccagaagagacgctgtgtctttttgaagcagccaagctcatttgtagaaaaacgaatataatatgtttttttgcccatgaagaactcatgtatggagatctatgcatacagacataaatgtgtatacctctacacatcttggtttgtataaaatctaggcttctggcccctgggagatcttatgccaaattataaaatgaagtccatttgttcatctagaagagtctgggttattggtttataaaaatttgcccattgtgaggcctccgagccagtttaggtaaacagagatggcaaataattatctgcagatctgagatttcaaacaggacaagggagagaggaaagagagttgagctgctattttttaatccaaccttcctcaagttccatgttggggatcaataaactataaaaacaagaagaaaaagctgcagagaagagaaccagttgcagctggcagaagaaacctgctattgaaactggtaatgccattttaattaggctaaaacatgaatgagcgccgcgttaagaccttctccttggtgccctgggtcgctgggagagagaatgcactccctttgtgtgctttgccaaagcccaccagctgctaccttgcaggagagttacatctgagtcactggtttccaaaagggcgacaagtaggctatgtgtggctgaatgagaggggcctgtcttttcttgatcctgccagcttgggcctggactcaagccatcacagcaatggctctgatttgtaaatgggttggatgtttcaagaagctgctacaagagcggattgggagaggatgggaaaaccaaatagggtgaagaaagaaagctgtaggactcggctgggatttttgaggcccagaaggctgttttgtttatctcaaactccataagctgagatgtatcttgcccttgagggggtcagcttttaatgataatgatgatgaagatagtgttgataataataatgcaaacaaaaattaacagtgaacatttaacaacccctttctgtgtatcaagtgctgttttaagtttattatgtcaatgagctcagtcttgattctagccttgtgatggcagttatcctattatttccattttagagatgaggaaacagaagaacagagaggtcgtcttagtccatttgtgtttctataaaggataacctgagggtgggtaatttataaagagaagaggtttatttgactcacagtcctgtaggctgtgcaggaagcatagcaccagcatttgcttctggtgagcacctcggtaagcttctactcgtagtggaaggtgaagggagtcacctggcatcacatatcaagagaggaagaaagagagggggtggagggaggggccaggctctttttagccatcagttcctatgggaactaatagagtaagaactcactcctgggcaccaaagcatgcatgagggatccactctcacaacccaaacatctcccaccgggccccacctccaacattggagattaaatttcaacatgagctttggaggaaacaaatatccaaaccatagcagaggttaagtaacttaccccaaaatccatagccagcagaccaggatttagagctggagactgcgatattcaaggcagatctcagaaaaggacccagtgggcttaagatttaaagtatggagagcatcatatacagtgaagcctcagactctcagctttatgagggtagaaaccatgtatattatgttcattgtgggatccagcacagaatgtattccaggcctgacacagtccttgtgctctttcagtgcttgttgactcattgatttttgataaggcagagaaatgcacaaccaagacatgaaactttggtacataaatttaatgaacaaatgcctatatttatatttgttcttttatttaataaatattctattgagcctctactatgtgccaggtgttagaagtagaaaaatgaatacaatgtggtttttttgcccatgaagaactcatgtatggagatatatgcatacagcccaaccttttctctcaatttctctcacttgctgtctgggtctctcctaaggctcatcatgtgttacctggtgttaaagttttgtttttcatgtgtttgtgtgtgcatgcattctttttctttgtttgtttgtttgtttgtttcttgacagtgtcttgctctgtgtcccaggctggagtgcagtggcgagatctcggctcactgcagcctccgccccctggggttcaagtgattctcatgcctcagcctgctgagtagctgagaccacaggcgcacactaccacacctggctaatttttttatttttagtagagatgggatttcaccatgttggctaggctggtcttgaactcctgacctcaagtcatctacctgcctcggcctcccaaagtgctgggattacaggcgcgagagggagtctcactctgttgcccagtttggagagcagtggcttgatatcggctcactgcaacttctgcctcccgggttcaagcaattctcctgcctcagcttcccgagtagctgggattacaggtgcctgccaccatgcccagcttatttttatatttttattagagttggggtttcgccatgttagccaggctggtctcgaactcctgacctcaggtgatctgcctgccctggcctccaaaagtactgggattacaggcgtgagccaccgcacctggcctgtgcatgcattctttgggtccagtaattgattatagttacttcaggcaaactccacctattattcacctttgtaaccccaggagcagtgctactctaagtttggtccatggaccagaagcattagcatcacttgggagcttgttagaactgctgactctggactctacccccagacctactgcactagtagctctgggggtgggacccaggaatttgtgttttagcatttctccgggaggtccccatgcatgctccagtttgagaagcactgctaaggatagggaagccaggttctgtcatgtgtgattgctcaataaataatttttgcttgattgcatacataaattactgtatgaacagggaaagtgggttggtcttactaggtctgggcatgactccaagcatccattttgccaagtctgcggagactgtgaggaggtggagtcgtatttccttccctctcagaaaatttggatggatgtgtttaaatggctgggaagatagactccatcagcatcaatgtgggaaatggtgagcaactgagcatgaaacctgatgggaaccaagtgaatgggccagttcgtaatgaaggccagaagataaaacagggtggagtgatgatttcacagaagggctgagaactctgtgcagatggtttggggcaagatgctaaagccacaagtttacaagaattgtatgcttgggactcttttctgttccagggacttattacaaattaagccctccctattcctgcatatgtggcagagccttgctgtaaatctatttcaaactgttttttctttctcatcttattctccttttctctttctttaactcttccttccctctctatctcctttttcctttctgaccaagaggctattgttgtccgtgttttgatcagggctaaagctaccctgtggcataacatttgttaaggacaaggatgtgtgggtttttgtgagtaatcagcagctgcttttggagtcatggttttaaggaatctcccttcctcaatagtgtgatcattccctcctcccaacacccccttccaaaagagaaaacttgcataagagcagttggctcaatataataaaatatagcttggcatcatgagctttataaacaagaggcatttaatacactgcatagagttttggcagtgggagggacagtagcagccaaggagacacatatggctgggtttagcagcatcctgggctcataggaagaggatccccagctttagatccctgttggggggaggttgggtgaacaagaggttagaaagatgaagatggttcagcatccagggaacactgttatacccacattttcccaagtacaatgtttatttatttatttttcataaacaattacctagtgcctgttttaggtcaggcactgttctctaagcctttacatttttcagagcagctttattaagatataatttacatgccataaagctcacctattttattttatttatttatttatttttaatttataaacaaaagaggtttaattgaatcacagttccacactgctgaggagaccccaggaaacttaaaatcatggtggaaggtgaagggaaagcaaagcacatgttacattgctgcaggcaagagagtgtacacaggggaaaccgccacttttaaaatcatcagatctggtgaaagctcacctattttaaatgcaccattcaatgattttttttttttagtgaatttacagagaaatgctaccatcttcacaatctgattctgtcacctcttatgcccatttacagttaattccaaatcacacccccagccccagacaaccattaatttacttgctctccctattaatttgtcttttctggacagctgatgtaaattgaatcatataatatgtgatcttttgtgactggcttctttcactgagagtaatgtttctgtttgttccttttgattgccaaatggcattctgttatatagatagggtgctttacatttataacctcaattcattcttataagaaccccatgaggtagttgcttctgttatcagcaattacagatgaggaaactgaggcacagttaggaagttgaggggtaacgattcaagcccagggagtctgacctcagaatctgtgctcttgggctctcttgctatgttgcctctccataggtacaaaatatgtattcacttctaacttggagagtttctttgatataatgaccactgaatttattgaatacctactttgtgcgtggaactttgctaggtactgtgatggactgagacaggttttgtaccttcaaggaatgtagcattttatttggtagagaagactcagatccacgtgatcaagtggattctctagggccacacagaattccatgtgatccaaagcctaaatgcacacgccaggtatcgaaagtcaacaagacaatgatggtagtgagaagagccaaggaaagcttttcaggggaggtaacattgagctagttccatctccttggcctaatcaatcccaaattccatgaatggaagcttggaattatttagagcccaccatttgtcatcatgtcccttccaaacacaaagtccttttcttggtgtgttccaacttttagatcccatgtgtgtgactataattacaccaagaagcttttcctcttaagctgtttttaatagacatgtcttaaagaggggttgttctctttagaaaaactagttgcttcacaacatccagttcttgggctggccacagaagcctggcagacagggaatcagaagtaagaatggtacatggaactacatgttagactctacaaggcctgttacagttagcttgtgctgtgtaataaaccaccccaacacttaatggcataaaacaacaaccatttatttggcttacaattctgtgggtcatccgggcagtttttctgctctggactggttcagcaaaccttttgggctcacgtgcatctgtggccagtagggcttgtggctgagccacagatctggcttttggctggccattggtcagggtgacttaattctcttccatgtggtctcttatccttcagctgactagcttcggctcattcacaaggtagacagacacagggttcctaagagcaacaacagagtcccagttcctaagcctcttttcaagcctctgcttgcattatgtttgctaatggcccattgtccaaagcaagtcacatggtcagctcagattcaatgagtgaagaaatagattctacatcatgatgggagatctgcaatgttatattgcaaggatgttaatgcagaaaaaggatgaatttgtggccatttaaataattatccaccaagttagagagtataatagcgacaaggtcagccaacacatttattaaatgtttacagagtgtaggtactatttaagtactatatatatattcatttaagccatacaacagctctgagagctaggtgttattttttcccttatttttcagaggaatgacttgtagctctgagaagtgaagtaaagtgagaagttggctaaaaatcatacaactagtaagaggtggccccaggattcttttccaggcagtctggcttcagagtctgtgggctcttaaccactataacatcctgcccattatgagcttattgaaattgagttgatgtgccaccaaactatagggataatgattagtacgtagtaacattaattgaagacctaggatgtgcctggcactgttccaagtactttacatacgttatggtatttaaatatatgtaaagtacattgaaatgtactttatgaaagtacaaggcaatctgatccatcaaagactgcttttatccccatttcacagatgaggaaaccaaagctccaagaagtaagttatatgttgaagaggttgcacagttagtatatgggcaatttaagattcaaatccaggtctgaagggtcaactgtcttatctaattcacggcatcgtttcacttatttacactttatttcacagtctcaatttacagacatgggggagggggatctgaaaactctccagaacacagatgataataataagaaagaagaataaggggcatagagcagagcatctagagtcattgtcacaaagcccatgtatttgctggggaagttttttggttgatattgatatttcttgtccattgtgtatgttggagctgactgtgcactgccctcactccaaggggtaccagtagcatgagctgtgatgcaaatagcacactgggttgtgcaatgtggcacccatgcaatgctcccatgctcactcatctgggtctccaccttgcataaattagcaaagcaattaaaatggacttaagtaaaaaatctgacaacagcttataagctcattaccataggacaatgaaggaaatttccgaagaactagtttaccaaaaagcacaacaactcaaagtaagagagtttgggcagttgatgtagagacaaatagcccataaaaagcaccatagctcctggggatttgctgggggggagggcaggtcattgtcttgctacttggtataatggtggggtttttttttttcccccggaggaagaaagtttagattaggtttatatgctttggtgttcagaggaaggaattaaataatgtaatttggaaaggttgtcatagatgatcatgatgatgatattagtatttcttgggtaaagcatatcataccctgaaaggccagataaataggatattattgaaactgatattccagggttgctgtggcctcttgtgatccctgacttttcagatttttgcctcttgattttgttggggccaagggaaaggttcccttttgccatctggaggttcactgaaaatcactggcgagaggcagattgattaaactgttaaaaaggcatgtaaatgtacttaatatgtatacatgggagccttcaggatgaagacctaaagatccaggggaaattgtccatttttatgcttaggcttaacaaagtatggagagctttggagaaacagggataaaaagggcctgatcgaatgctgatagactgagtggggaaacccagcaaggcctgtctgtctagatccttcttggcctctctgagcagcattcctttctcctgggtgtggggcagaaccctctggaatgggggtcttataacctgcagtcaaacaaagtaggtccaagaatttctttgtagccaatttttacacagaaaagcagagtgaaaattagagttgtatttttaggtttatggctggctttggggaaaaggtgttttggtttctatgacctgccttgggggagaggaattctagtttccatgggtagccttggagagaatgggactgagagatagaggcaggagaaggtcagagaaaaacttttgcttctgaggctgctgctgaggccttcattttggggtattgttttttgagtcccaccagtttcctgtagggttgatgtaattccaaagacagaaaagtgaggactctcagagatcaaggagatggcccagtgaccctttaagacttgtgaaagagcatgactcaagcagctttcagactcaagagctggctggttcctcactgggagggtttgcacctagccttgagggtggttgtgaagagtcagtgcataacaatgagaagccacagcaaacaagtctgtcctggattgaccagtgtcctgaaatgagtccccacctccacatcccacctcctataattaagtgatggaaaggactcccatttctaaaatgctctgaagatcagataacagagggaaaatgaagataaggggagaggtgattcttctgaatctctagggttggtgccagcagccagctgcaagaatcaacttgggagatcccagcttagtgtttcaccagaaaatagcccaccattgtgctcagagaaagctttcatcctccctttgtcccaccattgtactcctttactttatgagaactttgagaaaaatcctagagccagatgcctcatgtccccatatatagccaggtctgcctttggtccaccagcagccatgtcatggtagcggtgcatctgtaaagggagaagaggaggctagagccagctgcatggaaataccagcctgccaaaccaaggcgggcatgatctctgatgctctagctggcaatacatggacactggtatatcggcaaagtgctttaaattcctgggaagaaagatgtagaacggaaggtgggaacttgcagccagcttatgagagccattaccatggccagcaagtcactgatgcacaaatgtatatttatgggggcagcaaggagatctatgtctccaggtaagtcccttagagtgactgcaattgtggattgtaggtgtctggggtgctgagtttgaccagagctcagaaacttttggatggttttgggaagagtgcaatgatactgtggggcaaataaatggatgcagttggctgcttgactcataaaagtcttggtaaatgccccaaagcaaaaatatggaaggaattaaagaagcactttggaggcctcgatttaaatttcttttctgtgtatcatatgtggtcaagacagccgcagagatattaaaggaaaggactctttatgcccttgttggtgcagggctcagataagggtgaggttgttctttgttaatatttataatggtatttgtggagatgaataaaaaatgaaattccctttggctaatttctcagattgctggaggagtagatgaagaggcaagaatagggttgcatgcatctcagaagaatctgctcttccaggacaaaaaaaaaaaaaaaaattactccttacataatggaagctagagtctaagagaatgttccctttctctgggaacacatcatttttgcttttcactgttttatacttttgtgtgtggcaatttctatttgccctgtctatgttaaagcatcatattcatcagtgtgtggttctactttatcatgtgtaatgtctaacatgccaaagctgttttacatccattgcctgaaagagcttaaatcttgctgtgtgctcacccagcgacaccctccttgcccctggggaagcagcattctgccagtctattctttcctctatggcctaccttcgttatataacggaatttgaatgtctagcatatggtgattagctgggacactgggtgtgtaagcatgccctgcaaaatgatgtgcatctgcatgcatgtgccttcctacaaatgcaaacagagcacagatcacagatgtggttattgtggaggtaattatacatttggtctgaaaccaaataaagttttgccctcctgccctgtcgggcatcatatttacctcattgaccaagagagagctgcagtggggcaggcaagagggtgaggctggagagaaggagatagagatgccatatggaagtggttggaaaacagatgggggaagtctggaaaaatccaatttgttgttctcaggtgtttaaaggaatgtctccatgttaggacattagaatggatttcagtgctcaagacaggttagaattagataatgcaaggccacttcccaggtagaattggtatataactaagctttgaataatgatgttgaattagtggctgatcaataaatggaaaggctaggtctatttaggcaggcttgagtggaagaagttggccagagttgggctagtcaagcacctcgtagtggaaagaagagtctgaaaataatcttattgtaatcttgtcaacaataaaatgggatggaggaacagaaagttctttgctggagggttgacaaatctggttgcatcactggggcagaagccactgccaggagatccgttatctaacgccagacccctagcatctcctttgttattatcacctcagaggggggttttgatgcagtccagaaacatagaccttcctgtcctgggcaatgcacatatccaacttttatgccattgtctgtacctttagaggtgatagaagcttgtttgatgtgtttgatcccgtgatgtgagaagctggacactctctttgcaggttcctttcatgggcttctgttgaagaaaatcagatttgaaaacagtcatgcataagctctggatgtccacgtgagcctgctgttaatgtacagaggccaatggacccacaaggagtaaaagatttctttttactggctcctgtactcagcatctagtctcagggcataagagcttagcaggccctggaagggcttcagattcctggtcctcagacatggtaagaagaagggaacagccctggatctcctgcttgactcctaatccagtggtatttctgctctaccattttttaaaattaccttttcttctacattaccttaatgttcctaattaatgaagatggtcttactgaagttgtcttttctttcttttaaattccaaaaaaagaaaaaaagacagaaatgtacttttacttactaaggggagttcatctagtttcccagaactgttgttctttcctttcagctacaaacacagcatctcatctcttggtttcatttaaaactaaacaaatgaacttaataagatttcatgattataggagttgggcatactgagttcctactaccttaggactctttcttgagaatggagggccatggagaggtgacattaaatttcatagtgattaaaattagatttttagttcatagcaatttagtttaccattccttcaaattataattttgccaattataattgaacatgtttttagaacctgaattttctcacttaaagtgattcccctaaatatcattttaaaaattaaattaattaccattgcactaattaattccttaattggctcttaacccaagaattagattgcctagattttaacagagaaagcaaaacagacaaaaacaacaaaaccacacaaggatttttttcttaaccagaatattctgaagggatcatttgatcagatctatggtatgtaggtgaaactgggataaaacattttttaaaagacattatataattgataagagccatatttttgacttgattaattggctattttgattaattaaaaatatgtaaaatatacttagaccctctccatgagaaagaacaaatttgtggatttgaacacatgattataaataatcatttttatttttgtctcttactgtcccccactgccaccccagggatttgggaatgggctgtctctgcttatattaagaacatgtaaaaaatagactcattgatctatcataacagagaaaggaaacaaagccatgggatttctagacatgacatgtaattcttatactcttctcaccttccataccctctgctggtttttcccatcatgctatttgccagtgttaaaaaaaaatgaggaatgagctcaccatgtcatctaaaataaaaaaagaaaagttccttgccatcgatcacagtttgtaaagtactttaaaatctttctcttggagcttgagatgtgagcctttggcagcttcagtcatatatgaggggcctgaaagaaggtgtctcgcagtgtggaagttgctgtttccattcactctcagctcatcatttaaagatattgggagagagctttttttttttttcttactgagaacaccaaaaccgatgatcaccacaggaagacttagttactatcacagctcagcctcaccaaaaattctttttcatttttttaaatgtttatttatttacttacttacttactgagacagggtcttgctctgtcacccaggctggagtgcagtgacatgatcatggctcactgcagcctcgaccttctgggctcaaagtctcctcccacctcagcctcccaaatagctgggactacaggcacatgtcaccatgcccagctaatttaaaaaaattttttgtagagacagggtcccggtatgttgcccaagctggcctcaaacttctggactcaagcaatcctcttgctttggcctcccaaagtgctgggattacaggtgtgaaccacctcgcctggccttaatacattttttaaattgaagcataacatacacatagaaaactgtaccaaaattaacagtatagcttggtgagttttaccaacgaatattataagcaccccagaagcccttcctgtctctgtccacctgccctgcccccaggatagccactcttatgacttctaaccccatagattaattttcttgttttgaactttatataaatggaatcatacagtatgtgcccttttatacctggtctcttttgttccacattatgtttgtgagagtcaaccatgtcatggtgtatagtagtggttcattcatccatattccattccatggtgtgaatagaccacaatgtattgatccagtctgctctctatgggcatttggatattttccagtttggggctattactagcagtgcttctgtgaacattcttgggtgtgacttttggaaaacatgcgtttgtatttctgttgggtatatatccaagggaggaaattctggatcattcaagagggactattcataaatctcgttttgcttttttcctccatcttctctaagagagggtagttataggatttcaggactggaggaggccccacagaacatgtatctggctggtgtttttctgattctgcctcaatatcctctaaggagttcaggcatcttcagtgaggggagaggcgagcttgtgtggggctctggggctctgcttcaaccagagcaatgcccccttcatctgattcatagacagtggtgaaattacaaagaacatattgtttcaagaatgagttctataagtttgtttgagtctcactgtgtcacccaggctgcagtgcagtagtgccatggcgtgatctcgactctctgcagcctccgcctcttgggttcaagtgattctcgtgcctcagcctgccaagtagctgggattacaggcatgcaccaccacgcctggccaatttttgtatttttagtagagagacagggttttgccatgttggctaggctggtctcaaactccttacctcaggtgattggcccgccttggcttcccaaagtgctgggattataggccaccatgcccagccatttttgcttgtttgtttgttttttgttttttgtttttaagagtttgaaaagagatgatttgggtttattgttttcacttgagaaaggggcaagcaggcctacacagcagactggggtggattgatgtacgtggggggtgctggcattttatgggtgctcttttactcaaccctgcaaatcaactctatgagagaggcgtgttcttatccctatttacagctggggaaactgagggggtgaagcagctaagtgacattcctaaggccacccatctaaacgaggcagagctgaatccaggtggtatgactccagggcttccccctgctcccttaattatccaaaccagagtactctactcccacgcactgcccgtttcacaatctccctcacagactgtcaagggcctacatgagccattatggtgacagtggtttactctttgggtttttgtttctctggtatgtaaagctattgcccaagaagccaaggcataatatagagacaggcccacatgaaactgactcccccacttaagttcatttcaaagcagaatgtaatccttcgtgcttaccctttcacatgcccgatgttatacgattgttgctggaaccctgcgagataagcatggtaagtactactggcccttattttgccaatctctctgcccaggtctctttacctgctcgctgcactccagctaccactggcttcctaaatatgccacaggtcctttgcacttattgtttcctctggctggaattctcttttctcaaatattctcatggcttgctttctcggttccttcaaggctctgctcaaaatcatctaataaagtagaccttttcttacctccctatctaaaatgacatctccatcatgttccactgcctgatctactttacttttcttcaaggcaagtctgcttcctgacttgtgatatatttactttgtttcgtagcaattgacagacaaggtaggcttcaggtgggatggcagtgggggggtgttgatcattgtgtatctctggcacatcaataaatatttaatgaatgagtgaatgaaagaaactggtgttaaaatttagatactttatacccaaggagggtagctggaacttatgtttaatgggataagcttgtaggtgctgtatctccttacatttctaatatttgttttgctttctctcttttttcttgattattcttgccaaaggtttatcttttcattgaacgtttcaaagaaccagcttttggtttggttgagccttttattccatgcctttcttcttgttcagctctatatttatttactttggtttgtatatgtctgttatatctctgcacattaaagattgtttgagtgcagagaccatagccaaccacagctatgatgaggcttgctgactaggttagacctttgagccaccatgtctgggggtctgtggtttaaatctctcctttgccaagctttcccatttttgcatgagccaccggggtggaaaagagcaacatttagatttttaaaaaataacaaattatccaattatcatttcagctaagctattttaaaacatttcaattggtatggactggtttctaacctatgaatatgattgctgttatagtatcatttgttaattcctttataacaaatgtcttctatagcttgcagtattacttatattattttactgctgtaattgaaaccatagggagatgaaggttatgctagaatgaaaaagttcaaaccacattttgggactcttttttccagatctaagtgaaatccgtgttagaataacaagacagaaaatctgtctctataattagggaattactggagtcagaatcaaaccgtaggaaggtgcatagctaaggaatgcttctaagacagtagaaaataaagccttatgtgaacaaggagaatctctgtgcatggaccttcagggatggggatatgtgcttgcagggccagggagggaattgatgggagctccatatctagttaaagcacttaacctctggggtgaaatcttagtccagagaacactgaatggtttcacagcaaaatgtcatctgatgaaccctgctgtataaagtagcagagaagtggtcgtaaatttgttcggggattcttgtgtctcattctgactttggtttgcaatatgataggtttgattttcctaggaagtctcctgatgccatgcccacttgtgttaagatcaaggcacttagttgtatgtgaaatgtgatcagggaatgcaccaaggattcggcatcttgggggcattatctctgatcctaaggtagatcagagaaagtcaaagggaaggagaaatgatgagggagggcaagataggtagatagatactgaaagagagagagagagagacagagagagacagagacagagagagacagagacaagagacatagctgggctgtttaggattatgaaaaagcatatctgtagtgccctgttaaagatgaaaattttaccccaaccccattcttcaggctcccaccattagatccacagtgagagaatgtgagagagacagagagatctgattcccaatattccttttggcttgaagcttctttgattctaaatgcagggaaggacattctctgcaaggcagagcaactttcaacgtaccttgagagttcaaaggtcagtgtttatctctaagtgctgttcaactgtgagcacaggaaatgttccctgcaaatcctgtgtccaggggaatttgggtccagcatccagaccaccatagactcaggttagggtgctttttagagttggatgggaatcagtctggattttttggacccaaaggacactgacctggtggagtgatgtagccaccatgtgcagaacagttttcatgggtgagtctctcaatgtgtgatatcaaaggcgtgtttcttttagcaaagggaattcaagttccaaacagcaactgtaacagaaggaaaaggttgtattctactttttcaaaggtgtcaaaggaatagagaccatggattaagtacaaatttgggtaaggaagattcaaattttccaatgatttgcagacagtgaaaagtttgaacataaacacacatgatttatttaccacagaatatcaagactgtcgagccaagtcaggaagcaagcgtgtgccaataaaatcttgacagataccagaagaaaaatgagaacccaacttagtaagtggtgggaaagaataagtggtggtagatggaattctttttaaagagcccatatagaaatgagtgagtgtagtgttcttgaacagtggcccatttatactggaagctatttctttgacatatatgaaccagccagatcactgagagggaggatgcttcttcccacaagaagagtaatctgattgtttttcctcaaataaataaccaatttattatccacccagatatgcaattgttaaagacactaaggttgtgctgttcaatatggcagcctctagctgcagagctgtaagcacttgaaatgtagttagtgcgattgaggagctgaatcttgaatttcatttaattttaatgagtttaaattttaaaatgggtgtttgattcagttattggaaaagtttttgttctttgcaacaattctggtatgtgaatctactttttcaaccatttcatgaaatctaaatatagatcaagtaattctgatgaaaatttaccatccaaattgagctgtgctttaactgtaaaaacacatgggatttcaaagacttaatataaaagaagagaatgtaaaatatctcgttagtaatttttttacattgatcacatgttgaaatgataatattttagacataatggattaaataaaacacattattaaacttaatttcacctcctttaaaaatttttttatgtggttattacatatgtggcctgcattcttgcattatatttcacatgaacaatgctttatatttatttatttatttatttatttttaacttttattttaggttcgggggtacacgtgaaggtttgttatataggtagacttgtgtcataggggtttgcggtacagattatttcatcacccaggtattaagactactacccaatagttattgtttctgctcctctccctcctcccaccttccaccctcaagtaggcctcagtgcctgttgttcccttctttgtatgaacaaggttttacgtgccacatttggtggataaggctagctttgccactgaagattgaaatgaactgggaaatgagaaaaatggtgaatcctttactcttgtatgaactgaaagttttccctgctcttcccttctgttcctgagcctaaccactagtgatttatttaatataagtctttatatcctgagagagctaggtattaatgaactttgtcatgtgctatttaagtcttaagctcaatgaagaatttagtttgtaagtgattttaggacaacgtgcttccttcttacacatccgtcttaggttgggtgcctaggacagactctgagatggagacccgtgcacaggaaagctactggggagtgccagtggaatcaacacctgcaaggagtgagggaagcagggctgggcatagggaagagctgaaccaccatgcagtacaacaaagacctcagctgtggaagcaagctggtcctttggagttgtcccaaattgaggcaagggggcctggcctttgtattttccaaatgaccagtctttggatgcaagtttcctctaggtagggggcaggagcttgggtgaggcagctcctttctgcagaaggcaattcccagagcaggaaaaagctgtgagccctcagaagccaataatcccagcagttgggagatggggtacctcaatccagaatgagaggtcttggaggcaccccacagcatccactatgacatctcaatcttgttctaatcataagcccccagccagacccagacaggcaaagcctttcaaatggcatcatcctagacctggggaactgaaaaaactccctgtgcctgagaatgaggagtagggtatgtgtcttcttgcattcctctccttcctgccctggaatgagccataatttctacaacacagaagtaataagggattgggggaagggagggaaaaatagagacagagaatagaaggatgaatcaatatgactcaaccacttataaatcccccagtggcatagataggcaaagagccattttactttcctctaacttctgaattgggctgtagccacaacccagcagctattcggaagtgtggagaaggatgagaaggaagcctggtcccagagcagacacgctgcccagatcaatttagaaagaagtcaagactgtcagcttgggctagtatttcactgacttctagccacacggagaacgaatgtcgctcagataataagccaagaaagagagcaggcctcggcctccagttctttcagataatgacctgcggttgctgcagaggaaataagagcttggtagccattcaggccctgagagcttgaccccaattcttctctgtgtgtctgtctggccatccatctggttgttctgtttcccgttttctagtttgtcctttaggacaaatttgcatcttagtatggcttcttcccaagcatctcccctgcctgtttgcaaacactgattcatcaaagatgcccaacagcctgtgatcattgggcagggacattttcccataagcctttcctgcttctcctgccagttatctttaatttaatagctgtgcatgtcacatatgtacatactcacagagggatgcacacattctttaactcacacacacctctaaaagcacattagtgcaaactgggttaaagctgcttccagctacctcacttcccttcctgcccctcgcctcgtccttttcctatctccagccaccttgctctttgcctctcatttcacgctgcctctgagagagaaatctcattatttctgatttaggggctcctgtgccctcccctgctacatgtcatgcccgctgccagcttgttgcaacatcacaagagaattcagagctctgatttatccgccagaggaatgcctctagggaggatgggggtgggtgagactggagaccaagaaagggtgtaaaagtggggagggattggcagagaaagcctgagtttttagagccttggtagcttcaggatgcttggattagctgggttagaccacactgtgaatatagcacattttatcagaagcctaaagaagaagcagtgcagcttttgtttatttgattttggagatgggctgaggacatgtaattggggcttgggcagagctattgagggatgctgtaatgggctttttaatccctccctccccttttcctcctggaaagtagtaaatggtgaggacagtcatgtaacttataatttaacattcttcataaatccatctttgccccattcattagcctaagagcaggaattagatgtcttgtgttgagcttaacacgtgggcacatagtgggattcagaaaatgtttgctccatatgtaatgcaggaattagccaggtctccctactgtcttggatttggttcccccagacacagatcctggcataatgattcaagtgaaggtaatttattttgtgtgtgggtgtgtgtgtgggggtaacactacctgtaggtagtgagaatatgatacagggaaggagggcaacaagtaaaggacattatcaagctgaatcctacagaaggattatcccacccaaggggcaagggagctggagtatttatacaccaacctcccaataatcattgcttggaggctgctcctggaggcattcattagttcttggcatttctagcccacctcgtgcatgggcagagtgaccttctacagtcctggttcaggaaaattagcccgtaggctcagagatgcaggcactagcagttggaaatctcctggtgcttacctgaaaggtctgagggatatgtgcaggggcactgacagtgtctgctatggtagccaagtttcatgcatccatttatccactcaacaaatatttattcaaccactcctatgttcctggcactgttgtaagtgttgaggatacaacaataaacaaaacacatacagatctctgttttcagagaacttgcagtctagtggaggtgaccaacataagataaatatgttatactctccttaggtggtgacactgtaatgaaaagaaaaataaaggtggggaataaggattgctgagggtgccatattaaatcaagcaatcaaggaaagcctcacggagaagtggatatgtgagtgaaaacctggaaggaacgagtcatgtggatatctgaagaagagagttccaagcaaaggaaatagtaagtgcaaaggccctgaggctggggtgtgtgcctgtcatatttgaggaatagcaaggagcccggtgtggtcagagctgcatgggtaaggcatgagctgtgggagaagagctcggagaaatcccaaggtgagggcaacagtgcaagacatgcaggatcttttgggtgattgcaaggcctttgccttttactctgaatgagatggggagtcactggggggcttttagcaaagaagggacacattgtggcttatgttactgtgttgggaacatactgaggcagggcaggggtggatggaagcagggagatcttgtgcaaagcacatcttctaggaccgtctattttactccataataaatgaattaaagatgagagtgggaacaggtctcttgagccctacatgtggaactggcatgatacaatttttgcttcattttgttggctaaaacaaattataaagtgagactaatttcaagggatggagaaatagactcacctagtgataggaggggttgtaaagtcccttcgcaaaggggtgtggatagaggaaggcaaattattgtggtcattttttgcaaacaatctaccatggcaaatgacctcaaattgaactttgaatatccctgttcttaaaatatcctggggctacctcacctcatgttatggagtaaaatggaaggtccaagaagatatgccacgttcactttagatcctgcccaccacagatgtcagtgggtattcatgtgccaggcagaggtgaggaactaattgtgaacctacttccacttaactgctttgctccttttaaccttaataccatgtcctttggccagcttcttctttcccttctcatccttgcttcttccagttctccttgagaacaaacacccactcccttgtgtcatgaagaagactttgccagatctttagtaatcttgttcctgaacactttgcaccaagtttcaaagttcacatcaagtagtgaccaagggattttcccaaccaaaatcagacctccatctctaacgtgctcaagatgaattctgtgccagttgttaatataatccattttcgatgtgctttataaatgaatgggcttgaccttgaaactgacaccaagattctgtgggttgggtggagaatggtattatagatgtggtgttgatagagttctcgttctatgctcttttactagtgtagtttatggctattgcttcttgaagccaaggtctgtgcctgtttctttgattcccctcccaatacctaggactttgtagactctcaagtaatgtgaccttgaaatttaaggtgagtttctacaacagtctatctaatattttagaccttcccctcttctcaagctaggagggaaggatctcaaagaattcccatagattaactagatttttgtatatctagaccagtgctgtccaataggattttctgtgatgctggaaatgttctgcatctgcactgtctaatatggtagccactagccacttaggggtattgagcacttgaaatgtgggtaatgtaactgaggaactgaattttaaattttctttaattttagtttaattttatttgaatttttttaattatactttaagttctgggatatatgtgccgaaggtgcgggtttgttacataggtatacacatgccatggtggtttgctgcacccaccaacccatcatctacattaggtatttctcctaatgctatccctcccctagcccctcactccccaacaggccctggtgtgtgatgttcccctccctgtatccatgtattctcattgttcaactcccacttatgagtgagaacatgtggtatttggttttctgttcctgtgttagtttgctgagatagatggtttccagcttcatccatgtttctgcaaaggacatgaattcatcctttttatggctacatagtattccatggtgtatatgtgccacattttctttatccagtgtatcattgatgggcatttgagttggttccaagtctttgctattgtgaatagtgctgcaataaatatacgtgtgcatgtgtctttatagtagagtgatttataatcctttgggcatataaccagtaatggtgttgctgggtcaaatggtatttctggttctagatccttgaggaatcaccacaatgtcttccacaatggttgaactaatttaccaacagtgtaaaagcattccaatttctccacatcctctccagcatctattgtttcctgactttttaatgattgccattctaactggcatgagatggtatctcattgtggttttgatgtgcatttttctaatgaccagtgatgatgagctttttttcatatgtttgttgggcacataaatgtcttcttttgagaagtgtctgttcatatccttcgcctactttttgatggggttgtttttttcttgtaaatttgtttaagtccattgtaggttctggatgttagccctttgtcagatagatagattgcaaaaatgttctcccattctggaggttgccttttcagtctgatgatagtttcttttgctgtgcagaagctctttagtttaattagatgccatttgtcaattttggcttttgttgccattgctttccatgttttagtcatgaagtctttgcccatgcctatgtcctgaatggtattgcctaggttttcttctagggtttggactctcatttgcaattgctacaaagagaataaaatacctaggaatacaacttacaagggatgcgaaggacctcttcaaggagaactacaaaccactgctcaaggaaataagagaggacacaaacaaatggaaaaacattccatgctcatggataggaagaatcaatatcatgcaaatggccatactgcccaaaataatttatagattcaatgctatccccatcaagctaccattgactttcttcacagaattagaaaaaactattttaaatttcatatggaaccaaaaaaaagagcctgtatagccaagacagtcctaagcagaaagaacaaagctggaggcattattttacctgacttcaaactatactacaaggctacagtaaccaaaacagcatgctactggtaccaaaacagatatataggccaatggaacagaacagaggcctcagaaataacgccacatatctacaaccgtctgatctttgacaaacctgacaaaaaccagcaatggggaaaggattccctatttaataaatggtgttggggaaactggctagccatatgcagaaaactgaaactggaccctttccttacaccttatacaaaaattaactcaaggtggattaaagactggaatgtaagccctaaaaccatgacgttttaattaatttaaatttaaacttaaataccatattagcctgtgcatctctagatagtgcttctcaaacttttctattgaagtgctcttgatggtagaaaaaagataatgcataccctgatggtatgggggcttcaatttttcaagtacaaaattactttgaagttagtttaaaaaatgcacggcgattttgcatttctctttataatatatatactctaacatggagccaagtgtatggtctagaaacatgtgcccatgacttccttagtacacggcttccatgtagtcttgaggggtcatgatggccagttagacatagatgaatgcattgcaagtaagttggcttaaagtttaaactttacattcttcctatttttagtgcagcctgagaataaaaacatctcatcaaacacccattcagtgttatgaacgaccttcttgctggtatgggttataaccgtcttactgcagtgcaaacctcctatttgatttaaaagaaaattctctcccagaaatctcttcaagtgcatttaatgaataaggcggtgtccgtaactttctgtgacatttactttaataagccatgggagtgatttagtgatcagtgggcactgacatttgaggagggaaagataaactttgctgcttctgacatgactttttttcttctcctcttgactctggtcttgcagccatggaaactttgtttcctgagagagatgctgtgttctctggcttttggaagtaatctattttttttcctttaacaggcagccacaaattaatttctcttttgtgtatttgatgttgcaagtgtttctactgagtagagtatgttttccacagtatttgaactttctgtcttgttttgtcttgtgtgtgtgtgtacatgtttttcctcaacatggaatttgttctatcatgtttgaaagaaaaaacatggaacaaaaaggattttaaagggaagatttaaaaaaatcactacacaaatacatatataactacaattataaccctgactatatatatctgtacaaccaccatacagaccaagatatataagaacattgtcctcactcctcaggaggttcttctgtgtccccattcagtccatacaccctgcccagaggcaactattctgactcgtgtcaccatagattaattttttcttgttcttaaacttcatgtaaatagaatcatatagaatacagttttcacttactcttagccaaaaggtcaagaagcaatcaaaatgcacttttgatattatgtctatgacattcatccatgctgtgtgtatcagtacttcatttttaaatgtaggctttggagcttcactaaattgggttcagatcctgcttctgttacctaccacctgtgtgaccttgggcaagtagctttacttcagttttctcatttctaaaatggggatactaataatatttagctcaaaggtttgtggagaaaaacaaaaggactgcttcatcacatgttcctaagtgctttgagtaggccaggggagctcctgcagtggaatttctgctgccaacttttgggtgcccactcattcccagtgggaaggataagagacatctcagggcttttttagggagctcttgaaatgtctcagcaacatgacaaagtattaactgcccaagcagcagtttatccacagtccctctctataaggtgagctccatttcctctgcaatgcttcagcctaaccagcaaaattgtttacttcctaaacatttttccaacctccaaaacagctcacaggtgcagacactctggcctcgaggaatcttctagtgctgaaggtgccatgtctaggttttctgaatcatagatcatggcagaatattcgtgattggtacttgttgaggacatccacttgccatgtttccaggactccagacataactgtggccagttcctgtaggagtcaaagcatgaaagtaactcaggaaacacccagtcagtggggatggagttgggaattgcatccggtgctgtcatggattggagagccttgtctggggccaggtaagccatagttaggatttctggtgggtaagagagaacaccaggcagtaagcaccatcctcctattcagcggatttctcttttaaatttttttaaagttttattttatttttaattgacaaataatacttgtatgtacaactcatagaattagagagtagaatggtatttactagaggctatggggaggggatggggaatggagacattttgatcagtggctttcttgatgttctgacacctcgtggggacacggagctgagacttttccagggggcatctgctccactgctatcacccaagtaagtctgttaatgccccagaagctgtgagaataataataacgataataataaagtagctaccatttttagtatcactccagggattcttgttgtttgtttgaaatatggcaatctagtgaaacctatggatcccttctcagaataatgtttcttaatgcgtaaagtataatacataggattgcaaaggaagccaagtatattgaaatacagttatcaaagtatttaaaaaattccaatattataatagatatatgctcctttattactacattaaataacaagagttagtggtgagtctaacacacattataatttgaagtagtggtggtgtaaataatatttcagtacagcaactttaatgtgatatgaaaatatctgtaattcctattggtaagaaactcacaagtactgctaataccaccgtggtttgttactttcacttataattgaaggaaatattaaatttcagttacaaatgaatgaaaaatatctgtttgtggctctcttgaccagtttaggaactcctgtttgtgtcaggcattgtgctattctctgaacgtacattattcctagccttacagtccagcaatgtcggagttcttattcccattttacagataagtgcactgaggtttggagtcagactaactcagccatggtcacatagcagtggagcttgctgtccaggccagggctttgtgatggcagagctcaggttttccctcccacaccttgcatgccttgaactcctgagccacatttccccctgagagacattggcataagagatgcccagggacttttaaaggaacgtagtaaaggcactctttcctagactttccatatttctccaaagagaaagcaagctcctttcttcttctgaaagcctgtcctgtggaagtatcaagcagcttttctcttggatctccagggccacattttgggaattcccttgagtctcccagccaatgttaggtggtcctattccattggtgtgccagagctgacatgtaaaggcttgcaagagccaattgtgtacatctcttctcacattggtagcttgaaatcaaccatggtagaactatttacatcatggaattcctaaacactactaatgaaagcgtttttattttaaaagccagttgtttaacatttactcttgaacatgcttctttgtccctcatgtgttcccagtcctcactcctccaaaggaaagggtttgagcaaccaaccaccacacagttggaagaactagcttgccttggtaacataaagtcttggcttacttgcttgctgtcttcctccttcctgggtactgaagctgttttaaaatgtaggttttattattattcaggtacagtgaggccaacagatcaggagatggacaattccattgaaaagacagtttgttactcacagatcctcccaagaggaggggctataccacatcatgggggcccacacggggaagcactagggtgggtcaggagacaggagagggtacaactgtggacaagagtcttacttgtggttttcatgggaaggaacaggcaaggcagggtaatcaggctttggattggctagtttcaggaatttcagtgggctctggggcatcccagggccaagtaccagacaactaaggacatctatgccttagttgtctggtacttggccctgggatgattagggcaggtggatggtgacctggagtgtgagagctgcataaaggaagtggttgggatgtggactctggattggttggttcgcatatgaaaggagctctcccaggtgagttgtttgctatctctaggaattacctagccctgggaggtgcagctcctctagggtgaacaaggccccaagatgtcaaagcatcaaaaatacagaattaatgcaaaagccaacactgtcctcagagtggatggcagcagcattagattggagtgatttcccaataagtggtgtgagaggctcccctcttcatttagctccaatggcgagaatgttttacattgcacatattggcagctccgttgtcctcataaaaagaagcatgatagaaagtaaaagctgagacttaatggccaatttaagcttgagataactctgctatggtagatctaaagaggctcccaggttacctacgtagcaccagtctcaaccttatgtgcactaattcaaacttcaggggacacacattttgcatttctacaaactaagcgagtattaggaaaaataaacactcaccagttctttttatgctatcacattctatgttgcacataagaaaaaaatatgctttctagagagttgtaaacattctgcacacaacatccattatgttatagctggcaatggggtccaaatggaataatctgcagactaaaccctttctttatccccagagctgaggctgaggtcagtaggacagtgtgggtgaaacagcttctgaggtgccctccgactctgaaatgtgctgacctggagttttgccagttggcccaggttggataatagactgttagatggcctacatctaagggatgataaaatagcagcccagaccttgatccctgctcctgccaggttctaaagcatcagctctgggtggtgggggtggggttccggatggactgcttttcaattttcccaagccccagaaaagcagtcggctgttacagaccaggattgctttagcctgaaggagaggagaaatgcaacttactgcctttccgatcgtaggtttgtgctgggttgtattgagcaaaaacatggcagcgttttggattctgaacatcagtggcaatttgaaggctgtagagctttctatagggctgagaggatcctggccactgacagccttcctgttgagcagacacatggctggctaaagactttggtggattccagtggtgatcatggcatgcaagccttcctcccctagctgggactaatatatcacagggcacaacttggcttctaagaatcagcatattaggcagcaaaacgtgatttcactgcaggaactaaacggagatggtcctgaagcatgtgtttccccagcacctagtgtgacatctgtctgcatgtagtaggtgctcagtaaatggtagttgagtgaatgaacagatgctcattttatgtatcctacaaggaaaagacaacaattcctcctgttgtttcttttaataatgagagttggccagaaatggaatggagtgatttttaagatttaacattacaacctcaaagtatacaagctgtagctagatagtaaaaataacagtagctattggtcactcattgctgtataacaaataactctaaaattcagtggcaagtatctattgtcatgttttcagttttgcagatcagccatggtgacgctgcttcaagctgcaggtctgtgcattgattagctaatgtacgctgggcttggttctcatcttcaggtttggttccagtctgttccacgtggctttcttgcttctgggacagtgggctctccagggcatgttcttcttatggcaatggcagaagcacaggaggacaagccccacagaacaagcacattttaagcttcagcccacatcgtatttgccagcatcccatcagacagagcaagttatatggccaagcccaaaagcaataagtagtaaaatatactttgccttcagtgggaacaggagggaaattagttatcactgaacaataataagcaacaacaataataaatgagcaataaacaaactacctaccatttattggatgttactgtgtgccaggcactgttctaagcattttccatgcttagaacattttctatattcattttccaataaacttatctaaccaccatagcaacctaacggggtaggtgctgctatggttaagctccattttacaggtaagaaaactgaggcacagaatgactgatgaacttgttgcagggcacacacccaagaggcagtggaaccaggattcacacccagttagtccagccccaatgcctactctcttagccactctacgctcctgctccagaaagcaagaagcatgctaaacaactttggggcactttgaagtttgcaaaatgctatcacaaatgtctcatttaatatttcatggaagccaggataggctatttccatttactaagcacgaggacactgaggcccagagaggttaaggaacttgcccaagtcacacaactgggaagtgactgagccaacatggagtcccgggccttgcttctagcaggaattccactcttgtgaatgaggagcaactcagcagttatccagggtttttttctgcctttgggccttgggaggcttctaatttagggcgcccaccctccaacgcagccttttacttgacttatttatgtattttctggctggaggatttgtgcccttgttccttggcatgggattgatgtcatggcaagatagctgtgctctagttctcacggtctccaaggccttagtttctcatgacatggcatgtccctgagtgtccccttctctccctgatgtacccgcccttgctttcttcctctactgaatgctgggacagccttggctgtcctatgtgtctggttacaggctcagaagggcaagaccagctcagaggctgtaattttagtcctggatgaaaggcaaggggaagcaaaggggactctttaacaggtgtacccaagccacaaggctgtatctcctgaactctggtagaaagcagacacttagggaagagtctcaatgtgagcaatattttcaggatccaaagcccccagtgtggggagtgccagggagtcaggagttcccaacaccaaaataaaaagtgcagattgacagctctgaacaaaaccttgtgcttgctgctctctgcagtgtggtggggcacagggggtggaggtttatgccaatatatgctcccattcttgcaaccaatttgaacaagtctcgaaaccagcaaaaatcctattaatgtgtttctcctcacctgtatcctgccggcatcccacctgcctgccttttcctcccacctcgccgcctcgcttctggcagaatctgatggctacacaactgtcattcaggagtttccgctacgggtagagattcccatacataaggcaccaatgagccagaaaggacaagcagagaatgttacattttatttggcccactgcccaacatttcttacctcattgcctgaattctgtcatactagagtcagggcttatcttcaagacactggaaatttccagatgcttacagctccctttcccccattctgagccctccagtcagggtgacgtttgggcttgagggctgaaggacctgcattttttggtgcgggaagggatgggagatgtcctgcagctacaggcaggagaggcctcctgtggggttacaggggtgatgtaggtatgcaatcaccacatccagaaacttgacctagacctggaaactagagccagcatttctaactttttctatgccatggacccctgggcaggctggtgaaatctggactcttctcggactgaggtttgaaaatatgtagaattacaaaggacctacagttactatgtaaatacagttatgcaaatatgaatttgtgatatagtaaaatatgtgcttcttattaacccacgaattatcaagatctagttgaagtgttaaagttgtactatttccagatatctgaaacaactctttctgtgatgtgaaaatatctatgtattctttttttctttctttctttttttaaattataatttaagttctgggatacatgtgtagaacgtgcagttttgttacataagtatacatgtgccatggtggtttgctgcacccatcaacccgtcatctacattaggtatttctgctaatgctatccctcccctagccccacacccctcgacaggccctggtgtgtgatgttcccctccctgtgttcatgtgttctcattgttcaactcctacttatgagtgagaacatgtggtgtttggttttctgttcctgtgttagtttgctgagaatgatggtttccagcttcatccatgtccctgcaaaggacatgaattcatccttttttatggctgcatagtattctacggtgtatatgtgccatattttctttatccagtctatcactgatgggcatttgggttggttccaagtctttgctattgtgaacagtgtggctataaatgtacatgtgcatgtgtctttacaatagaatgatttatagtcctttgggtatatacccagtaatgggatggctgggtcaaatgatatttctggttctagatccttaaggaatcgccacactgacttccacaatggttgaactaatttacactcccaccaacagtgtaaaagtgttcctatttctccacatcgtctccagcacctgttgtttcctgactttttgtttttctttgttgttgttgttgttgttgttgtttgagatggagtctcgctctgtcacccaggctggagtgcaatggcactatctcagctcactgaaagctcagcctcctgggttcacgccattctcctgcctcagcctccccagcagctgggactacaggcacacaccgccacgcccagctaattttttgtatttttagtagagacagggtttcactgtgttagccaggattgtctccatctcctgaccttgtgatctgcccacctcggcctcccaaagtgctgggattacaggcatgagccacagcgcccggctctgttgtttcctaactttttaatgattgccattctaactgacgtgagatggtatctcattgtggttttgatttgcatttctctaataaccagtgacgatgagctttttttaatatgtttgttggccgtataaatgtcttcttttgagaagtgtctgtacatatacttcacccactttttgatggagttgtttttttcttgtaaatttgtttaagttctttgtagattctagatattagccctttgtcagatcaatagattacaaaaatgttctctcattctgtaggttgcctgttcactctgatgatagtttcttttgctgtgcagaagctctttagtttaattagatgccatttgtcaattttggcttttgttgccattgcttttggtgttttagtcataaagtctttgcccatgcctatgtcctgaatggtattgcctaggttttcttctagggtttttatggttttaggtcttatgtttaattctttaatccatcttgagttaatttttgtataaggtgtaagaaaggggttcagtttcagttttctgcatatggctagccagttttcccaacaccaattactaaatagagaatcctttccccattgctggtttttgtcaggtttgtcaaagatcagatagttgtaaatgtgtggtattatttctgaggcctctgttctgttccattggtttatatatctgttttggtaccagtagcatgctgttttgattaccgtagccttgtagtatagtttgaagtcaggtagcatgatgcctccagctttgttctttttcttaggattgtcttgactatacgggctcttttttggttccatatgaaatttaaagtagtttttttctaattctgtgaagaaagacaatggtaccttgatggggatagcattgaatctataaattactttgggcagtatggccattttcatgatattgattcttcctatccatgagcatggaatgtttttccatttgtttgtgtcctctcttatttccttgagcagtggcttgtagttctccttgaagaggtccttcacatcccttgtaagttgtattcctaggtattttattctctttgtagcaatggtgaatgggagttcactcatgatttggctctcagtttgtctatgattggtgtataggaatgcttgtgatttttgcacattgattttgtatcctgagactttgctgaagttgcttatctacttaaggagattttgggttaagatgatgggattttctaaatatacaatcatgtcatctgcaaacagagacaatttgacttcctctctttctatttgaatatcctttattgctttcttgtgcctgattgccctggccagaacttccaatactgtgttgaataggagtggtgagagagggcatccttgtcttgggccgcttttcaaagggaatgcttccagcttttgcccattcagtatgatgttggctgtgggtttgtcataaatagctcttattattttgagatacgttccgtcaacattattgagagtttttagcatgaaggggtgttgaattttattgaaggccttgtctgcatctattgagataatcatgtggtttttgtcattggttctgtttttgtgatggattacgtttattgatttgcgtatgttgaaccagccttgcatcccagggatgaagctaacttgatcgtggtggataagctttttgatgtgctgctggattcggtttgccagtattttattgaggatttttgcatcgatgttcatcagggatattggcctgaaattttctttttttgttgtgtctttgccaggctttggtatcaggatgatgttggcctcataaaatgagttaggaaggagtctctatttttctattgtttggaatagtttcagaaggaatggtaccagctcctccttgtatctctggttgaattcggctgtgaatccacctggtcctgggcttttttttttttttttttggttggtaggctattaattactgcctcaatttcagaacttgttattgttctattcagggattcgacttcttcctggtttagtcttgggagggtgtatgtgtccaggaatttatccatttcttctagatttttctagtttatttgcatagaagtgtttgtagtattctttgatggtagtttgtatttttgtgggatcagtggtgatatcccctttatcattttttattgtgtctatttgattcttttctcttttcttctttattagtctggcttacagtctatctattttgttgatctttttaaaaaaacagctcttggattcattgatttttttgaaagggttttcatgtctctatctccttcagttctgctctgatcttaattatttcttgtcgtctgctagcttttgaatttgattgctcttgcttctgtagttcctttaattgtgatgttagggtgttgattttagatctttcctcctttctcctgtgcacatttagtgctataagtttccctctaaacactgctttagctgtgtgccacagattctggtacattgtgtctttgttctcattagtttcaaagaacatctttatttctgccttaatttcgttatttacctgttagtcattcaggagcaggttgttcagtttctatgtagttgtgcagttttgagtgactttcttcatcctgagttctaatttgattgcactgtggtctgagtgactctttgttatgatttccattcttttgcatttgctgaggagtgttttacttccaattatgtggtcaattttagaataagtgaaatgtgttgctgagaagaatttatattctgttgatttagggtggagagttctgtagatatctatgaggtctacttggtccagagctgagctcaagtcctgaatatccttgttaattttctgtctcgttgatctgtctaatattgacagtggggtgttaaagtctcccactattattgtgtgggagtctaagtctctttgtaggtctttctattggtgatggagtaacaggttctgctcataccattgtggtttgttgcctatgatcataactaaaaggaatgctacatttcagttagagatgacaaaaaataaaattttaaatttctctccaagtttctggacctcctaaattctagcttaagttcccctgatataggatcaagctacatggtgacttgtaagttcttggagggcagatattatgttccaaccacttacatagttgaattctgttttttgttgtggaaaatgtcaaatatataataaatggaacaatatgatgaacctttcctaggcacctatgaaccagcttcaactattaccaactcacagccaatattgtttcacctatacctttacccacttcccttcctgtattattttgaagtcagtcttagacactggatcgtttcatcccatactttgacttatacatagtaggtgggccattacgtatttgtggattgctgatggcttaatttagaaaggccatttcaggtgcttgcttccagtgatcatgggtcagtgtcccagaagtgtggactggggtcagagaatcccctccctgtcctcagtcatggtctattccatgcttcccagcacatacctgatgctgcattagttatttattcatttccacatctattttcagtctttttccactgcagtgtaaatttcatgaaggaaaagactttgtctgcttgtccactgcatcgccagtcccccagcacagtgcctggcatatagtaggtgcttagtaaactcagtacatttcgaatgagtggatggctaggccccctgaattgaaagtgaatgaggaaagggaagttatggagatgtatgctatttctactcaaaagtagggtccctgtaccacagcatcagtatcttctggaagcttattagaaatgcagaatctcaggccccacgccagatctactgagtcagaatctgcatttaaacaagatttttaggtgattctgtagttacataacagtttcaggagccctgctttgccaccttaacctgcaagggagagaatgacaaccaggaagagctttccgctgacttccaagatattaccaaccaggagggcagggcagggcaaaggaatgcactcatttgtgagttagggatcctagttttgaagtttggttctctgggcctcagtttcctcatctgaaaggtgggtgaataagacattgctgcaagggttatgggaagattaaatgaggcaatggctctggtgtgaagtacagagcaggtcctggatgacttttttttttttttttttttttgacagaatttcactctatcacccaggctgtagtgcagtggtgcaatctcagctcactgcagcctctgcctcttgggttcaagcgattctccagcctcagtctccccagtagttgggattacaggtgcatgccaccacactcagctaatgtttgtatttttggtagagacggtgttttaccatgttggccaggctagtttcaaattcctgagatcaagtgatccatctgccttggcctcccaaagtgctgggattacaggaatgagccactgtgcccagccctgtatgactcttgaactaattccacatggctgtctttccaaaatatgaaggaatgacatttgttcatttttcaaatgccatttgatatttttgacttctgactccaaacttgttctgggaatcctcccccttctgtttaatcataactgtggagagtgcttggaaaaagtgtgaagtgtgaggctcacctttggtgctcccagccattaacttctgtaccctttctccttttctgggatatccttctccctatggggcatcacagaccctcttccataagatcctgctcccaggcaaaacagccaagatcacagtcacatagcatttcattccctgagaactgggggtccttgatggtagaataaaattgttttccttgatgtaggtatcagagggctagtgggggaattttttaaaaacccaaaacattttgcatgtgcatgccattgaggaagggacttcccagccattgaaatattataacatcccatggataagtgcttgctttggccttgggtgttaagagttctgatggtcacaatcacttctttgtgttggagccatggaccaacaaggttgggtcagttcagctcgagaacagttggacagattgaggcacttcttacttctaaactcacatttggctgttctaatctggacgtattcaaaacaactggctgaggcagggaagcggaactgaagctttttaatgcttacagggaatattgatagcccaggtgaatgctcctcaccccttgcctccaaatactccccagccttgcctcacacatccattacatgatactctgtgtttacccggggcttgtcccaacagaacttagtaatcctacttctatcttggtctggctgtgtatttacatggtaaacatttctacaaaagacagggaaatattcacttcaaaataccctataaaaattgccctttagagatgagtggataggaaaaagcaaacatttcatatttataaaatgaatcatttttataaaaatgttactcatagaccaaaaacttaataatattgttggtagcacagtaatacttgtataggtttgtttcgcattgtagagatatatagatgtattctttcatatacataatttcatctaagcttctcagaatccagtaaggtagacaccattatctctagttttaaaaatgagaaaacaggggcttaggaaggttgtataaatgtccagtattatgctcctaggcagcctgaagataaggatatgaggctaggtcttctcagtcaaaactaaatgcctattggcatatttcagccaagggtaccttagaagccagttgtaaacccattggcacacagctgtctcaaagtatctgtaccattgagtgtctaaccaggaaaatgaaactactgcagatatttcacacagagggaatttaatataaggaattggctccactggtgatggaagagctgagaagtcacacagagaatggtgaggtaacctggagtttagcaatggtagtaacctgctacctctctcaagctggagggacatagggaaggggccaagctaacagaacctaagggctggtggcactctggaaaggctggaacaatggtgagccagcctggagggagtggaaaccccagaggatacatggccatggtctctaagagggaagggaggaaataccctacctcttcccttcctcctgccctccaatctcctctgggtgcctcctcttggctgagcccagccaagcccagcccagcccagctagaagccagtagacctgggatatgcagcctgcaggggtaagcaaagcagtagaaggtgaggaatggatctaggggaacaggcccagggcagcacagcatcttttattcctaggtatgggtgaactcctggaactaggtttgtgccattgaattttcctcctccaaggacccctgatttagcctgtttctttggtgacacctacctcctagttgcctccctgacccacctcaaacaggcttgacagcaatccgtttttgaccactttctgggataaaaaaggaagagctcagaagtttgtaaaggtgagagaaagtggtttagatttgcccagttatgcatttgagacccagatagaaactcctgttgattttgggacacaaagaccaaagctccagtcattcaacaaagggctgtgtcagtgaatatcttggcaagcagatgtcaaaaagagcactgccaaatgtcctgccaggagaactggtttggcaacaagctgatagacccaaaggactagaatacaccacccgttcttcttctagatactacttaatcagctctgattaaaataataatttcaacctttgttattttgcaaaaccctctcccaatttgctggattttgcaggactgttgtcttcctctatccactgccctccctccacccccaggatcccgctttccatagatatttctctgttaaaggtaagtttgtttgcaggactttttattgctgtcgttcattccacaaccttctatgtagataattggagatatctgatgcccttaaactaaaatgggaaaaccctggcggaagaaaaattgtgtctgtggttcatagcagttttgcaaacttttatcaatgaaaaaagaaactcatggttatttgggttcatgattgcgatgagataaaagggaaaccctacacctcattcagggttgggtgcacaataggttctcataaaagaaatgctcgctgaatggatgggaacatgcaaaatgtacagtaccctgttcattccctttgacaggtgcctttttgttttaaatacacatggcagcatttgatagcatgcaactaatgccttggagtttttctggggacttaataaagcccaaatagtaaaaggtcttcaaggttttgtttggtttcttttaaggggttgctacctctgtcctctgtactgttgagtttatgatgaatttgaggcttatgtgtatgttgagtcactttatctgcttgatcacttttatattctgtagctttaaatatttattatgcaagctttcagagaatgacataacagtcatgtatcaaccattcagttctaccaaagctaacgtttctcccacgcctgctttctgtttaaagaaataaaatgttagttagaattgaaagcccctgctttcccatcctaatctaattctgtcctttccccagtgttaacttttattctaacttttgtatttcctcacctcgatatgttttaatattattactatgtatgtatatattcaataatagtattaacatgtttttaaattttgcagagctcatataatgtatgtgtcattctgtaacttgctttatgatttaaacatatcgatacacatggtgtactgtattcatctttaactgccctgaggaatgctattaaaggaatacagtacaatttatttatgcatgctcctattgatgggtatttaggttacttccaatttcttgctcctgcaaacagtgctgccataaataattatgtcaaatgtccttatggcacatgggggaaaaggtctctagggcagtggatctcaatcttttgtacacatcagaattgcctagggatctttgaaaagtcccactgccaggttgcacccagactaattaaatccgaatcactaaggtgaagcccaggcacctgtatttttttaaaactccccagatgattccaatgtgctgccagcattgacagccattgctttaggtcacataactagaaatgaagtttctgggccaaaatgtttgttcctcttcagctttctcgatattaccaaattattctccaatgtggtctttccaatggaaacgccaccagcagggtatgagatctcctgtgcctgtggcattatctcctcacctaaacttgattaatcttgtccctgcagggatctcaaagggatgtgtcgagagatatccctttgatggccttcccacacctgcctctatctgatttatcccctggtaaaaattttgcctcgcccaaaagtcatggagtaggaaccgttctcacaaagtataactaaaaacttggggcatccaacaccacctgattttgcaattcagggtgttgcagtcaagaggttgttgccattaattcttgtttgtatagtctaacattcatttcgtggcgtgatgtggtgcttatctgtgatatctaggtttgggggtagaaaatgacacaagccttgttgctatgatgttgctataccttccatttagccacaggtccaatatgatagtgccctgagcatctggaaaaacaagatgctcagcccaaactcatacttccatgatggttagatcagagttattgcggagaaacaacaaagagatcctagccttgaccttaatcaagctatagctgtgtcgaaataaataatttctagccatgatgtcctctctctttggacattgtggacacttgagtgaggtttttttaagctgctcacatgctgaaagcttatgttaaaccctctccctgtgttgatgcagatttagaaaatttcatggataaaaattgatggggttacaattgttacccactttgaatttaacaaccttaaacataatacagtaaacttccctcatagtatgcaagtaaaatgccatgccatgaagttgatgaaaaattgggcaagtcttcatagctacctggccaggagttccagaagtctgactgtgtgatcaaaatctgttctagcactggctgcagtttctggtggcagtggacctctctggcttaaatattcatggggatgattctgggtcctatggttggctaggatactccaggaatctcctggagagttggcactctttcattggcctatttggggagattgggtcagaagaatactggggactcagggacttactgtcttcctccctgcatcacttgctgacacagggttgcctgccatttcccagtccagcctcaccttcccctacacaattctatccactttcccctaaatagaagtttattttgcccctttttgaaagcacaacccaccactaactgcattaaatccagaatcttgctatcatgggtgacttattgcagggttttactcttgaacttatctttgcttccaactctgtgtcttggattgggttcccgagagacagcacccgacacagggattctagtgcatgtgatttattgggagagagttctcgggggaaacctgtaagagtatgaaggaagctgaatggggcacaggacactgctgagctggaatgtggtctcatatggagcctagctttgcttttatctgcagggagagagcttttgtcatgggaaaggagtgacttaccttccaggcaaggtggctctcatcggccaaggagaactctcctgagaagtgagtagttgtgagacactagcagccaccactcacagtatctggagaatagctacacaggcttggtaaaggggatccgggtggggcaccctgtcctgggtgcagggctctgaaaggagatgaactttcagctctcacacattgccatgcagggctctgaaaggagatgggcttcatgtggatagtcaaataacaagcatgacatccatgggtatggagtgctataaaatgactatgtttaataatgcgtctttcttctggctacaggtctgagtatattttgctgttttaatcttaatcctggaattgagtctgggacttcctccgtgcctgtaaaccactttgatgttatgttgagaagcattctgaggcacatgtgtgaactgataaccaggataagtggcatgatgaaattaatcccctagtagatgggaaaggaaggccagtgcctttcccagtctgggcttctagagatgattcacaagctggggctttaaggcatggagaacaaacagtagacacaagagtgttggatgcaattacttccttaagccataaagctggagaacccagatgattgaagtgaatgtttgttaggctgaggtcaggtttgattttgctgggagccttccttgattctgattgtgtcttatcatttgtttgtcttctgaaggttgtggaggaggagggaagggttcatagaaatgccctggctgtgatcccattgttgctggttgtaatgtctggccacgtttcctcctgcggtgtctgattggaacttccactctgatcaagcagcaggagcaataaatagctaggtctgtgcctccttttctatgtgaagctagggaaaggactttatgagctttaagcggtaacttgatggaagactttacgcctctgcacatactgtcagatgctccctcagaagagaatgacaagggttcaaggtagcatggagtagggacaagtgtgtgtggcttttgcgttaggcagactggggtttgaatcttgattccagtgcttatcagctgtgcgaactttcttagttgagtcccttacctgctcccagactcaattgtttcacctgaaagtggggataatagtacctgttttaaagggttatttgagagattaagtgaaatagtgttgtgtaaattgcctgtcattgtaaatactcaataagtgacatctattattagagctttctttaaaagttgtgctgcatttctgatttatggggaggtcagaatagaccagagctaatagcccttcttgaggagatcaagaaagggatcaggccaggcagggtggctcacagctgtaatcctagcactttaggagattgaggagggaggattccctgagcccaggagtttgagaccagcctggacaacatggcaaaaccctgtctctagaaaaaaaatcagccatgtgtggtggtgcatgcctgtgggcccaggctgagatgggaggatcacttgagcatgggaggttgaggctgcagtgagccgtcattgtaccactgcactctagcctgggtgacagagcaagaccctatctcaagaaaaaaaaaaagtggggggattaggatatttagaaggacttacttccttgagaccatagccaaggtggaaataagagaaggtcaaggtgtgtgggtggggcccgcacagtggctcacacctgtagtcccaacactttgggaggcagaggcaggaggattgcttgagcccaggagtttgagaccagcctgagcaacatgggggaaaccccatctctataaaaattagccaggcatagtggtgggcgcctatattctcaactattcaggaggctgaaatgggaggaatgcttgagtctgggaggtcaaggctgcagtgagccatgattacaccaactgcactccagcctgggcaacagagcgagaccctgtctcaaaaacaaacaaacaaacaaaaagatgtgtgggctgggtaacaacaagtcttgaatgttccaggacggtgatgatttcagatattccctttcagcgagaaaccaagtatatagatttggggttcatagaaaacatgatcactatccttgtgagaaaatgcagctctaggccaacttgcttgggaatattaagagtctttggcacatcttcaaagaaaagtttccccatggggttacttctgacgtttatgcttccagtttcaattgtttggtggagagtccattgaactcagttaattctttttatttacctcaatgttcgatatgacaggccaacattttaagtgctattctaaattgtagcttgtgtacactcgggaaaaaagggcctatttgtctcctcgggtctcctccatttttttcttcctgcattggttaatgttcccttctccttgttgaatatttggaagtttccttccaaagcttgggaggggctagtttcacaggaaggtcacatgaacacgatctcatgggcagttcattgactctgcccagctttaatctctgcggttggagcaggagagtgaagggcagtggacagacactgccctctccctctccatttattctcctccttccatgccccttttctgcctggaaccttctccatgctctagttaacaaatgtgcatttcagcattcaggctgaaactcaactgccagcacaaggcaagtaatgccatttgacttaagaacaatctgcatttaagaagtcagggttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaagtcagggttttctagtctgcccgatgcttctgctttagaacaaattaaagagggggacctcagcccatctttatatcccagctttatccatttacctgtcagaaacacaccctgttttcctttgagtttctctacatcccactttcaactcttccctctcttgtgcctccagtatcctgagtctacagttcccacctccatagctcccaatgcacacagtgaacatcctctttaaaaatgacctaatctttctagaaccttaaggctggcaaagaaaaaaatatcaatgcatcccttgccttcctggcccttataaatttttaaatgacacaacatgtgtttctagaagggaaagtgttatttgaattcttgggttttgccctggcaatgatgggcctattaacctcccattaacattggctttttgatgatggccaaaccattatccttttcatttcactttttaaaattactgcttgattacagtgaaagtgttgtataaaaatggtaatgttggagtgaggatgccccactttaggacctcaagatctcagtgactttattttgcttaaagaaacattgatatggtacttactatgtgtcaggtcatgtcctgtgtgctttacagctacaaacccacttaatccatatcacaatcctatgtgatatagactactgctatcttcattttacagatgaggaaatagaggcccagagaggtcaggtaacttactcaaggtcctgtaaaatgctggggtttgaacctactcattctggctccagagtcccagctcagaaccactagcactgttttctctctgttgaggattatctgggacaccatttctttatttgtacaatgaaggagttgaaatgtataacttctgaattcattccaggactaatatcatgggggacagtgataatttcagggtgttttgtaggccataacacctggcttttataatttttgtcctgatccatgtgttgaaataattattttgggtaaaatattctgtgcatagctcttaagtcccatgcccagccattctgtgatcccaacattgaggaggagaaacaacccttgaatgaattgacttcccaaagcacattccaagacccaccaatgcagtgccatgtttgaaagaaagggttccccagacaggaagtctgggaaacactgcatatcacatctcacccttttcaggaatcatagtacactgaacatattggaggaacctagttgttctgcaattgggaaaccaattcaactttgattattcaagtgtttaccacccttgtcttaccaggaaatctactctttgagcagcattttattagcatcccctacaaccaggcttctgaaagacactaggggcacactggctgacacatttttataagtggtttctacagcttttaatctgcagagatgcgaaagttttactcttttgtgctggtacccatctgtgtatatatagctgtataaatattaggaacaacaggagtcttctgtaaaaagatacatatctaccacctcttgagattctcagctaacaagatatgtatacttctcccacagccatccttatggtgaaaatattcacttaaatacaaactgtacatgtaaagatgtgaaattgaccctcaagctgtctctctcttcacagttccatgccagctagagaatgtggtcaaacgttgactttctctcaccctcttcttacatcatcttttcttcccatatattcttgggctttttctgtatttatttcctttggctttccatttctattttcccctccttcctctacctttcataattcccaaagacaaggatgttcaggagagagaggactggcagctaacagaacaatgtccctaaacactgaggctgggtcaccacatgtggcaacgcagtgtttccatttgctgatttattatttttacaatgcccacttgcaaaaagggtttctttactccacttgctagttttcttttatggtgtgtaattttgaattaaaaaattaaaatacatgtacactgttaaaaataaaacctaactctaaagaaaggaataaaataaaatgaaatgtgaaagtcttcctctcccctgagttctagtcttctctccaaagataaacactgctaacaggttcatgtgtatcatttcagaaaggttttattcaactacctatgtgtgtgtgtgtgtgaatatatatgtatatatatataatgtaaataaatctatctcatactacacacaatgttcattatcttgctttttagttgccttaataacaaaccttagacatctttctagttctaaattagctactcatttttttcatcagatgcagaatatttaaaactttataatatattgaaccagtacccaatgacagatgtaggtttttccattttctgctatcaacattgctgcattgtgtattcttttacatataatttggcttacttttgcagctatgtctgggagtaaattccatacagtggaattgccagttcaaagggtggtatgttttctaactggagaaaagtttgccaaattgccctccaattaggttgcaccatttgtgtttttaccctgtgtgtatgagaaccttcttccttccaacctgcaacaaccttaggtattaccaagcttttaacttttgctcatccgaaatagctgatacaagttatatttgctgatttaaaatgacaactgtcattttgattgtgatttactttacagaatacagattacgccttcttatttaatctgcataatgaatagtgacaccgggatcagtgttttttttttttttccatatgaggaagcagaggctcaaagagggaaagtgacttgcccgagccaagcagtgagagaacagagaatcaaaatcaggtttcctgactcaagattgattgattgactgatttttctaaatcgcactgtctctccagcaggggtgagggtgaaaatattgtgtggatatgtgtgtgtatgagtgtgtgtgcatgtgcctgtatatgcatgtgtgtgcttctgtaatggggaactggggcctgaggagggaagatgactgaatgtaggatcttttcccttcttctctccactagtcccccttaataccctgaaaaagaatcacatttgagcatcaggtgctttcttcaacatgatcagatttaattctcacacccagcatcattcttcctcatctgactctcggccaaatcctcactttgtggatcccacagaaatagaactgaggaatatggaaataagaggccatgtgtgaaatttaagttagagccaagtcagaactttgtcacctcacatttctaaagcactcagtcctagaatcggcacccacaggctgcttttcttatctcttattcacacacaccccacttaaagtcaggtgcacttggctgggtgcggtggctcacgtctgtaatcccagcactttgggagaccaaggtgggcaaatcacctgaggtcagaagttccagaccagcctgaccaacatggcaaaatcccgtctctactaaaaaatacaaaaattagccaggtgtggtggtgggctcctgtaatcccagctactcaggaggctgaggcagggagaattgcttgaacctgggaggtggaggttgcagtgagccgagatcacaccactgcactccagcctgggcgatagagtgagactctgtaataaataaataaataaataaataaataaataaataaataagtaaataaattcaggtgcacttgtcctgatggtactgagagacttcagggacttagaatctttgcctctttctccttgtgactgttggtaattccttgagagagagggtaactacagaaatgtctgccttttaaattctcaacaagatagtggattggcctctagcatctattctcacatccttccagcatatcttcctataatatgctagagaggctggaaagctagaaatgatgtttttcagactcccttgcagctaggttccagttggaaagtagattttgttaagtagatgtagctacttaatccactggcagatttttcaggttcactggcttctagggcataaatctgtgacatatcttctccctggccacatttaaggctggggaaaaaaacaccagtcagattagatgactaatcttgctaaaatggagtatagtttgaaatgtctacttttcagattccttactaccttttgtagttgacagatttttttccagtctgtatctgggttgtattacaatcccattggccagtcttattaggcttcttgctaaagcaaacaatccctaagtagccaacaaacaaaaacaggacaaaagtttctactcttcctttgtaaaaggtgacatcttcagatgccatatattatgggcttcataaatgtatacttagttcatggatcattaacaatcatgaaatgagtggagagataatgttactgatgttttgacatctggggtatttctgtggtgagatattttctgttgtaacttgggtgctcctgtgaacttgtctgtcacacctttcccgcccttcacttgtgctggagttttgctttgagatggaaaaacacaaatacctaaaaaaacatacctcaccccactgtaatgaagatcaaagtgaaaaaatgaagaatggcaagacatcccaggtgtgtttttaaattcccagaaaattttgcctctggggattctccgtgcttcttgccagaaaaggttttcccttttagaacgtaaggcactgttgcttatttttcagttacagatggggatttttagtaaagacctggccccctctcaccattgtttacccgaggtgtctgatcactttctttattggcatattgcccaagacatagacaaaactgctaaagggttttggatgcattagctgagcaaaaggtgtgtgttcctctgtctctagagcacaaatttgattagccctttttattaggagtcaagaatgacattcagtcttaacctagctcatctctcacactgtggctttggtgtttcaccttctttctctgaaagatgggggcaagcatgataaaggacagcatttcttgggtgtttactctgccaggcatagtgctaaagtgttttgcatatactatctcatttaatcctcatagtaagcctgaggttgttattgttattattattattttggaattgtatattttttcattgaggcgaaatttgcataacaaaattaaccattctggaagtgaacaattcagtggcatctagtacattcacaatggtacaaccattgtgatgaactatggtacaaccatcacctctagttctaaaacattgtcatcaccccaaaaggaaatcccatatctggtaaacagccaccccaccattcccatttcccccagccccctcccaccaccaatctactttctgtctctatggatttgcctattctggacatttcatataactggaatcatacaatattcattcttttgtgaccagcttctttcagttagcataatgttttctaggttcattcacattacagcaggtattagtatttcattcctttttatggcagaataacgttccagtgtatggatataccaccttttgtttatcttttttgttgttgtttgtttgtttgtttttgagactgggtctcactgtcacccaaactggagtgcagtggcatgatctcggctcactgcaacctccacctcccaggctcaagtgattctcctgcctcagcctcccgagtagctgggattacaggcatgtgccactactgcccggctaatatttgtgtttttagtagacggggtttcaccatgttggccaggctagacttgaactcctgacctcaaattatccgcctgcctcagcctcccaaagtgctgggattacaagagtgagccactgtgcccggctcatttttgtttatctattcatctgttgatgtacttttgggctccttctaccttttggctattgtgaatagtgccatgtgaacatttgtgtgtgtatttgcttgagtactagttttcatttcttttgggcatatacaaggaaagtcagcatgtggaagtgtgggtacagagaaggtaaggggttggagataggattcaaacccagagccttcatgtaaccaccatgtggtgctgcttcctataatacagcactgtccctggaatccctcttagggaactagcttataacaaagtctctttagcatttggtaatgaaagtcctgcaggcatgatggggttcaggtagaatccctttaaagtatcagctgctctccagcaaatggtggtgttgggaggcattcttctttattcttgaacttcaggtaatagttacaagtaatttatttatttatttatttatttatttatttatttatgagacagagtcttactctgttgcccaggctggagtgcagtggtgtgatcttggcccactgcaacctccgcctcccaggttcaagtgattctcgtgtctcagcctccagagtagctgggactacaggcacccgccatgatgcccagctattttttgtacttttagtaaagacgaggtttctccatgttggccaggctggtctcaaactccttacctcaggtgatccacctgccttggtcccccaaagtgctgggattacaggcgtgagccaccacgcctggcccagtagttagaagtagttttaatctctatggcatgttactcttaaaaaatatttttacctagggttttcatttggccattataacaaccatctgaggtagccagctttataacttgcatctccattttacaaatgaagaaactgggactcagagaggtcaaggaacttgctcaaggtcacacagcttaaaggtagacaatccagggcctatactgggtcttctatggccttgttgcctctccacttagcaataagaaatggttagaaaacaggcacatgcaaactgccttctttacatcaaaagctagttgtaataaaggagtgaagttttatagctatcatgccataataatggtaacaacagcagccacaatagtagcagcagacaattccagcgtctctacattgtgcttatgcagcaaatataatccagcacacagtaactttctactaacattttttaatcagttcactttagtatgtggaataagcatcataaaagctctcaatcctgaaatgtgtaccctggtctcccagggtctaccttgaagtttatccccgacagttgttcatccttggtgaccttaccgttgactacaactagaaactgttattttatttctctttttcagtgtctctttctatttcccactatctcagatcatatgaaccatctcctgttttgtagttaagcacctggaagtgaaacatcaagtgagcagaaagagctaggcacagaattctgggtgcctttctagaactttccaaattgccttgctttcccttggagggctgagcccaccacacttctccctgagtattggtcatgggcctttacacagcctcccagtctaggtctcattccacctcatgaatttactggtctgcagatgcccacctcctgctttcttgttggaatatttgttcctaagatgtcacgtgaagatgatttcagtgtgaaccactgctagtgaacaatggggaaagcattgcttcccaggatggccaatacatacccatgcccaaggttagcactattcctatagcagcagctgagctggtacttaagtagtgaggttataaatcgagtggtgaggctgtttagattttcccaaagtagcctgggtggctggtctctccatttccctttatccatgagggatggttctgtctttctgattcagacattgttacatgtaaaaataaactccagccttattactctgacattttatatctggacattttttgatgtgggcataaggcttcgtggcctatttaactgaagacatagatttatttactcatcaattctaaagcaatattctccatcattcagtttcatagatgagggctttattcatttgaccagcctcagaaattagccatatttggggttaaggaaaaataaggaattgaggctgatgcacaagagattgtccctggttgtagatggactggctggctgcagaattccagttctgtgttcagccatgggtggtgaggtgggattgccttggccttaagctctaggagattaaatgtacagcaatttcctgaagctgagttatctctaggaagagagaagctgttctggggccttaagtcaccttacttgtgggtgggcaggatgtgaccttggctgggaggccctcatgcctgccccctctagctctctataaaccacttactgccattgaagattaagggaagagacaaatgaccatagcctgcctgccacctctttgttttctgatagtgggtgcagttgggggctggaggggctgagcaccaccgtaggtctctccatagtgatttctaggcactcttctgcccctgtcacatagtataggaacttctcctgaggccagtcagaatctggcagaactagtgtattatttgtttggcattgtttcccaggcttgccagataagacagtcacctttggaggctggcagtgggatggggagaggtttgttcatgataaaaaaaagcttcttaggcccttcctctagagaatttgattcaatagatgtagggtaggtcccaggaatctgtattttaacaaaccttgtgttattcctagtgccaggcaagcttggaaaacactggcttacagtaagaggttttgaaatgtgcaatcccatctcttgtcttcttttcttctgcagtatttttcccttttctgccttggtggcagatgctcataagaagatgactcgtatcccttggatcttaccacttcagtgtgctccagtgggatttccatctatttacatctcattgccttcctggggactcaggaaggagggatccatgagggatggttctgtccttcttattcagacattcaggctggaattaccccaggagcagccctcaaccaggacacaagaggagttggtgtataaataccccagctccatcacctctcagctgggataaatctgagccatgtcctgcaccatttcccagaatttcccagtgggattaaactctagtcatgcacagtaatagtatgcttgacaatgcactctttataggctgcctttccttcctgtctcacttacttgcttctatatttccttacgagcatttccttgcctctcaaataaactacagtcagttctgctataacatgacaaatgagtttctagaaaatcaccatgctatgcaaaattatgcaataaaaaccacagggcttgtgggataaatgagattagggggcacaacacttaaaaacgtagtgatatataaaaaataagataggaacctaataaaaattgtagttttacacataatgtatgttttaaaaatgcataagtacaaaaatagatatggcattttacctagaaaaatccctgaaggtggcttgtggaagtggtcattggaagagttgcagcttgtgacttaccatgcaagagtggaaggaaggtggtcagaaacccgaaggaaaattttaacaccagatatggatggttgtggcttctaaggtgaactgaggtagctggtcgatgttcaaggtgtgtgtatgtgtgtgcattttgtaaatgcagctcaattcagctgggtgcacttttctgtgttcacctactatttctttcagacaaaatggcacataagcaaatgtgaaatttgcatgatgcccaagtcatttcctaatgtatcagtcacactggaacaaatttttgtttttaagacaagcgtttagagcagaattttccatacttgtactagtgttcttgttgcagggcttgcttctaaacctagctaaaattacctatcaatgacagcttgatggtggttttattttttaagtggccctttctcctgttgaacaaggctgataagcaaaacacaagccccttcacacccaagtaagttcagtagagactgtggctggatataagaagtgacaacttaagccagaatgtccctgttggaggctctgcactccaagttacctggtctcacctactcattttcttgtaactcacctggagactgcaaccctgttttacaggtcttgagaatcttggctgcctatttacagtttcttggaacgggcttaaacctaaaatcaaatgtcagattattacgagctgaagcagaattctgtaaatgctcggtttcttcattaggggaaaaaattaacgtggaaccttggtagatatattactcacctgcattcagtgcttcccaggaggtaaaattacagtatgagctcagtgcattcttaatttcccatggtaggttacaaatgggctcttttctattctacaacttctttaatctcaataccttatttctcccacgtgtagctctacacaatcaagcaacttatacaccacatggctcatttgtctaactggttctgctttggtttcaagttcatgctttctataaccttgattttgacctgggtgtgcatgcaggctgcaagttcaatgtttttcagaatgtggacttcagatcaaccacatcagaatctcccccagagagcttgttgcaagcacagcttcttgggctccaccctagacctcctgaatcaaactattttgagagtggggctcagggatctacattgttttctacaagctattgggtgatgcttatgtgcactcaaggttgagactcactggtttcgaccagtgggtctcaactggggccagttgtgcaccacaaggggacatttgacaatgtctggaaatgtatttggttgtcacatctggagggaggtgctactgcctaagtaagtagaggccaggtgtgatggttaatattgaatgtcaacttgattgaaggatgcaaaatattcttcctggatgtgtgtattagtctgttttctgctgctgataaagatatacccaaggccgggcaatttacaaaagaaagaggtttaatggatttatagttccacgtggctggggaggcctcacaatcatggcagaaggcaaggaggagcaagtcatgtcttacatcagtggtgacaggcaaagagagagcttgtgcagggaacctcccctttataaagccatcagatctcatgagactttttcactatcacgagaacaccatgggaaagacctgccttcatgattcagttacctcccaccaggtccctcttccaacacatgagaattcaagatgagatttaagtggggacaaagccaaaccaaatcagcatgtctgtgagggtgttaccaaaggagattaacatttgagtcagtagactgggagaggcagacctatccttaatccagtgggcaccatctaatcagctgccagcgtggctagaataaagcaggcagaagaatgtggaaggacttgacttgacttgctgagtcttctggccttcatctttctcctgtgctggatgcttcctgccctcaaacatcagactccaagctcttcagcttttggactctttgacttacaccagtggtttgccaggggctctcgggcctttggccatagactgaaggctgcactgttggctttcctacttttgaggttttgggacttggactggcttccttgctcttcagcctgcagaaggcctattgtaggacttcaccttgtgatcatgtgagtcaattctaatcaactccccttcatctatacatatatctgttagttctgtccctttagagaacgttgactaatacaccagggatgctgctaaacttcctataagtgcacaggacagcccccaggacatgtaaatggtgccaagtttgagacaccctggtttcaaccctgagagatttctccaaggtctgctgcacttatagggctgtttcctttgtcattattttctttggtttctctgcaactggatggcttagaagcaacaaagttctctggataagcagaaatgtgtgggggggcagactggcagctttatgtgggtagaatcagggtcggtatgagtgatcactgactccttgaaagatgccttccccagaatccaagagttgaactataaatcaggtcagcttaggtcatcctagagatgaggggcccttgcagatttggagcaaataacacaaatttggagaagcagaatgggcttttctttcagtgtgtgtggattctttgtcaaacatactcagttgttattacctgacatgtacatgatacagtgaaagctggccctattcatcacctagggcagtgcctgtatgacccttccatgcttcatgtgttactgacctgtgcttactaaaaactctgcaaatatcttctaaatcatcaaagaggggttagtgtgtttaataccatttcaacattgggagtattccattgtgccatgaatctttgaaaactggtaattcatgtataggataaatggtgattcaactgccagctctgaaattctgagtctatattatataccaaggaatatttatctgttttataagtctattattcagtgataagacttgtccacattatgtacaaagaaggatgttttgactgctaactagtgagattttacaagttcatgtatattattgaaatgtttttgtatatgctgtagcttgaatgtagaacctctttcatctatagcctgttgaagtctggaaaaccttttaggatcctttaaaatgactaaaatgttaacatggtttggataattataatgcttaacatctattgagcactcacacctgccagatgctcttctaagcactggacatttattttgctcattcaattctcacaacaaccctatgggatagaggtatgattattaccattttacagatgaggttaaatatgaaggacacgcagctagtaggtggccaaactacaattggaactcaggcagtctgggttcttaacaagagtattattctgcctcaattacttcaaatgtagtcaataatttgtcacatctgacttgaatcaagtgaaataatcattaagatgattttcctggtccagcgtagaaatgggatgcaagccacatgtataatttcaagttttctaggagacaaactgttaaaagatgtaaaaaaaaaaaaaaaggtgaacttaatcttaatagtatattttattaaccaacatatctgaagtactataatttgaacatgtgatcactataaaacattattagcattttacatttttcttttgtagtatgcctttgaagttctgtatatattttacacttacagcatatctcaattcagactagccaagtttcaaataccccaaagccatatgtgacaactggccaccatattggacagtgcatccttagctgatacttggtgagaagcattaggcttggagaactgagtttgaatgattttttgaaaggcaggaagattgttttccaatcctgcttatttagctcaagtcagagagaggccttaaatgtttttccatattttgacagacttcagtggctacttctttccagggtctggcttctgcaaatggacccaagcatttataccctcatgtgcacacatgcccctcctctgccaataaatattcttgaaaggggatttaacttacaacacacacacacgcgcacacacacacacacacacacacacacacacacacgaagaaaacactgaccatctttgttaccaatgtgttattttcattagattgaggagtgtacaggaggggagagatgtttcatttgtgcctgtgtgatatcttcctatgtctgcttgacctttcaacctccacatactgccaacttggccccagtgtaattcaaatggcacacacacacacacacacgtgcacatacacattttaacccaggaatgggaatatatggatctacagccttaaaagcaaaagcttgttgcatggctagcccagaactcaaacaaagctcccacatttgtgtcataatggcatcaagtttgatgaaagacatcagctcaactcagaagcatatggggctgctttaaagcctagaagagcaagtgccttttgggtatctgtctagtggaagacgtctgtccctgattgctggataaaatgcacagaggcgccccttgaacactcagaccaacaggaacattagccattggtattgtcatctttcttttaattaaattcatgggagcaagtggttcttctagaaaaacacaatcattgagaagcaacatactgcagtgagaagatcacggatgaaaggttttagtcttgacttttgccattaactagccatgtgaccttcatccctctaagcctttgaggtaataaagggacttgggattagatttcaacccaggatgcacattagagtcactgaggagtttgttgttaaatgttgatgcccaaatccaattctagaccaattaaatcagaacctctgaggttggagccaggttgagaatcactggattaaatgatctgtaattttcctctaagtcttcaatgctatagtgaatcacctgttacagatagtatagcgtattacctacttccaagccttaggaaggaaagtgtcatttgcattgtgtgcctcctattccttttgaatcagtcagggccctggtttcagggtgggaagtcaagttgggctgctatctgcctcaaaatcttcattcctaaggaactactagtattggggagaatgttagagggcttattgtgttgtaaatgggccctcactcttttggtggaaaattaggggaccagagagaaagaagaggaggatttaggtgtctaatttcaaatgctatttgtttgtaagagagagaaaatccatttattttaattcaatttcatttagttaggccctttccagtctcagaaatgatttaaggtatcaggggagaactaatattaggtgtctccattcctccctcctgagaagagttccatggagaaggaaatgctctggtgtgtctcatccatattccctagagtatagatgaaatcagagtatttcaagggtgggtgattgtatcagtcaggaccagcccagtaacaaatgactcccaaatctcaccagtttacaacagcagatgtttttttcttgctcatgaaaaatgtctgatacaggtcagctacagctctctcctgtctccttcactccaggactggggctgatgggattggtctctgcctagaacactgctggcccaagtgacagataaaagaagagaaaatggtgaatcacacacttgatcttaatgtttatgctcagaagcgacacaacccttctgctcacacttaattggccaaagcaactcatgtggcccagccaactctgagttcaacagagcaaagatggggatgtgtcaaccttctgcaaggataaggatgaaaacagtaatacaatctactacggtagcaaaagatgctgtagtaaagagagtcacaaactcccatctacacaaggagtgaacgcatggccacaacccaagttagctcatagctgtcatggcctgcctctccccgcccctccagttgatctaccagagttcacttttgccctgaacacaccaagcaagagcccttgggacatactgtaacagcaattcctgtcatgctggcctctgctgatctttgacctttccaaaatccttccatctgctgaaagatgcttgtttgctctccatgcagatttactgatgacttgaacaaagatctaggatgggctcagcctttctacctggcggcaaggaagcatggtggctgggaacaatggttctcaaatttggctgcacaccagagtcacctggggagcttgagaaaatactgatgactgggtcctactctctgagattctgatatagttgatcttgagtgcagcttgggcttggatgattctaacgcaaactctgagaacctctggttaaaagcaccagcttcccagccagctgagacctgggttcataacttgactttcccatttctcagctgtgttgcttttgcccaagttactgtatttctctgttgcttggttttctcatctgtctctatgtcataggcttttgttgtgataattagaggagggtgaataaagcactaagtgttgtgcttaggttctagtaagtgttcaatatgtataataattgttgttactgtcatcatgctgcagcttcctgtgctgcacgaatgcctcctggaaaaaccagctgttctactagattggccgttgaagaaatggttgtaaaagccatactgtgctattaaacatgattacatttagcaatggtctaagcaatgggaatgaatgcagcttttggctttccttgacatctcgagacctcacagcagaaaaaatcctctggactttctggaaccctcaccactcattctttcatctccagtatggaaggcttattttgggggaagtgtttatgatgaaaccaaaaagtaaaaaagaaagaaatgtaacaattttgaaatgtgtctttccattgttttgcggcccattttagtttccaatatgaatgagcaagctgttgagaagtaagggggacagcatgttgctgtcttcccagggccttacacaacaaggaggcttgggccagctggactgagacccaggagcacttgcacacgcacaccatccgcccggatgttccggagtgtgtttgggtttcactttgaaataaaacatgaaacatgggaagtgccaggaaggggcagggtggctatcagattaaaagagctctaataccacttgaccacttgcttctagctatagtcgtatttctttgtggtttaggataacccaccgggaccaccatcctgagggacttaggggaaggaagagagatgatcactggtgtacctcccatcatcatcatcgtcatcatcatcctcatttcatttaaaataaggatgtagggctcttcagtcttttaattctgatttagcaagttctttgcctcttaatctctcaattcccaacataaggcatttcccactccccacccccacccccatttgtgcttatggagtttttaatgatttaatgagcaaatgtcaagacttacatttctgtttccaggaactagttcttgatcattcctaattctttgcatatgacacacacatcagagttagttccatttgacatttgtgaatttatgggaaacctcatctttgtggacatttaaaacttggctgcacccattgaatccaccctagggaataattttgcaaggttccctaaaggattaggcgagataaccaataacatgctatttctgtaaattccaattctgggggggctttgatgagaaaggcactttttcatttttgttttctttctcctgcaaacatggaaaataggaatgtctctgaatgattaagatctaagagtggataatgaaagcacagacagtgatagtcttgctgactgccaagaaagcaagctctgtagggatttgggactggctcggaggatagcatggattgctcacattctgtttggacagaaagcagaattgctggatctgaaacattttaccccttttaggaattgcttctccagttgtggacatccagctgggttaacatgctgtctgaagggcatcatgcttattgtcatgttaagagggattgtaagggaagagagggagagactggagagaagaaaattagcaatttttaaatggaatttccctaagcatgattgggaagtagaaacacatttccatccattctaaatattgccgtcattatttgggtgaaattgtgcaagcatgaaccctctttcttaattgcaagtgtaatttcaagatggagaagaggctgtaagtagagggtgttttcatttatttgaactgggatgcataccctgccaccactctctttatttacaggtgtattttagagcctgctttctcaaagtgggatccatggagccagcagcatcgcatcgtcagggagctcattagaaacaaagaccctcaaccccaccccagacccactgagtcagaatctgcatttcagccagggcccaggatggctggctcgcacgcacagtacagtctaagaagcattgctcttgagaattttaaagagttataggttctttccttgctgcgttgactctctgcaacccagttacatgaaggagcccaatttggccctctctaaggagcacaaagctaggggcctgtgtgctcagaaatgttatatccatggtgggaatagaaatgttctgttccagaaagtctagttggagggatggcaggggcagggtggcagatctgtttgagatgtctcttgtaatgtgtgaccaatgagaccttgcagaattaagctgggtctcccatttctctatgcttttgctactgaggaaaatctccagtgagttctacctttttctcccttccctctttttttttttttgagacagggtctcactctgtcaaccaggctggagtgcagtggcatgatcttgggtcactgcagcctcgacctccctgggctcaagcgatcctcctacctcagcctccagtatacctgggaccacaggtgcacgccacaatatgtggctaatttttttgtctttagtagagacagggtcttactgtcttacccaggctggtctcaagttcctgggatcaagtgatccttccacctcagcctcccaaactgctgggattactggcgtgagccaccatgcctggcctatcccaccctctattgtcctacaaatatctattacatctaatgcattatatgtttccaaaagtgcttctttgggagagatgtctgctcaatttttgctgcttaattttcttcttttaatcattcattcattttgcaaagccaaatgtatttttatttgcaagtgcttcattttcattattaagctagctaaggcctggtcaccatagctgaagcaaagtggaaaactaagaaacggtcttcatttagctgaatgatgttggaaaatcagggtttggttccaattctctggataattccctggttgcttcgttttggtttggcagaggaagcagcccgcatgctcagcccttaactgggttttgtcaaagtcaagataccttgctctctgctcccctgggggctgtggcatgaggcccaggcttggaagacagagacaggtaggtcctgggccacagccatgtccagctacaagggccacttgagagatggtgtccactattctttgtggcattttaaggtcgtgctttctgattctctgctttgtgctgcctccgagtcacctggagcaagctcttagttagttagtgtgtggattctggcctcggaggaatgcagtggctcctccagagccgccccactgacctgtaggataagggggcgggaggaagagctggagaatatttcaaccttggctttttccagatggtttggcctggttggtgccatagcctctgaagaacctgtcttgggagtggggctctgtgtcaggcccacaatttccccctgggggcagctctgacacatttgctcaaatagtagccagaagccgcccccccccccccgccccatcccccccatccggaagcagcccagggccgtctgtggtccaggtttcaggagctgcagccgcctgggtgtggctgctcttccgaagttcccggtgctgccatctggaaaagccggactggatttcagttcaggcctggctcagagcaaatgtgggcttgctgtagcagggaagctttctttgtgaggtgctgatttagagaccccgaatgttaatttgtgaagttggtgattggcctgttaggagccatcttgtgacactgcccctaaatctttccttgtttttcttaagataattcctctccaagttattatgtgagaacccaacaaggccaccttcagtaactgcagttgggaaactgatgtggctccatcatgcagttctaattcatcttcttcctggtacctgctctagttacatcaagaagtcaggtttgcactggtgtatggttctatgttggaggtcagaggtcgtctctgaggttacattgtccatcacttgctaggaaaaaaaaaatggataaggaagactctttgaagaaaaactcacattggtgactgtcttttgaggagttgtccatggtcagcaaggcagttctgtcgctaagtatcatgagtctagcatgtgtgctcatggagctggaatatggtgagtaggggtggtagtggggaagtacagagtgcctgatggctctgcagggagagaactagggcaccatcaggctgagtcttagagcctggcaggactcaggcctgacagaatgcaggaatgctggaatggaaactgaggtagcaacacagtcacatgattgggtggacacagcagcaattaggaaactcagcagcaggtgccacttgagaggcagagacccagtcttcctgccagggatgtctttccagggcccaccccccaggccttgatctctgctgctgccaaaaatggcagggctgacacagcaggattgcttatctctactgagcagagcagatgaggaaaccgaggcatagagccgccatgagactcatcccaaggctcctgacagtccagaggcagagccagtagtgggggcagtctccccagatgagctgacctcaatggatctctacacagaagagggaaaacagatagggcggcatccagtaaataccccaaaagctcatcttggaacctgtgagtccctgcttgtgtttcttggcttcccaggtccctcacacctcaataaaagcccagtcttgtctttctctcccaacagtgccggcaaaagaaataagacctccaaccaccacagtggaaaacctgcaggaagaaaatgttcataaagagttgaaccatggcccgaagtggttttggttttctttcaaggcctgcagcatcctggagtgccaggggcctgtggtcacaaaagcttcatctcaaaagaagctaagagggggtccattctggggaatactctggacagtgctatgaagggcagctgggaagagagctggctctctgctgcatattgactactcgggggtacaattttgtcttgcccttacccttatccacccatagcaagctccgcatttggtgatgtttgcttgtttcactttttattttgaaataattaaaacttacaggacaggtgcaagaatagtgtaaataactcttgtatacctttatctagattcactaattgttcatattttgttgcatttatcccttctctcccccacactaattcatgttcatatatatgtgaatttttttgctgaaccatttaggagtaggcagctgtcatcaaactccctttaccccttgcatttcccaagaatgagaatattctcttgtatatgtacagctatcaaatttagaaaatataatatttatttcatacttttatgtaacctgtgtcccaataatgccctttatcacaattttcttaaggttcacaatctagtcctggatcccacattgcatttagttgtcctgtctcttttgtccccgttaatcaagaacagttcataactcttcctttgtcttcagtggccttgacatttttgaagaataccagccagttgttttatagaatgttccttaattttggtttctctgatgtttcttcacatttacatttggatttaggcatttttcagttggaatgctatataggcatgtaagtgatttgttctctggggaccatatcaggaggcacagatgtccatttggcccttgttggtgaggtcacatttgattagttaagctggtgtctgtgtagctgttctttttccttttgtaatgaacaaatataatttgttggaagatattttgacattatgtaaatatcccattcctcatcaaactctctccacctagctttagcattcattgaggattcttgcctggataatgatttactctaatggtttcatccatcatcccttctatatttgttagtccaaaatagtctttgattgggtgggaaggcatactaagcctgccgatcttagtagctgagctcacagggaggaagggccttgatttcctccttggactctgactgacagctcttttgaagcagtcctgttctgttgggtgtatgttttgacacatgtagtaactcattttggaaatacttattttttactagataactttcaaataagtttttaaatactttacaaaaaaatggtaggatgttggttgcatatgttatcatttatttttgtggcatctgctggaaaattgcacctggttcttttacacagtgttgatcaacagaaacctgatcatgatgatagcaataataatatcttctcaccatctgaaccctgctccagagaaagggatgaaattagagagattgtttgaattctgagaaggatggttggactaaaaaggaaaaccagctattggaagcagatgaattaagtaaaacatgaatttccaggaatgtttcaaaatacttgtgtgggagttctttttggaatgttaaagcagtgaatggcattgcttggaattttgtttttttctttattgattttggttcaaaacgaatccttaatcagtttctagccagttcatttttgtctattttttgcagcaatttactgttttgtttttgttttcttttttctttcttttctttttttttttttttttttttactacagtggaaggggtttttatgggagaaacctctgattattgttttagtgggcctagaatattaagttcttggttttgatttttgtctttttaaatagctctttatagcccatagtaagaacaaaggactaatgggggatgtttgggaggtttctcagctcttatatgttgttataacactggttgttacagttgccattaaggttaatgttttcagaacagcaccaaaagctataagcggacatgaaggaaaagcagctgtttttcataaaacttacagatgaaccaatgctagttactcctgtgatgagtgatctagagcagcctttccctagtgtgtgtgttccttggaatgtgcatgtgtgtatacacacagaagagagaaaagggagagttaagttcatggtcaaagaagtttcaaaaacattgcatattgtaactccatattggagaatcacaaggttaaaagagtatagttaatgctttgaatgttacacctttgctagaaaacaaactaccccaaaatttagtggcgctgaacaacaaacatatatcttagtctgtggttgagctcagtggttgttccagtctgggctaggccaggccaggtggttgtagctgggctagcgcatgtgtccacaatcagtgataggtcagctgaggcctagctgatctagattggcctcatctgggatgttccccctggcagtgtcctcttatcgtctagcaggccagcctgggcttgttcatatggtgatcacggaattctgagcatgcgagcagaagtgcgcaaggcctttcgagatccaggcttggaactcagacagtgccacttctgaattgcattggccaaagcaagtcacagaaccaaacccagattcaagggtttgagaaatagactccacctctcgatgggagggcttacaaggtctcattgcaaatggatggggagataccgaaaggggaatgattgcagccattttgacaatctagcagagagatcaactaatacgtgactggctattatttctatgcgcatttctgggtttgggagaatttgtaggggaggaggaaaagagatacagatcatttataattgcagaaagtaaaaataagacttcagttgagatttaatgagctaatctatttcaagtgctttgaactcgcatgtagtaagagctctataaatgttgctgttattattatcatgaatgcatatgtcacttgaggtcctcaacctcacttagaagtgaagcaggaagattcatttgacaacaaaatgaacaaaacttcagatacttgtgcaaaacatataatcaagtgaaggaatttaaataaaatacccccagcaaaaatagtctggagcacagaacagacattttcctctgggggttgaaggtgggaagatgtgtccagttttgccttctgtgaccagttcaccctgttgggcttgtttccaaggtaaggtcagagcttgccgggttcttgctaaactggagtctgtaataaagagggtacccaggtgtgaagagttttatgttctcaggacttgttctttgtttatttagttagcctttattaagtgcattggagccttggagggctctgcagtggcttttgttgcatgataaaggtggcacatagcttttctttggctgacttgggctcccaagtgaaaaaggcagagagggccctgccagcttccctggctctgccccttcagggcatttcagggagcagtccagtgactgacgccaaatgcccttgagcactgtgccagccctcttgactggaagctggggaaggaaactttctcaggccctctctctctttgcttctatttcccctttcattttgtggtctgagcagcccccgcccctccttgcgtaaacccctctgcagttagcatcaacaaatcccaagttgtttgtatgtgtgtctaaaagaaaaattctctgaggattagaagcagacacaatagagggagtgctcccttttgctttaatcacttcaggctcctacgtgttgacaggaagttttgttagtatccaagtttaaggaaaggagcattcaggggtggcattttttttcctgcgttgaattcttaaagtaagtttgataagatatctggtaaactacaagccgctccctttttaaataggcttcactgcccccttggcctgcctgtaaaagcgctgctcccttcaaagggacccataatcacgccgagtctgtgggttgcacgactatacccactgtcttatctgcaagttgagtttgatcttcctggctgaaacctgtgagatgttcctttatgtctccacattcttttcttccctttctgctcccaaccccacccccaaattaattggtgtctggtgactttttctaccgcttcctcttgttttctgtggcttttgtctagggcagtgggggagggtgattcttccctcacccccaggggacatgtggcaatgtctggagacatttttggttgccacaactggagaaaaggggcatctggtgaggagaagtgaaggatgctgctaaacctcctacaatgcacagtgcagcccccacagcagagaatgatccagcctcaaatgtcaccagtgccaccacaaggagcccctgatctagcaggttgctttctggtagggtgctcctgcttctgatatggctcctccctctctctcttcttcctcaagaggactgttcttgtgtctagtattggttacatcacccctgcccttaaataactaaactcacagaaggagaaaatttttccttaaggatgctactgactctggaatccttgagttacatgtgaataactgggtcgtgcatgtcagcattaagaaataatcacagaactcctgattctggtttgctctgggtggcagctgtgctgggtttaccaatggaggaacttcatggctgctcatctttgactctttttctgaggaaccaaatctctctgggagtgctggctaactcaccccttcttcaaacacgctgtgtggcttcaggatatggctgctggctttaaaaaagaaggaaaaataaattaagacacccacactgcaagacaacccctgtgagtatatgttatactgggaatgccccatttctcaaatatttataaatatatggtctcttggagtgttctaggtctgtcatttgggaaggttagacagccctgggccactatcctttttcgtaagcacagggcactttcacaaataccagattgacagctgggtgatgccaagggaatggtgatgtgttgccctgtgtatatctgggatgtgttagacatccctcccttccttctttttctttgttttccctccctccttcccttcttcccttccttctttcttttttcttcctccctccttcccttcttcccctcctttctttccaagcacatcagtgagaatgtagcacagcttggttttctgaagtccgtcaactactgtgtactgcttgtcaagaagggtgctatataagctgaaatgctgctctaaatttcacattatcccttcctgctgctcattgagttatttaattagaagctgccatattttctagggaaaacactttgaacagaaggcctgatttcactgagaatggatgcctttattatgtgtcaaggagctaaaaattgctagtaagatgtcagtgtgtatatgtatatgaaatacagaaaagtgcatgtacatatatgaagagcaatcaaaagagaaatgcgaaggggttggaaaatgaagaggtgtcagatccagtcgatgatttggttcctgctcaggagtgtgtaagcttcagttggctccagtttggctaacactgcaatgcctttagtgtcactgaagccgacaaagaaagctgacgcgttgtttttctagggggaaaaaaaatgctctccttccacattcccagtgcagacaacagcagaaaacagaaatgagaccgtactgcccagagtccacacagactccaactcaaagtctttgaattatgtattcaattcttgccactttgcacattttcccttaaagaaaagagaaaaaaatcagttcatagtagctcttaaaaagcatggaggggcattcaggattcaattcatcctgagaggcagattttaagtttcattcttagaaggagatttcgtgtttagggtatgacagtgtggagttcataggaagggatgtcagctaaaaccaactgcatcctgtcttttgagtttgttttacctttggtgtcccctgttgacatgtgcctttcacttcgcttggagactctctggatgtgcaggctgcttcatgtcctttaggctcttctgtggcagccaagggggtttccttttttcttccctctatttctgggccacagagaggaaagaacaaagatgctttccctgcactgactccaagttgaagctagtcaaactcccctctgaaaggggttaatcattttaaaatagctcgagaataacttgaaagtgactttcagtgaacgtgtccagagatctctggatttaaatcccctcccctcctctccctctccagccaggtcaccggatgggaatggcttatttctatctgccattaggtttttcagccctgccgagagagacgccagtgctggactttaatgtggaggaaattcagttaaggagcatgacatttctcaggtttctggagagatggatgttttggcttatgttgagtgctaccgaccccatttgtcaccagcaagcaggtggatagtcccttaacctctcagaatggggtgaagggatgatttggacccttgctactcaaagtgtggtccttggactagcagtatcgtctcccctgggagctggttagagatgcagaatcagggctccactgctgaccgactgaatctgaatttgctgtttaacatgatccccaggtgattcagacgcacattaatgtttcagaagcgctggtccagggcagtggttatcaaatttgagcatatattggaatttgtttcaacaatcctattaaaacacagattgctcagccttactctcagagttttgaatctatcaggtttgggtcagggccagagaatctgcatttcatccttttttctttttttttcagacaaggtctcactctgccgcccaggtttgggtaccgtggcacaatcatagctcactgcagcctcaaattcctaggctggtcttgaactgctggcctcaagtgattcccctgcctcaacctcccaaagtgctggaatttcaggcgggagccaccctgccagccaaatctgcatttcaaacaggttccctggtgatgcccatgcttctggtgaggtggaggagcacacattgggaatagctgctctcgaggaaccctggcccttctggcagcctttatttctctctccatggaaaccctcgcaccagccaggctacccttgccccctgcctcatgcttttaattcccttccccttcctccttttggagaggccagtacctcccccttataaacctcccccatttcctagctgtgaatccaaacccacactttcctttcctggccactctgagctttctcatcccccttcagtggccccccagttcttcccctggtgccccagccttcccagttagattgcaagctggaagtgggcctccccctccctcactgtccccctaatccatcaccaggatcattcatttcactgcccagtgtctctcagatccctcttctgccctctaccctaactaccacccctgtggtctaagccccatcttctcctgcagctgtctttggaggtctccttgtagcctctcttgcatttgtccagtctcttttctactatcaagtccaagtgacctattcaaagtttcccgcaccattattcccccctcctcctctgccactgcttcagctctttctgtgacaccattggtcgtagcctacaatcctgagcatggccctgaaggcctctagggtgggccctggctatgcttctgtctttctctctgctgccctcccttggctttgtgctgcagccacgctggcctattttcaggcccccacagggcctttgcacaagctgaggtgctttctccagccccacctcacctgcttagtgcctcagcatcctgccaatggcccctcaagcttccccagggaggctttctctgaccttctccagccagtgagattcctttgttgttgaccctccttcttatcctcatagtgctttttgccctatgcagttatatatccaaagtgtgacaattggattaatgcgtgtctctcctgctagactgtaagtttcatggagtgaggacccattcatttgtgttgattcttgtctccccaggagctggtatctagaatgcacccaacaaatatttgttggtgaagccagtgggatcctttgcagctccatgcagtggttcacaccccacatagactcctaaaatatgacactggaaaatgaaaactttttaaaattgttttaaatatataagaattcagctctgaatgtctagataattggtagcatgaattggccctcgaggtcaggaagacttctttgctctggttttaattagtgcaaagcggaagccatttctatgtaaatgaatcaatccatcgaggcacacttctttagccctgattatatgccaggcactggaccggagccccaggaaacaaagatgaatgatatagtccctgcccttgaagggaggaaaagcagatggctggtccctggagaccttcctagcagtaaagaattcagtaacagtatggacgatggcaccagaagtgtgccttgagtttcgtatcaacctcagtgctcccctcactgtgcatttgaaggcttcctcctttacaaagacaagagcaaattcagagagcctgagacgtcaccatgagatatggtctatagaatgtctcccaggaagggatgagatcttggcccttcagtgaaaatgccaacattattggaagaaagcccagaccaaggcaggggctagggctggggttctggagtaaactaactggcatataatcagggctaaagaagtgtgcctcgatggattgattcatttacatagaaatggcttccgctttgcactaacctgggttcaaaccctggcccggccacttactggtgggcaacttgggcccttttcttaacttatctgagccttagtttctcatctatgaaatgggtataatagcttctaccagtagagccatggggaggaataaataaaatcctgagtgtgaggcattcagcacaatgcctgtagtatagagatgctgaatctattgttatgatgagtattagctctgcagagcagggcctaccaaagacctacgtggatttttctataatgaacaacaaccatcaccagaaaaggccagtaagttgctggcaagtgtctgccccgcccaccacacaggagtgtgggggcagcaaagacatgggagagggccaaagctcttagagaagtgaaagtcattggcatggctctatatggaatcgtctccagtgtgtgagtctgtgtgcttaagtcctttacagatttttcggcaacctttttttgtaaggttgctcgttgatttttatttttttgagtgagacagggttttgctctgtcacccaggctggagtgcgatgacacgatcatggctcactgtagcctcgacctcccaggctcaagtgatcctcctgcctcagcctcccaagtagctgggattacaggcatgcaccaccacgcctggctaatttttgtattttttctataaagacagggtctctgtatgttacccaggtcttgaactccggagctcaagcagtccacctgcctctgcttctcaaagtgctgggattacaggtgtgaaccactggccctggccttgttgacttttaaaattatgacttttaaagcaatcagggaataatcactttcaagtactgagcacaaagtgatgactcctgctaggaagatggacagggctggggtcataggcatggtcttgggtcttggagaactgagtttgcttcctgacacagccctttgggtcccatgaccttgggcagcccccacagcctctctaagtcttgctttcatggcctgcactatgaggttaatagtaatgcctattctgagggctgttttgaagattacatgacataaatacagaaatgtctaacactatgtccaataaattgttgtttctcttctcttgccattaatatgcacttttcttgagcaaaagtcttgtcagcacttaacagaattaattacaaaacctaattaagggagtctataagtgtgatattttactgttttctcccttttgatgatgagttctctaacctactgagaggaagaaagccttcttcggactgttgcctgaaaggtcattgtgtgtgtgtgtgtgtgtgtgtgtgcatacacacgtgtgtctactctcacattaacacactttgcccaggatgcattcatgatgccctggcagccagtgggtctttggaaggaattcataggattgagactatgagttgatttcatgagcagaaaattgtatattttgatgagagaacattagagaatgcctcctgaagaagaaggtcacaaggaggccagtgtggttagcgatgcctgggacattgattttgggaagtaatgccatgtttttcttcccccaggcctatagctacctttgcttagccagcacacgccctcatgttggagacctaggtggctcttggtggatttttgtgttgctgtagctttcctgttttgaaagttagggacaagagctcagaaagcagcaatgtcttcaaagagagaagttaaaattctagttatgactctaatgactctagtggccccataaatggcaactccccagggtctatggcttcatgagagacccttggccaaatccactgtggggttccaaaatttaattgtatggactcttccaagcataaaggcaagtttataaaaaatcatttccaacaatttccacaggccctggttgtttgattcaggaactgaataagtgcccagattcatgttcaatgtttgtccttgcttttctagcagatgctattggtgcccacccacaagttcttggcatctggtgtcccagtgcacacctggagagtgtcctactccaagtgtctgcagttctcttcctgagggctttctgtcagccttcgagcagggcaggcccagagtgcctggggattaatgttcctgaacagccttcagtcaatgaaagatgagagctggagaatcaataccctagcttcctcacttctcaggtgggccagctctgagctgtgtactacagtgtctcccagagtctccaaacaagattgaacctcagttgcctgtggcagaaacctgtttcataacctacctttatagcttccttcccttccccgtctcacttaccccctctcccactatgtttcctgaaagcatctcccaaacatatcccaccatttcctctgaccttggggatttcttgagattttgtccctcttctataaaatgatggtcacaggttgcttctgctggggtgtgataggtggatcaggtggaacaatgatttgttgcatgggatgaactgagcattccaggtcatctagaatctctgtgcctactagaagcagtaaggaaggccctctcctagtcacaaccaaaagcacccccaacactgccatatacctgtagggggcagcaccatccctagtcaaacaccgctaacagatatttctcgtctgctctagttttgacatcctaaggtgagttgattgatcaagaacctcagactgggatagcgcccaccatggtatatttcagtctggggagtggtgaggagtggccgaatgctaactttttcttttagagacagggtcttgctctgtcacccaggctggaatgcagcagtgtgatcacaggtcctcactgcaaccttggactcctgggctcaaacaatcattttgcctcagccccccaagtagctgggaccacgggtgcccaccaccacactcggctattttttaaaaagctttttgtagatatgggatcttgctacattgcccaggctgttcttgaactcctgggctcaagtgatcctcccatcttggcttcccaaagtgctgggattacaggtatgagccactgcacccagctggtaactcttgaatagattctgtattgtcagaaataaccactgacttgcctccttcctgaaatgtcgaagaagggaacatttaactcattccctctgcttccctaaactccttggccaagttccccttcattcatttgacaggtcttccctgtgtctgtagctggtgatgaactttaaaaacttgcatttgggctgggcgcagtggctcacgcctgtaatcccagcactttgggaggacaaggcaggcggatcatgaggtcaggagatcaagaccatcctggctaacacagtgaaaccccgtctctgctaaaaatgcaaaaaattagccaggcgtggtggcgggtgcctgtagtcccagctactcaggaggctgaggcaggagaatggtgggaacctgggaggcggagcttgcagtgagccgagatcgcgccactgcactccagcctgggcaacagagcgagactccgtctcaaaaaaacaaacaaacaaaaaacaaacaaacaaacaaaaaacttgcattcggacctatgtgtgttccaaaagcactggctctttcttacagccagctcatccctgggcaataacatctccagctgtctctacctagtcagagatccatgtgtagagtatagagggaaggaaaaagtactggaagggttgctccttctgagtcagagtcagatttgtgatttattgatttattcctgaaccatttgttgttctgctagtggggtggtttgggattttctctttcttacagaaaagttagaggaacccaataaattgcttctttttctttaagaaaatctaaaagtatattcttgtgtgggcaagataggtctcacttatgccacacacctaaccactgtctgacacgtaggaaactttctataaatgggtactgtgttgactaatcaacaagttgttcttgttcgttgcatgaaacctttgagaatgtttctttgcaaagcctctttttttccattctaagacggtatttgaagaccatgctaccaggcttttatggtgtatggtgagttgaatttttccaggaaggaaacttttggggaattctaatcttgattttctataaagtgattgaactgtggagataaattgaaatatgagtcatgaaatgtattgaaatagcagcaaagtcttgccagatggaaagcaaagcaaagactcttgtcatgtccaagcaagacaaagaccaatttacaaaaaaaggataagtggggcatcttccttccatctgtcccatctcgggcacgtatatggcaccaaacttgaagtgaagtttctggtagatgttttgcctgttctgttaggttttggaatcagcaaaactgaccagctaagttcgatcaaaagcaccattaggagatgagagctttatctttaaatgtgatccaagcataatgaacaatgaaattcctgtgattaaaggtttaaactggagcaaatctacacctagaagaagacagaatctctttggatgaggaggagaaagcaaagtgaattggaagtaaattatgtagctgaaaaacttccagtaatatgcttcctagcctgccccaggcagagataaggacagggtcctgcctggtgctatcctgagctaacttctcaaaaatcagacactttggaggtgaatttctgtaaaaggacaaagttgaacttcaaaaaagaaaagtatcaggtccccccaaaatggaggtggcctgttggctcagcagagtggctaagtcaagtaggaaatgtggtgtctggcctagcagtgacaggagactatgttgcattaggggttagacaaaggtcagcaaagccaaagggtttaaaagaggcgggagtggggactgtcctgctcagcttcctgacccgccaggctgatgtcagagggtttattcagatttgagggcttttgtttggggggattggagtgattcctaagagacaatgcccgactggaggctgggggcacgcgacgcctgaattgaatttgggcagttgctgagcagatggggatcagaggggaaaacaaaagggaagctgttcccagcacatccacaggaagggagaattgcagagccagccacgggcaggagggcttcctgctcagcctggctgtggaggcctccagtgcccccatcttgcggaaggccaagcattcccagggctagtgggactttggctctttcgcagagaggagagagggtggaattggaggcaggtcaggagcatgaacttcttgagttcagatttcaggtttgtgcatttcctcatctgcaggctggcaaggttcctggactcatatagtctcacaccctcattttcaggtgcgggagctgagacctgtaaaagtgcactgcctttcctggactctgtcagtgtcttaggttggcttcctctaaaagcagacatgacatgaggaatggagcaaatgctctttgctcaggggggtcctggaagcagtggttagggcctggagaggtaacacagggacgagaaggaagctgacataggtgcactaaagagtaggctcccagcgtgggcaattggggcttcgtcctgttggggacctctgggaaactaagcagaacacacgtcagagtttcctgcctaggaggtgaggaagctggggtgttcttcataattcctgccctttgctgattgctcccagagatgttgagtcctggcacttctgtgctccagtgaccagagaaagccctcagggagagggtcataggtgtacggagcaagaagccatgaacacgtgcaaagtgggaaggggcttcaccggatagatttctggtcatgctctcatcaatttccttagcttgtggggaagccaacctttctgaggccaggaaagcatttctctgggtgcccaatgttgcacagacagatcaaaaccgcttttctttgctcttaagtggggcgtacacttctcttcttcctgggagcgcattagatgtccaggttggatgtacagtgactctccctctctcctgcttccctgtctagccactgcccttgtctttctgcctccctttcagccaggctttttggctttccattttatttccagtaaaagccagagtcccaagcacctacaggagtctacatgatgggcacatgccctctacccacatgcgtctctcatgacacctctaccatttttcctctttctcactgcatccccactgcattgcccccttgttgcttcttaagcctaccatatatgcagggtcttccttcaaggcctttgcccttgctgttccctctgcctggaatgctttcccctgaaagcatggctctggctctttcctctttaggagagagtcatatcttgccttattggttagtgaggcccttcccaactaccccatttaaaacagcacacaaccactccctttctctgtcctccttccctgcttgatggttctccacagtccttaatgctctgcgacatagcatataattggtttatttaactttacaccatgtatctgcttctctgcttggcctttcttgaatataagcttcatggggtcagagacctgtgtctggttcactgctgtatctccagtgcctagaattgtgcctggcacatagtagatgctaaacaaaattatcgaatgaatgatcagtggcaattagaacatgttttctctttttcctcccttctctagctcctagcacatgtctgggacctttctgccctaaaattgaagcatccccagggaagtttctccttgtgcagtagacagaacagaggctttggaccctagcagaccttggttggaacccctaggttcaaaatccagctcctccaaaattctaaacattaccagctcaccaatatccagctctcccctcctttgggcacatggaatcttacactcctcagtgctctttaatggggcagggtcacatgactagttctggccagtgggctttcagtatagaagagcaggtgtgaggtttctgtttgctcttgtcacctgcctcagcaaaccctgaagccacatgtggagatggtggagcctgtgtcagcctggatccctgagtaatcatgtggaacagaggcttccactatcctgctttggacatgtgatgtgaacaaaaagcaaacctttaatattggagttatttgttgctacagcataacctagcctattctaaccaatagaattaagtactagtggtgttgctatgggaaagtcatttcactctgagcccatactttctcattcgttaataatctttgtaccatagggcagatgttcaacatggtatgttgaacacactcatactttaacttatgacttccacagtaaccctagggaggagttgctgaggactccatctctcttacagatgcaatatctcagccaggtagacatagcattatgcctttacattcagaaaaggaagcaaattctgtgacatgggactatcagggggtttcttggtgcatttgggccttgacctgggttctttagaatggcaaattttgccaccaggaaaaggcagaagagattgtgagtgataaaagctaaagcagtctgggccagaagagctacatatgagttctgtgtctatacagcatgtgactttgttatttgagaaagtagaatgtcaggttgagggagagaaaaacagatcaggccaaaactactaggcatctgatttgggtggtggagagagggtgggcagaagagaacagaaatgatgaaatctggatcctagttcttgataaaccgtcaaccctctgaagaacttgggaaaattaatttcacttatctgaactctggttagggcaaaacacaagtcatttcccaagagtctttaaataatgagcatcatcacaattgtaagggctcacactgattgaatgtttattgtgtgggctgggcacggtggcttatgcctgtaatccctgcactttgggaggccaagacgggtggatcacttgagcctaggagttcaagaccagcctgggcaacatggcgagactccgtctctacaaaaaattagctgggcatggtggtgtgtgcctgtagtctcagctacttgggaggctgaggcgggaggattgcttgaatctgagaggcagaggtttcaatgagccaagattgcaccaatgtactccaacctgggtgatggagtcagatcctgtctaaaaagtaaattaaaaaaaaaatttattatgtactccttgccttgcctttagtggattacttgaatcaacccatgtgactttctccacaatgccatgtgatagacactgccattgttctcatttcacagatgaggaaaccaaggcacaaagaggttaagagacttgcctggagttaagtagcagagttgagagtcaaactcagatagtctgacttcagagccaggtttgaatgtgactggttcctgcacaaggcttttctatgagatgcgtaaaatgctttagtggacaaatctttccatttttccctctggagggggtttaagtggtatttgtcttccttctacctcacagggtgattgtgaaggtgaacagcttagtaacatactgggagtgggagtggtgatacagcccactctgcaatgcagggtgtgtggttaaacctgtaaattgaatgttgataatgataatgatttttactttacagataacatttatcacatgttaataaaatataaagtaagatgcacgtaagtaaagaatgtagttactctgtccagaccctctggaattttttaagggtctttcccccacttcagctttgatgggctttcagcggccagccctgcagctcatctttggactattggacctgcattgatcccaggatgaaagagcccaaggtatctgagtttgcgaacacacacacacacacacacacacacacacacacacacacacacacactttagccaaagactgatgggtacaagagcccagctgccttacctcaaattgagacaactttgaggtgtaaactcacactctagagttccctgtgcgacctcagtggaactttgctggagaccttcgccttgcttagctcttgcccttctctcttgggagcatctcttatccaatagcttgtaatcccaatttccttgggaaacaatgagaagagaaaacattgaaaaacaaaccagtagggacatctaaagcttcaaaagaggcatggcaaggagggcttgatcttcttggtttgacaagtcattgtttgctgattgcttgacatccattacagagccaggcctgccacaagccatctctgccctacctccctgccaacattgtcctgcaagacggccagggccttttgaagcagcctgtggagagcctgccagggttctgtgtacttgcatgcctgctctccggttgcagaggagcagtttttacatttctgccacttgcctgacctgctgcggcaaagcagcccactggggaaacttggcatcactgcctggcactggtgcttattccttcctggcattggcccatgccagcaggaacaaggacagtgccaagcatgccaccatggttgtgccaaccagttccactgcagcagtgccctgaggatgcttgaacctgcctggctgtcattacaactaatgccaaagacattgaagggggttggccatttccttgcaattttctttctccaagcaattgtggcttgctgggtcagcttcagaagcatttattattcacatgtctgaatccagagaaggtagagcttctacaaagtgacacaaagggaacttttccttatggaagtcctgaatccagagagagagagagagagagagagaaatgggtgagaaacagaccacagagacagagaaagttgaggcgtgtagtactcagacctgggttcaacctcaaaatccatgacttctaggctggataaccttgggcaagttatatgagcattctaagccccagttgtctcgtctacaaaattggtagaataattatatccagcttgtaggatttttatgaggagtaaaggagatataagtaataacacagtatataacacacagtatttattcaattaatgttagctgttatgattacttgtatattattaataatgtcctcatatatgttttatcctctgggggaggtggtataaaccagtgcttctcaaactttagtacataataatcatcaggagagttggtcaaaatgcagatttctgagccctgcccccagagattctgattctacaggtctttatttgtaacaaattccctggtgctactggtgatgttggcccacgggtcacactttgagcggcagcattggtataagccacagggcagcattatccttatctgcaacagatattctgatgcatttgagggatggatacagtgcgtttcgccttagttcttgctttacctgcctgcaactcctattccatttggctgcagaatgaatgcttaacattgtcctaagcactgataagatgaaaaggcagaagctaatgcctggaaaaactaacataactaggaaatgcttagagcttgaaggttgatcccattgctgaacctgacgctacttagaagtcagaacatattccagtcacagataagtatgggttcctcttcccagggaaggcagacggagctgatggaaggaaaacatgcgcattgtctgcttctcttgtacagaggtcatgcagggaggaaaataagggtgcttcagaaatactctgtaggcagttcttgttttttttgttttgttttttgtttttgtagttatgagacatgaaatcaaagactattactatcaaaataagaggctagatggctctccatgtcctgtcaatttcccctaacatcttcctgtgtcagtgcttctcttcagagttcgggattttgctcccttttccatgccccctcctctttttccttttgataccaggagctacttcacttaaaagtgcctggattctaggagtaccttggtttggggcccttcaaggccaaaatgaagataaagagatggagctgcggggcatatataaatcatggtttctttcttataatttctttccagattgttctaattgcccacaattaggaaatgtcacttttatagtcagaaaacctagataatattttctttcaatcaagattgattaagtctgtccatagcctataacaatagctaatatctcttaagtgctttgtctcagccaggcagacgctatgctaagtattatcatgtataacgtcatttaattcttgctacaaattgaatgagattagaattgttgtccccattttatagataaacaaatggagacacgaagaagtgaagtgacttgttcaatgttgtagggctggaaagcgacagagataggatttgaatccgacaatttggactcaatttttaaccatgatgctttgtgtataatccccaccatgtaaaaaatataagccaggcaaaaattcaagaaggaaatgtatcaacatttgacattgatttgtctggatggtgcaatggtacgactatggacttttttccttctgctgattttctgattattttctcaatgaccatatactatttttccaataaaaatactttatttatttatttatttatttttatttgagatagagtctctgtctgttgcccaggctggagtgcagtggcgcgatcttggctccctgcaacctctgcctcccgggttcaagcgaatctccctgcctcagcctcctgagtagctgggattacaggcacccaccaccatgcctagctaattcttgtatttttagtacagacggagttttgccatgttggcccggctggtcttgaacttctgacctcaggtgatccacctgcctcagcctcccaaagtgctgggattacaggcatgagccaccacacccagacaacactttatttattaattggaaaaaatcacttagctcagtctctttcctccaagttcaatgtctaaagtcatcccgggcagatgatcttttgttattctgtgaagagtcccagcgacactaactctgcaggagctagtcagtttggttaatcattccatagatttacctatgtgaggccccagaactggctgactccattttcaggatggaaggactgcttgtaatcatgtgctctccctgctgggcagggacctgctgtcaggaggctgtgccctttgagctgttcctccaggtgttgaaatgagcttgtgctgatcatccaaattcctgcttagccaccttcatgccccaaagcctgcattgaagagtgtgatggccagggctagagatcaaacttgtgcccttggcctctttattgatctggggaggctaattgctggaacaagcaattcccaaatctcagcagcttaatacaatagacatttattatttgctcggctaatagtcccatttcaacgttttctgtttcaacatttggcaggaggtcctccacctggtcgttcggaaaccaggctcttccactctagagttttccgttggatcgtctatacctggccagtccacagaggaatcttaccggtaggagatgtctgtgggccaggtttggaagtggtgtacatcacattggccaggactcattcacatgggcacccctgactgtaagagcaattgggaaatgtagtccagctcctgcctggggagtccatagctgtctctgccatgggcccattcatttgttcaataaatatttttggagtgtctgctgtccaggtactccatacattggtcagtgtccaggcccatggacattgtttgtgtcctgtttgctgtaggaatgaggcattttgtctgttctctaggtcagagccagatttggaagggtcctattcaagtccaagcggaggtcactgtgcctgacttctaatcttttggaggagtgcacaaggtgctgttacccctacaaacaccatagttcccatatcagttgggattcagcccagagaagagcaacatgccaattattttaacagagaatttagcagaaggcattggttaaacagatcttagaggatggaagaggcagaaagtgtagcagagatgggaactgcagaaagcagagaacacccttaagactgggctgacaaagggaagggattaaggttatgagaactttggagttaataccctgcagagctgagacccagacacctgaggaggaagtgctgcctggctagtgctggtgtctcagagggggtacagtgagactggctcagggactgccaaaaaaagggactagattctggggccaattgccactgcctgaatgtagggctattattagggaatgctcatggaaacaggaggaaagggaggcacaagccccttcttcttcctccatcctgccattctctgtctcattcccctcctggcagggccaaacagggtgcagctggcaaaacagaaatgaggtgtgcagagtcccagccctagtatcacagggcagagtatagaaaaagtgggtttgaaactgagagacaataacttaaaaaatggtgcgggggctttgtttcaagctcacacaatttatgttttggctacatggtgcaaccacagtggagcttcaaggggtcactcacccagagaaacctctgagtatgatctattcattcattcattggttcactgagcacataactgaatgccaggcatgtgcttggtactggagatagagctataaataaggcagttcttgcccacaaggagctcacaccacacctgtacacacatggcacacacatgcacacatatatgcacgtgacataaatgaaacaaggaatggagaagcactgaaagatctggaattaaagacacagggcttttttattcttggctgctgccactgaaagattgcgtagaaatgagtttagcttttctcattgaagaaaaatgagaggaggagaaggtggcatttaacacgtccttggcatggcatgatcattgattgttctgctgcctggacttgttctactgatcaggggtcagatcaagtggaggttgaccttgactcaacagaatgagaaaagtataaaataaatgagggcagtcaatgtatgctggcctcttggaggcctctgctttcctccctggggtccaggaggagtctgctccttttctttgcacccttcaggcatttgctgcagggtgcccagagctaaactttttcttgcattgggaaggtggtacattttccatgattctgtgtgagtggagaagaagggccctgcaggtatgattttttcctttagtgtaacaagttttccacatgggtgtcctcatttgacattaattgagcacctgctgtgtgccagtcacaaacaaccagacagactctgtggattcaaagcagtgagcagtgggcgctgctgagcccatccctacccctctgatccaggcaagtcacgagtcatctggatacccccttttttcgtgtattgagcatcatgttgcagggaagccacatactttccttgagcctctgttttctcatctgtaaaatcggaagtgagattagatgagctcaggagtccagccagtattcattcagagcccactctgtgccatactctgcatgtctctaggctgtcattatggtgacccatttaacttagcatctcccatacagtcctgattttatatagtttaattcctttcaataaagggacgttctaaatatataaccaaatgtgatttaatgttttctgttttctttagacattttatctgagttgggaaaaatgaggctaagtgttagaggtggtggctatggggaagtaatgcaggtgtttctgttatctcttgctgtaacttagtgacttacagacacatacacttattctttctcatgatcctgtgggtcagctgggcagactgccaggtctgagctgactcagcagggctggaaggtctaggatggcctcacctccatggctggcgtctcagctgcagcagctgcattgttggtcctctctccatgtggtcttgtgccttccaggaggctagtccgggcttgttcacatggtggtggaagggcctgcagaagcaagcaggagaggacaagcctggaagcacaggtgtttcttcatgtctctgcttgagtcagacttgctattttctcatggaccaaagcaagttgcaagaccaagccagaatcagcataggtggggaggacccaagggccattctgcacacagtttttgcttgatgtaatagataccagatacattctggaggcttgtttccacaagggggctggctggctagagggaggccaactgtgaaggtgtcaaggacatggagcttgataagaaaaatggtgaggccattaagagccaggaaaccagaaggaagaatagatttgacgaatgagtttttttttttcccatgcagattggggtgcagatgggtctcacaccagtgctatctaacagactgcttgaagtcattcagcacatttttcctgggctccatctatgtgccagttttgtggatccccagggaacagaggctggggtgggggtagtaacatagtagaatcatatgagttcttgacatggacatgatgggagaaaagatgaatttactacaggagagattcaagactgctagaaactagggccatgcatgtatgcacatgcaccacacacacacacgcacacattcctgcatgcacatacacatatagacatgcatgtgcccatacacatgtatgctctctcacacacttgtacacacatcttcatgtgtacatgcttgtacatgccacatgtgtatatgcaccacatacatgcatgatcttccagacagcctcagaggactcacagaagcccatcctaggggatctatgaattgcagaataaaagctaggctgcagagagaggaaaaggaagagggctgacaacaggcccctgggggatggctgcccccccttgcttttaaggtgaacgttgaatcaagacaccaccatgctctgttctgcataatgattcctgaagtacaattttgtaacgtcatacttgtcccttttttttaagaacggggttgacacatgtctgtttaaattaattttcccatctctatggatgcatttgggggaaacaagttttcctgcttaaaaacaaagagggtgggggtggagagactggaagaaagggagggggagacctatttgaaaaggtttcaagatgagtaggcccctcattaaaaaaaaaaaaaaaagaaagaaaatgaaagctaggctgcacattagcatcagaaaaacagccctcttcagtgtctgccaggccaggccagggccaggtcctttagtggctgtgaataacaggcttttctggaaactgtggaaggcaacaagcactgtccttgccttcctgcctgaagggctgagtttttcctttaagtactactttggtgctaactgcccccgttgttcctggatctcttggtcccagacactcagcaaaaatgtggcctcatcccaccctccaccctccccactaccatgaaaaagagacaagctgtcagatgcccctccctgcaagcccagggctctcctcctgtttctgtttagaggttttcagctgacaagagtgtcagcttccatcccagcactcaatggcattacagccagcttttcacagcagcggtgggtgtgaggatgcgctgaccacagaaaagctcgtttctgtttagcagaagcgtgagggcgcagggtgccagctgctgctacagtctcttacagaaatgggcaccatttattctccaagaggaagctcaggatgatcttctcagaggtagaagggcagctgatatcagcaccagagaaaacagctgggggatgagggaccggagggagcaggaagagggatggggagaaaaagaattggggaagcctttagccctggaaaaggaacaagtgtgtttgagttgggccacatctttggtctggatggggggacttgaacaggccccttgggtcaagaagggatgtcttttagagacaacgagggatttggaagaaagattgaattcattattactaatggggagctcaagttcaaatgcagggcatttaaactgcttactgtagggtcatgatttttcttaagatggtaaaaataaatgtaaatgaacaggtaaggtgttgatttcttgatacccaaagccttcaaagacacaactctcaccatcttgcttatacatacaagcatgcgcacgtgcacacacacagctggctggctttgcgaggcagaaaggaattcacgtcacagggcagtctgagcttgttcctgaccacacacttagcttttcctttttgaacatctcaaaccttccttggacttggcattgcctctcagagacacatcctggggagacgaatgttttattgtttgggtgctttcaagattctaactcactaaagataaggctggtggatgcctgggtcagcctctagtggcactatggtgttgcagcaatgagcagtcaaaggcaggatgtagccaagggtgcctggattttgctattgcttagccatggggtggccattggacaccaatgtcaggggctggtctgctggcctggggctgagccgcgcaggtctggcctggagtcacagaagtggtctagttggatgcccatggggctcctctctttgctccagccctgctaggtaccctgaatgtctggagtttaggagggagaggacacccaagccactgttgcctgtcacctggattactgaggcagcctcctaatggtcttcccacttccccctctgcccacctcgaatccattttgcatacaactgctaggatagtcattttaaaagaggtcatatcacgtctctccactgctcaaaaccattcaaaggttgccgactcactcagggtatgagccaaagtcctggctttggagtggcccacaagaccctatgtgatctggcccactgtatctgctaccattcaccccatctgcacagctctatgcagctgcactggcttcctgctggccctagaacacaccaagcccatccaacccagggttttctttcttgctgttcctctgcctggaacagtctttctccagatatccacgtggctccctcccttatgtccttcagaattcacctttcctgactgctctattaaaaattgtcacctgctaggctctctgaaccccccttcctcacttaatttttctccatagcgtgtatcgccttaactatgtattttgtgtatgagttttgtttagtatccacctcccccactagagtgtaggttccatgggggcaaaggtttttgccttatttaacactgtacctgcaggtcctagaacagtaggagctcaataaatgttcctacaaagaatgaagggatctggaccagagaatgtctttctggatgacacccaaatcatcactcaagtcctggtgcttcaactgaggtgcagaagccaaattctttttcagccttgaagactagagtaagcgggatggattgtctctggaacctgcccccttccccagcagtcttgatgttgatggctgcacctaggctggccaaagctgccgtgtcagatcttcctcccgtaaacacagcacttgaaacaaaaagaatggcctgtttccatggcatctgttagagctccttggtctggtaatacttgtatttaaagcttcatcatggtggggtgcgggggggccccttgatgaagctgccggtcccataaatggtagcatgcagcaggtgcacaagtgcagagaatcaaatgaaggagggtggcctctcagcgtgcttccctgatgtacccctctcctccctgtgcctgttcgttgccctgcctgcaccctttcacagatgttccctgcagtagactgggcctgccacactgcagctgtgggaggaggagacccttgtaatcactgcagccgttcaatgcagggtgctccaaacagccgccagcacagatcatatgggttttctgttatagtatttagatgctatttatagagtatctgctctgtgccaggtgttttacacatatctttagtctttacaagaatcctcccaaagaggcattatcattcctctttaaagggaggaaaccgaggctcagagaggttactaactggtccaggaccaattaggcaagtaagtaatggaactgagttttaccaaggtctggctttaaagatcacactacctccatggctaccttgcatcttaatgcaggttttgcactacacaagtccaaaggcattctgaatggtgtctcccggagtgtgcagtttgcatagctgtacacagccaaccctaaccatctgctgggaatagtatttggctgagggatcagttatatcagtttgaaatgcattccactgtaaggaatagaaaacctgaactctcggagcaggagggcattaaacaaaatggggttttagttttctcacagagcacaaggtctagagataggaggctgtagggattggctcagcagctgaacagtgctgggtttggtgactcagaaattctcttggcctttcctcatgattgcgagatggctgctatagctccaagcatcatgtctgtgttctagggagaaagaagatgaggaaggtggcgttagtcacatctgttccctttttatcaagaaagttaaactttcccagacttccatccgggatctttgaaaatttgaatttcaaggctttaagggagagggggtggggaaagaactctaggctagtgcctgccaccccagtattatccgaagaatcggaaggcagagcgatgctcagatatgggttgtggcctccctgaaatagagaggaattctagatccttcatgttcaaagcatcagcgtcatccaggagctgtgagaaatgcagaatctcaggccccagcccagacctactggatttgagtctgcattttggcacagtccccaggtgatccacgtgcacattagtgcttgagaagcactgtttccagaaattgactgataacacaggacttctttacttccaccaaagttctcacagctttcagctcttgggcgaccaactcatcctggtttgcccaggactatcccagagatagtgctgacagtcccatgtcctgggagactccccagtcctgggcagaccaccctatcactcttatctgtgggggtcctaccctcctcctcccaccaaactaaggcagagcctataaccaagaggcagaaagcctagaaaacttcctttgaggagtcaggaaagatagatagtggtctttcctttggggtatggaattgaacaaggcctgagccaggactcacaagaataagaacatggcaaggccctgccctcccagtgggaggtgtggagagctggcaatgagatggttaagagccctgagggcgtttgatccaggtgggtctgaggtatcattactggacttaataatacattaacagccagcatgaatgggttttggattaagaacttggtaacaaagcagattaactctttcctcacttctttctttcatcccttcatgttgctttcttccttctgccaagaaaatagaaaagaaatgcccaaatctcacacaggaagcatttgtcatgagtagcactggtgactcaaacttattttttagccctgccagccaagagcaacaggaatgaactcgagtgatctgatttattagtgaaaaaaaaccaactacaaacttttcctggcctcatacctcctcccagaccttcccgttctgcctcccagcttccttctttccttattcacgccctgggcagcccatgtggctacctggaaactcctgtttcgggggcggggtaggggggcggtgcttgggagactgctttctcaggcctcaagctccattaacaaatatttgcaatgggcctactggagttggaaagagaagacagagcctggctatggatgcctgggtgtctgggagccacttgacaagtaacacagcacaacacaacagaacttctgtgtgccacctacagaatgggggcaagacattctagaacagtggggacaacttccttaagaactacaatttgctccttcattttggccattctggtggctcagcggagttttgggaaaactctcccacactaaggagaagagctaaggagctaaggagaagagtgccttcccccagggcctttagtcagctctctgcagcgcagcatgtccatatttgtctccctcttaactactgtgcaattgtctaagagatgttttggattcaaggaaactgttgacccaggagccttgctgtagacttggtgagctgctccagacccttctgctgtccgtaaggacagctgtgaagtgtcagggtggagttcctcattgcaagcttctgtgactaagtttcgtcagtgcctttcctcagaacactgtgcagagaccttttagacactccatattatcatacacaggccagagctggaggggggacacgggtcatgaggatggtcagggatgaaaaggtgatgatgacaaggtcatcaaggaagatgttcacgttaggcaccgtttgccaaaaacaggcaaataagggcagtccctgcctggtctcagctctggactgtcaaagccttctgggccagccaggtttaagtcagctccttcaacggctggaggtctgtgagtttaaacaacagcatgttatgcagaacaaggaactgtgtcgtggttggcccaacaggaccattctagtaggagccattgttcactgacccgtatatgttgagacgcgtgtctgtctgttgtcccaaccaaatgattctttattgtactgtatttgtctccaagagtgtgaagcccaactggaagactcatgtttattttgcagtactgtcaggaatggctgttttcttttttttctttttttttcttttttaaaattatactttaagttctgggatacatgtgcagaatgtgcaggtttgttacatagctatacatgtgccatggtggtttgctgcacccatcaacccgtcatctacgttaagctatttctcctaacgctatccctccccttcccctccactccccaacaggccctggtgtgtgatgttcccctccctgtgtccatgtgttctcattgagaaacagctgttttctaagggacagtggccatgtttacaactacagtgaccgttaatctttgagttagaagaatcttcctttcagggagttcattgtgttgatgctgagggggactgtgtgagggctgttcaggaagtggggtggggctggcagcgggttattttttttttttttttcaaaccttggtttggatttgtttcccattcagtagtttatctgtcccctcactagactgcagtgatgatttgagctccaaggctgtgaatctctgttgcgtgtggctgactacctaaagcagggcttctcacagtggagaatgcatagcatcatctggaaagcttgacagtgcccagatgctgtgccctactctcagggattcagattccataggtctggagtggggcccaagaattggcatttctcacaggctcctagatggggctgatgctgctggtctggggacacactctgagtagcagtgggtcaaaagaggtgccaagtgctgttcctctctctagctcctgcttagcacaggttgcatatgttaggataagaggaaatcagtgtgatctctacctttccttttgagcctagctcttaatttccactcttccaatcctcactgatgggggaagttaagataccatcttggagtgtgaagcaggaatcctaggtcctaagggatttgcctggattgccccatactccctcctccacccacccccaggaggttttgggggcctaggaattcctgctggcactgcagtagcaggcggcttgcatctggagttacacccttcaaaggtctctggaggaacaggaacaaaccggagagaaaattacatttgaaataatttattttcacatgcaggggagaaatcacatttggtctagattcatgtaaagaaaacagagattagattttttaaaatgtgttgctggcaagagagaagagcagacgggtttggataaaatacacattctgttgaaactggccttcaatcccagactacatttaaaggggttttgagttagcctatggaggggaatcaagtctggattttattttcaattgtttctttcttttgaaatacttcctaggttgggactgggagtgacagaaacatctggactgcaggaaagattgttcctagaattctgagctttttctatctgagcaggctgatttagaagtcttatccaagatgagagaagattttctcttggaatttctggccaaagccagaagaaacaggagtctggggaaggcaaggagggcaagctggagcaagaagcgaaggctgcacagaccacgcaaatggccatgccaggagggctcctctatagagccttagtgtggaaaagggtcaatgtcaggtttaagtccatcacaaagatgattaaagaaacaaccacagcaagagctgatgcttactgggtactcaccatgtacctggctgtatgttcatcatcatatgaaatccttacttagctctataaagtagttactagcatcatctccactttatagatgaagaaaatggagagaagttaagtaattttcccaaagctgtactggtaggaagtggcagcgttgagctctacagccagggctgtctgactcagatgcccattccaagaatcagtttagataatgatataataattaccatcagtagcattatcattgtcagtaaagggccgttgtttgtgtgtatgaaaatcggttaggttggatcatatgaaagagctatttttgtaggcaaaaaatggctgaacattggcaatttcatatgacttaacaaaatatcgtaccttatgattggtgggaggagggataaattgtgttgtaactaaaaaatggactactatacaggaatgaaagttgactggcttaaaacatggatatatatatatatctatatatatataacgtactgttgaggaaaatatctcattgcagaaagatacatgaaatataataccatttatatatagataggtaaatatatacaaagctatttgttgttaagggggattttgtgtgtgtgtgtgtgtgtgtgtgtgtgtgtgtgtgtgtgtgtattcaagctttctctaaagacagagaagacccctctgatggttaccttggcagtccagatgtgtgagagagttcaaataccctccaagagccatccacttaatgatgagagtcagggtgtaaatatcccagctcctttgcctctgggagaatatttagtgacagagattctgtgatatatatatatatatatatatcttgcatttcaatttcagtctggttccagagagcatctggagaggaaggaggggaaagtgatgaaggtagaatacaaggaaggggctttaagtatccttgtaatttgtttttttctaaggctgcatgctacatgggccatacacaagtattcaccaggttattctttatacctttttgcattagttgtctatcactgcataaccaatcaccccagagcttatcagcttaaaacaacacatatttacgatctcacagtctctgtgggccaggagtttgggcacagtctaactgggtcctctgctccggctctcaccggcagcattaaggtgtcagctgggactgtagcatctcaaggctcaactggggtggatttgcttgcaagcttgctcatatagctgttggcaggcctcagaaggtccacttcgaagtttacacacatggttgttggcaggatttggattctcatgggccattggaccaaggcctcagttcttcactgggtgttgcccaaaggcctcccttagtttgttgcaatgtgtcccacctcatagggcaactcacaacctggcagccagatttatcagggtgagggttttgagagagagagaatagtcacaatattttataacctacttacaaaagtgacatcccatcacttttgctgtattttgttcattggaagtcagtcactaggtacagccgacactcaagtggagggatttacacaacaacatgaataccaggaagcagggatcattgggggagcccttagaggcttgcctagtacaatatgtctgaaatatcttacaataaatttttaagagaaaaaacatatttaaaggtgaattagaactgattcctggcgttacaaactccttaatcctcagtggcagcagccacatttctggctgctactaaatctttcctgtgcctcctgcccccatctcattctccacaatgtacatcataatcaatgacaaaattaattaaggatattttctcattactagatttagagagatgtcagtatcatatcaaaagtgcttttatttcttcaactatacctttgtggagtcaatggtaacagtacctttcagaagtctgttttccaagagtgcccgttggctagagtcgtaaagaaggcattgtggaacagtaagacgtacatgggcttcgtagccacagagctaagttctgacccctgctccacctgttaccagctgtgtgatttgctgacagatacttacagtcttaaaaagctagtcttctgatctgtcaaatgagaggaatggtacctatctcaaagcttcctggaggattaaatatacaagaaaacatgtgctagtcctagggcagtgatcagcacaaagtaggcacctgacaaggtgaggaaagtttcctccaggtctcttaccttccaaaatgctatgtaccccttcatgagcaggctgtgcaaattgttttgaagggtgacagttttgggatgccatgaaaagaatggatcttcataatttctcatttgaccccaagattaatttcctattataaacttaaagtttcatgcattcattgattcatttttacattcatatacacattcattcaacaaatagaatttcttaaagaaagtaaagaccaatcttcttcaaaactctaatgcctttttatctcccaggggtggataggataatccaagttatatataagcagtttctcatgtccagggtagcaaaagcatcagatgtggtgcaaatctacctgttttctatgtggctccctgagagggctgttccatcaagggaagatgctccaatgtatgctagcctttgagattttggcttagtagaggagaggagctagtgcctagaaggaaatacaacaccatgagatagaggtccatgtaaacatgttctttgtggaggcctgcctgccactaggatacacaccatccccactggttgatttactgctacatactggcctttgcatccaagaaagattgtagtacttgacttcagagatctttaagcagaggcttgattcaagcctcctgagtcagctgagatgaggcagggtgcttttagctggaacctgggctaaggcattggcctccgtgcacccccattgaagaaaaaaagtagagcaaaaatccatactgtttatttatgaattatatgcacgtgttgctgtattaataagttacttactgtaacagtttctaggcccctgcccatatccctaacctttcacatttagaggaagccttcttttgatagccaactgccagattcttcatctctttgcctgcagtctttctctaaagatggagaagacccctctgctggctccctgggcagtccagacatgcaagggaattcagacacctcccaagagccctcatccacttaataatgggaaccaaggtgtaaatatcccagctcccttgcccccgggagaatacttaatagcggacattctgtgcttcttttgcagcttctccctgtgagactaagctccagttactcgctaactctctctttattgacttccttctcttccctgttttacttccccatcgccctatcagggttccctgcagctctgaagtaaactctttaccctggaatccttgtatctgagtctgctagaaaaacccaatttatatttaaaaaaacataaaaacagaccgtttaacagtacataaatatacatacatatacacatagtctaatgtttttccttacccctagagtgcacactctgcattttgaaggccgcttgtttaaggaacttagaggctcccatttcagtcttgtaatctgatatctcgaggttgatatcagagccagccctctctcctttgggctgcctgcttccaagccctgtttaacttactcagggtggcttggcatactttcacgttgattcatggtagtgatttctgggtcacaggctagccaactggaaggagatcttcaggattggatttcctgcactcctctatttgaaagaataatttctgtatcttggacttccaatgaggaaaacaaaaacaaaaacaaaaacctgcaagttcagagttggacaaaagtttctccacaggcactttaccccactttgggacctcatagtttctctcagttcagctctctgtgtatgggagaccaggcaacaggtacatcattgccaccttgaatcatcctgctattacatgatgggcagccccatgagatcgggatggtatgaatattctgacttgttgtcatctttaaccccagcacatggttcagcactatgtggacatataaacacacttcaaacagccttttgctagaaaacagactctactggccccagcataaagatttgcaagaaccgaatgctcccttattttctctctgcctggaacaaagcctcctattgtttttcaggtgatcacattctttagacattcaagtttaagttgttcctcaacaactgaattcaaagctagaggcttactctgctggctgtgcctgcacaagcaaacggtcccacccaaaggcccttttctccagggcctcccagtggcctttaaattattttggtcttcaacatcacagtctcccagaatgcttatcagaggataatgtcaccccctttcatgcctgcccaccatttctactcaaaagccactcctatttctctacagatagctcattctctcagaaacgaacctacagcaaattaatgtccagtgaggcctggcttgtagggaaagtcttgggtatccctatgctcttccagactggccatccaggacataaggtccatgagcttaatcttgttctaagttccctcgaatttcccattgactctattttccttggctgaatagatgttgttgctctgtaatagtgagaaacagtatctgtggtgatggaacaggcagaaataaaaatatttccctagctctttcctcagttctaatccctacaagtcttgccccttacctttgccagatcatccacttgggaggattcagaggtgctatctccattccagcgtctgggaaggagaagaggattgacacaagtttcaattttgtattaaaaagtcccgtcttgtagggttttgaagggaggaggaagagccaagaggagtctacgtctatactcctcaagccactggatagagttactttgagttcttcacacatgcaagtgcatgcgcgcgcgcgcgcgcgcacacacacacacacacacacacacacacacacacacacacacacatcatgccttcccaaggtactggcttggcttggcaggaatgctggatttgggcttggagagccgtccactgcttggtgcccacttttagaaaataaagaagtgacccaggttcatgggtgaagttttaatgagaaataagtcactgaagcagtcagggaataaaccccaagaacagaaatcatgatgctaatctcccaaaatagggcaataaaatgttgaaaggtcttaaggggttgtgagagggaagattagggaactggggcacgtttgtctaatcttggaggatgatatgagggatctaaattcatatgttggtcatgaatagactcctactccacatgaaccaaggtttggtgtttctggctttcatcttccctaatatttgttctcacccttttccttagtacgtgtgtatgtgtgtgtactgtagaaaaaccctatgctactgttctgaaattgtagattctataaatgggttgggaatgaccatcttaggttgggttcctcagaagcaaaccctaaaacaagacctcaagtgtaagcagtttatttgagaggtggtggaaaaactggtaggaagagaggagaagggggttaggaaaggcaatgaagccaaggaagggttattaagtgaattgctactgtgagtaactggagctgaatcccaagggagactctgggaggctatgcataaaactcagagttatcccacctgaggggtgaggcagctgggatatttatactcccaactactaagaatcatttgttgagagatgctcctggaagttgctaattccccagaatttcaggccaaacctgtgggtatagtggccttcatcagttatgggaaaaagccaggcacagagacacaggtaggggtctttggaagtcaggtgcagtgaactgaggtgagaggtataagggagatggggagggcacagatggtggctgctataatcacaaaggggtgggtatgtagattgttggggaggaagactttctcatagttatggtcttgataaatatttctatcctttaataaaatataatggaagttttggaataataaacaaagaatctttaaagaaagagagttttacaaaaaccagaggatagtggtgtgggatccaaaaattaattatactatacatttgaaatctgttcatttcactgaaaacaaatgttacctaaattttaaaagaagcaggtatgagattccagattgtaacatctttcaatagaatcctaagctcctgcatattgagatatacttgcctgaatccctaaaattctgcctgggttgtggaccaatagttgaagcattttctctagaacttcagtcagaaaatgttgaaatgtgctctgggtagtgactccccaacaagaaagcaggctccttcagctgcttctgtgccatggtttgtgcccacgctgccttttctaggttttccttgtgaccatggcttgcattttctaagagaaatggctagggatttcatgtctagggccacaggacaaacatctgcaatgcagaagaaactgacagagcctgttcttactaacttaacctgtttggtcaagctagctgagtccatctgccatgcctaaatagggaaatgatgatgagatgatgtcctaggatgggcactaggtcaggactgacctcaatgcctggcacatagggggcattcagttaatgtttaatgggctgagcagatttgcttcagctcactgacatcacctatgactagcctcacctgagaccagaacagggtggaggtgggcgaagcaccaataatgtggaggccaacggcccttctgttccttcttgaaggacccagatatggagctgatgaggtgggccttcacagcagaggagctttctaatgacttttcaattaattgacttgaagctggtggggagagtgccagagtctgaaaaagatgaaaggtattgaagaggaaaagctttgatgtcactgcaatcccattcagatttggaaaggttttttcaggaactttatattttaaccacaaaagcctcatagggtcgatcagtcacgcaagaagatttttgtcattctctgggattggtgggtgatgagaggttgaatggaaagccagaaaggaagggctgtgtgtggtttctgtgggtggcaaacgtatgtgatggagtgggtggacgggtgggggaggtggagaggaaaggtacacaaggagggaatggggatatgtaggtgtgaattacattttcagggcagtgctatgcctattctacaaagtttggcatggatatgttttttcaacaggtttcgttcttttagactcagtgacttcttactgtgtttgttcctaaagctaatctaatctaggtatagtaaccaatataacctggccatttatatacatgcccactcccatacagcatatttatgcaaaatttaaatagtcagaaaacttacagaagtacaattacctcgcagatcaataatgaatacaattttagaagtagacagacccgaaacagcaattgtgctgttttctgctaatggtaagaccatggaggtttggatgtgaaactgatctctcatccacctagaccaggtcttggccttggtactcatgacatttagggccaggtaattctttgttattgggactgtcctttgcattgtagaatgtttaacagcatccctggcctctacccactagatgccagttgcactgttccctagttgtgtcaaccagaactgtttccaaacattgccaagtagctcctgggggacacgatcattgctgattgagaaccactggcctagatagaagcctggtgggtccagcacttattgtactgtcctgtgcaatttgggggtttcaaatgatgacgcttatatggcttcagaatcatgtacaaacattgaaatggaatgattctgtgtgtggtgtgcatgctacaattggcaatgttcaaatgccaaccaggctatttgtcttaccaggacgctccattctctaacagctctaaatgaggtgtttctttttcagaatgtgttaggttagagcatgtcaaattgccatttttttgtgtatggccctaacggtcaaataccagcaatttcatagatttaatgggaacacaccaactttaggagatatgtcctgagcaccttctgaaactcccccaaattgtgaatgtggaaatgtttgtttaggctcatgactctgtcctgtcacatttcaaaggcgagtccagtgtttccacacggagccttgcaccacaaactaactgcattgcaaaattcccctcaagatttctttctcatcctgtggcaaattgggtacagccacatttttttttatttattttttttttttgcagcaactcccattaagaggtggagcctatttctccacctccattgaatctgggctgactttgtgacttgctttgagcaacagaatgtggcggaagtggtggtgttcaagtttcagaacccagatctttaagaggccttgtggcgtccaccttgtagtgtccctcttggccactatcctgagactgccctgccaggaagctggtgtagctcactggaggatgagtggccatgtggaggactgccaaggcaccctgctaacggccagcaccactaaccaggcgtgtaagtagggccatctcagatcttccagtctgctgaccctccagccaaatccagtcaaatgagtgagtccagataagaccagcagaaacaccaccaagtgtatgcacataatcatgagaaatcataaatcattgttgttttaagttactagattttggaatggcttgttatgcagcagtagataactcataaacatccaatggcagctttacagtttttaacaatttcttagagtttgacttcaaatagagagcagtgaacccatgctcccctgggctgctggatggtggctagcatctcactagctgaatgcctcatgccttcacaccagccttgcagtgggcaccattcaatcacatttttcaggaaaactgctgatttctatatttggaggctacgagagagggccaaaaagttataagtaaaagctacactaggccaagtggctgctttacttaatgaccacctgcacagcattcatatgtagtagacacctcatatgttctgcccatgaatatacgccacatacaaatgtcacacatatacacccattgcctactgagtttaaccatgatccatatcttaggcatggttatgtgactgaaaatatcttaagcctacatttcctacaattatagtttggaaggggatatttcaaaccaagaatttcttcacaaatggtgagccgtaattgactttctgtcttttttttttttttttacagggtcttgctctgttgcccaggctggagtgcagtggtgtgatcacggctcactgcagcctcgaccactctgggctgaagcaattctcccacctcagtctcctgaatagctgggactacaggtgcgtgccaccacacccagctaatttttaattttttttttgtagagacggaatttcaccatattgcccaggctgttctctaactcctgggctcaagcgatcctcctgtctcggcctcccaaagagctgggattacgggcatgagccaccgtatactgcctgagtttccatgttaatcactgaacatctcttttgatcttcagcagatgccttaggaagccctttctctattatgtaaggaaaactgtacttagcattctcactgtagttagaactcacaattctttgtgatttctttaatgttgcacacaccagctcccactggactttacctacgtgagaagagaaattctgtctgtctctttgctcacagcatccccagctcatagcgcagggtttggtccctgtttgttcctcagtaaatttatggaccaatgaacgaatgagtaaatgaatgaattatggaagctgagagccgagagagaccttggaattcattgtcttccatctcctgctctgctttgtaagataagacactgagattcagagaggattagcatttgtttgtttttttttttttttattccaggatttttttcctttcaaaagccacttgacacacttgcttatctgatccgttacagcttgtgattatggaagaggaaactgagaattccttcttggactcaatgggatgtactgtgaacatccctgacattgggctagcctcgtgccattcagggcaggcttctgtccaccccatttaaccttgtgactcattgaggggctgtcagacccacccgggcactgagcaggcaccagatatacctctcagagttacattataatcactattcatctgcctgtcaagctgagcccttttctgtgctccagaatgtgaaagcaaaatggccttttccgttatgaagctaataatagttctcatcttgattctacttaacactgaactggagatttggcctctagggtgaagctcatagttaattcatttattttaaaaataattacagaaaccgtaaaagatacatcccaattgggcccatgagtggtctgattctcagtgtttctcagtaaccagttgtgtgctgggtgcttgaagaaatacgaatgtggcaactgcgtttgaagccttaggcagaaggtgaagccggaatggaattcctctgcagtcactctggttaggagcagcgatgtccagcctcctggcacccactcacatcattctctgtgatgacctaaatgagaaagacagttggcttccttccccctcagctcagtcccccatgcagacaaacaggctgcatccctggcagactgcaccggggttatgcgctgtctcatccattcgagaatgatctatagcttcaaaggaaaaaattaacaaacaagcaaagtcgacccctgtctaggaggaaatggatgggttttggggcttccacctcccctccacgtattgcctatgcccctgagccccagggaaagaacagctagtgaagaaaagaagctgtttctagttgtttgtggagcagggagaagaagagagagggggaggaagagagagaaaagaaaaagagaggagggagaaggagaagaagagagagaaagagagaaggagagagggaaacaggcaagaaagaggaagagaaaaaatatctagacagaggggaggagggaggaagaagggagaaagggaaaaagaaagagggagagaaaagatagggactagtttaaaagagggcagaggagtgattcaagtagtgatttcaaaacgtgaataaagctatttaaagtatcttttccctccccaatttcactttgtccttccagatatagttgtaagtagcccctcccccaccacccagtcctcttgtctaattctgaaatatattggagacttggcagcacaggcctcaggcaattcatcctcagaaccagtaaataaattcaacctttccatggtatctggctacaaacgtcaaagagaacagttcccaccctcctggcctcttggtcagctagcatgaaagccatggacttgttgctgggcacatcagaaacagctgtccatgtctcagcctttccacttccagagtgccatccaggtgagctgtcccatgtagaaggcagccccagagagggccttcccctccacgtgtgctggatgtgatgttcatgctagcgcaatgaagaacccatatggtttgccatatgtaagatcactattcagggtaaaaactaagtgagataatctatatcaagcatatggcacatagtaaatgatcagaaaatagtagttactataatctgatggcataataatagccaataagtttttttctctttagcagtatgtgctgggaactattctaagtaaatcttttttttttttttgtattaatgaaacgaaagtttatttcttgctcatacaaaagtctatttcagtccagacaactccacagggaaattgtccttcatgtaatagatcagtattccaggttacttagttattattattattattattattattattattattatgctttaagttctgtgttacatgtgcagaacatgcagttttgttacataggtatacaggtgccatggtggtttgctgcacccatcaacccatcacctacattaggtatttctcctgatgttatcgctcccctagccccccaccccacagaggccccagtgtgtgatgttcccctccctgtgaccatgtgttctcatagttcaactcccacttatgagtgagaaaatgcggtgtttggttttctgaccttgtgatagtttgctgagaatgatggtttccagcttcatccatgtcccttcaaaggacaggaactcatcctttttcatggctgcatattattccatggtgtatatgtgccacattttcttaatccagtctatcattgatggaaatttgggttggttccaagtctttgctattgtgaatagtgctgcaataaacatacgtgtgcatgtgtctttatagtagaatgatttgtaatcctttgagtatatgcccagtaatgggattgctgggtcaaatggtatttctagttctagatccttgaggaatcgccacactgtctttcacaatggttgaactaatttacactcccaccaacagtgtaaaagtgttcctatttctccacatcctctccagcacctgttgtttcctgactttttaatgatcgccattctaaaactggtgtgagatggtatctcattgtggttttgatttgcatttctctgatggccagtgatgatgagcattttttcatgtgtctgttggctgcataaatgtcttcttttgagaagtgtctgttcatatcctttgcccattttttgatggggttgtttgcttttttcttgtaaatttgtttaagttctttgtagattctggatattagccctttgtcagatgaatacattgcaaaaatgttctcccactctctaggttgcctgttcactctgatgatagtttcttttgctgggcagaagctctttagtttaattagatcccatttgtcaattttggcttttgttgccattgcttttggtgttttagacatgaagtccttgcccgtgcctatgtcctgaatggtattgcccaggttttcttctaggattaaaatggtactaggtcttacatttaagtctttgatccatcttgagttgatttttgtataaggtgtaaggaaggggtctagtttcagttttctgcatatgactagccagttttcccaacaccttttattaaatagggaatcatttccccattgcttgtgtgtgtcaggtttgtcaaagatcagatggtggtacatgtatggtgttatttctgaggcctctgttctgttccattggtctatatatctgttttggtaccagtagcatgctgttttggttactgtggccttgtagcatactttgaagtcaggtagcatgatgcctccagctttgttcttcttgcccaggattgtcttggctatgtgggctcttttttggttccatatgaactttaaagtagtttttttccaattctgtgaagaaagtcagtggtagcttgatggggataaaattgaatctataaattactttgagcagtaaggccgttttcacaatattgattcttcctatccatgagcatgaaatgtttttccattgtttgtgtcctcttttatttccttgagcagtggtttgtagttctcattgaagacgtccttcacattccttgtaagttgtattcctaggtattttattctctttatagcaattgtgaatgggaattcactcatgatttggctctctgtttgtctgttattggtgtataggaatgcttgtgatttttgcacattgattttgtatcctgagactttgctgaagttgcttatcagcttaaggagattttgggctgagatgatggggttttctaaatatacaatcatgtcatctgcaaacagagacaatctgacttcctctcttcctatctgaataccctttattgctttctcttgcctgattgccctggccagaacttccaatactatgttgaataggagcggtgagagagggcatccttgtcttgtgctggttttcaaagggaatgcttccagtttttgcccgttcagcatgatattggctgtgggtttgtcataaatagctcttattatgttgagatacattccactgatacctagtttactgagagtttttaccatgaaaggctgatgaattttgtcgaaggccttttctgaatctattgagataatcatgtggtttttgtcattggttctgtttatgtgacggattgcatttattgatttgcatatgttgaaccagccttgcatcccaggggtgaagccaacttgattgtggtggataagctttttgatgcgctgctggatttggtttgccagtattttattgaggattttcccattgatgttcatcggggatactggcctaaaattctcttttttgttgtgtctccatcaggctttggtatcaggatgatgctggcctcataaaatgagttagggaggattccctctttttctgttgtttggaatagtttcagaaggaatggcaccagctcctctttgtacctctggtagaattcggctgtgaatccatctggtcctgtatttgttttgattggtaggctagtaattattgcctcaatttcagaacctgttattggtctattcagagattcaacttcttcctggtttagtcttgagagggtgtatgtgtacaggaatttatcaatttcttccagattttctagtttatttgtgtagaggtgtttatagtattgtctgatggtagtttgtatttctgtgggattggtggtggtatcccctttatcattttttattgcatctatttgattcttctctcttttctttattagtcttgctagtggtctatctgttttgttgatcttttcaaaaaaccagctcctggattcattgattttttgaaggggtttttgtgtctctatctccttcagttctgctctgatcttagttatttcttgtcttctgctagcttttgaatgtgtttgctcttgcttctctagttcttttaattgtgatgttagggtgttgattttagatcattcctgctttctcttgtgggcatttagtgctataaattttcctctacacactgcttaaatgtgtcccagaggttctggtacattgtgtctttgttcttattggtttcaaagaacatctttatttctgccttgatttcgttatgtacccagtagtcattcaggagcaggttgttcagtttccatgtagttgtgtagttttgagtgagtttcttaatcctgagttctagttcgattgcactgtggtctgagagacattttgttgtgatttctgttcttttacatttgctgaggagtgttttacttccaattatgtggtcaattttggaataagtgtgatgtgttgctgagaagaatgtgtattctgttgatttggggtggagagttctgtagatgtctattaggtctgcttggtgcagagctgagttcaagtcctggatatccttgttaacctcctgtcttgttgatctgtctaatattgacagtggggtgttaaagtctcccattattattgtgtgggagtctaagtctctttgtagatctctaaggacttgctttatgaatcttggtgctcctgtattgggtgcatatatatttaggatagttagctcttcttgttgaattgatccctttaccattatataatggccttctttgtctcttttgatctttattttaaagtctgttttatcagagaccaggactgcaacccctgcttttttttttttttttttttttgctttccatttgcttcataggtcttcctccatccctttattttgagcctttgtgtgtctttgcatgtgagatgggtctcctgaatacagcacactgatgggtcttggctctttatccaatttgccagtctgtgtcttttaattgggggcatttagcccgtttacatttaaggttaatattgttatgtgtgaatttgatcctgtcgctatgatgctagctggttatttcacccattagttgatgcagtttcttcatagcgtcaatggtctttgcaatttggcatgtttttgcagtggctggtaccggttgctcctttccatgtttagtgcttccttcaggagctcttgtaaggaaggcctggtggtgacaaaatctctcagcatttgcttctctgtaaagtattttatttctccgtcacttatgaagcttagtttggctggatatgaaattctgggttgaaaattcttttctttaggaatgttgaatatcggcccccactctcttctggcttgtagcatttctgcagagagatcagctgttagtctgatgggcttccctttgtgggtaacccgacctttctctggctgcccttaatattttttccttcatttcaaccttggtgaatctgacaattatgtgtcttggggttgctcttctcgaagagtgtctttgtcgtgttctctgttatttactgaatttgaatgttggcctgccttgctaggttggggaaattctcctggataatatcctgaagagtgttttctaacttggttccattctccccatcactttcaggtacaccaatcaaaggtagatttggtgttttcacatagtccaatatttcttggaagctttgttcatttcttttcactcttttttctgtaatcttgtcttctcactttatttcattaatttgatcttcaatcactgatatcctttcttctgcttgatcgagtcagctattgaagcttatgtatgcttcacgaagttctcgtaatgtggttttcagctccatcagatcatttaagctcttctctacactgtttattctagttagccattcatctaaccttttttcaaggtttttagcttccttgcaatgggttagaacatgctccttcagctcggaaaagtttattaccgaccttctgaagcctacttctgtcaactcgtcaaactcattctccatccagttttgttcccttgctggcgaggagttgtgttcctttggaggagaagcagcattctggtttttggaattttcagcctttctgctctggtttctccccatctttgtggttttatctaactttggtctttgatgttggtgacctacggatggggttttggtgtggatgtcctttttgttgatgttgatgctattcctttctgtttgttagtttttcttctaacagacaggcctctcagctgcaggtctgttggagttggctggaggtccactccagaccctgtttgcctgggtttcaccagcagaagctgcagaacagtaaatactgctgcccgatccttcctctggaagcttcattccagaggggcacctgcctatatgaggtgtctgttggcctctactgggaggtgtctcccagtcatgctacacaggggtcagggacccacttgaggcagtctgtccatcattagagctcgaacgccatgctgggagaaccactgctctcttcagagctgtcaggcagggacgtttaagtctggagaagctgtctgctgccttttgttcagatatgccctgcccccagaggtggaatctagagagacagtcggccttgctgagctgcggtgggctctgcccagttcgagcttccctgccactttgtttacactgtgagcatagaaccatctactcaagcctcagccatggtggactcccctccccccaccaagctccagtgtcccaggtctatctcagaatgctgtgctagcagcgagcaaggctccatgggcatgggacccaccgagccagacaggaaggaatctcctggtctgctggttgcaaagacaatgagaaaagcgcagtatttgggctgaagtgtaccgctcctccaggtacagtcactcatggcttcccttggctaggagagggaaatcccccgaccccttgtgcttcctaggtgaggcgacaccccatcctgcttcggctcaccctccatgggctgcacccactgtccaaccagtcccaatgagatgaaccagctacctcagttggaaatgcagaaatcacccgtcttctgcatcgatctcgctgggagctgtagattggagctgttcccatttggccatcttggaaccaacctccctgttctaaatacatcttaaatcaatcctatgatgtaggtgctgttaccattatagatggggaaactgaggcacagaatggctccagttcctaggacctagacatgagggtctgttttaacatgatgatattgatccttcatgagcagagacagtgacaatgaagggagaagagaattcagtaacatccgctgcctcctcttcatctctggcaccactgcctaaaactactacgtactcctacctggaccatagcagctgcctccttcctggcctccctacgtccactagtgtttgctgcagtccattctgcacacaaccatcaaagtgatcctttaactcatgggtcacacactggcgtgcccctttataaactcctcctttccttcccactgcacttaggatgaaatccaagctcctggccatggcctgcaaggccctgcatgacctggcaagctgttcccaccggtccagcttcatgctgggccatactcccttggcacactggcccatcaccagtttttaaaatacatcaccagtttttaaaatacatcaccagtttttaaaatacatgcaagctctttcctgcctcagagcattcatacctgctgtttcctctgctatttttcccatcacttcatcctccagaactctgcttaatgttacctcctcatacttgagtatccctccccctcctccatgttttctgtatctcaacacactcattatatccttcatcaatcttctcacaatttattaatagaagtcttttcatttatttgagtaggtccttgatttctctttacttcccccactaaactgtaagctccatgaaagcaataaccatgtctacattgtttgctgttgtacctccagcactcagcacaatgctcctctcatggtaggtgtgcaatcaatatttattgacacacaaatggctcatgtatctggcatgtctaggatgtctatttggaagcatgaagggttatggctggggctcagctcctctgacttctctcactgccccaaatcttctttatacccccttgcctgccattgtgtgccccagacacgagcaaaggcctgtctcattccagagagtggtaccctccttggaatttcaacacaaagaggccacagatctgttgcatagcaagaaaagatagtgtctgttgcaattggttctcttggccttgtggcaggatgcagagtgaaaaatagagggatattagaagttcaatagttctctcgatgtctagagtatccagggaatgttattcactgaatagcacttatagaatacctaatatgttattctctcactatcctcagccacccaaaatagttgaatctctgactcacagataatcagtcatgtatatattcaccctccaataatttaatattacagaaagtgaaccagaattcagctttgcacctttggaagttaatttcttctttgtatgattactagagatattctctgataagggtaacgagatgtatagatttggtctcttcccaccttgctgacattccttgaatttttctcaggaagactgatccaaggcaaatcacattttttctcatcaccccacctttgtcctggccaaagggtgaactatgggaagatctcatgggtggtgttctaaacaactttcccttgattaaataacccttctcccaagggctacttgtgtgggttaaattacttaaaaataaaacaaacaatccagagtaagagaattagtttgaaaaacagaaggttaccaacagccttgccctgtacagctggaaaagatgtgaaacgcacaggctctaagcacccaagaggataaataaacgtgtcgcaggtgccattaagaaaacacatctgcacactgtcaatggtgaggataaacacacgattgttttccctttcatgagaagcagtgatggggaaaggcgacttatggaccctatccagttctgttcaatttacagcatctcaaggttgagggatgggcacttatccagccttgatgcattcccaaaatctctcatcagaagcaaatcttcaaagaaaacaaatagtatgttcattctcctcccagtgcacagacaggagaacaaacaaggaaagaaagaaaatgccctaaaggttatctggtggacctcagttgcccgagattgtgattttagacccgacatccttctctggttttcctccttctcctaatccccctgccagtaggaagatcaaatggaactgacataaatatccttcccagctgttaagtgtagccattgtttcttcttttaacactacactacactccaaacttccagggtccatcaacttccctagtgtcttaatgaagtagattatacatttttatgaaccataatcagaattcatgaaagataactaggagcctagggaattatgatggatccattcaaatcctcatggacttaatttgagaaaaggttcaaatgcacaagaaaataaaggcgacttttggagatgccaggcacctggaacctctgtgctttgtatttctcgggttactgatagtttgctatagaagtcatgagttgaatcttcttcatttttattagatcaaatgcctcttatattatgtgcctaaattggaaaatggaatatgatgaatgtcttacaccaggcttagagtcaaacatctatatgcccttagccacctgaattttaacatttgatctaaagtggattaaatatccactttaaattgaaatacccactttaaattgaaaacctcaatttttcatactaatagaaggtggccaaaaaaacctgccaacacctcagaaatcattcacatttgactttggaaagtgttcctggtttattggctgacatgctgaaagttggctctaaagataataatgaagaaatatggaaactgactcagagttagaagcctgtctgtgtctacctcattctgtcttgtctcccttcctctactttctgtacttcatcaaactctttccattttctcatctttaaaaagggataggagtgttttggcagggtggttaaatgagaatgtttctaaggactcctccagtactatagttctgcagtttaatagaacatatatgccctgatataacttccagctattcattcattcattcaacaaacttgtttgtgtgagtgcctgttaggtgttactgtgctagccatgaaactagcaccattcttgtcctagaaataatataaaatatgtttgttaaatatgtagtaagcatttcataaatgctcttgaagggtgtacacaatagaggctataacagcttctctgaacaatcctgtggttaatgatgttctttaattatgccaacatccaatacctcatgttaaagacttttagcattttccagatgttggaaatgatcagaaaattgtatattctcagtaactatgaagaataatctgagttcttagttgtgggtgctgaggcccaagaggtatatccttcatcaaggttacatgtgggtagaggtagatgcctcctgcatcccagcattgggttagttagctaagaaagtaggctcgaggcccaactgccggggttccaattctgtctctgccacctataggttaagtgatcttgaggaagtcatttaacttctctgtgttttagtttccttctctgtgaagtggggctggaatagtaactggctgcatagggtgtatggattcagtgagttcctatatatcgaaatactcaagagtgtaaacagtatagtttcatgtgtaataacagccattagcaacaagaagtaaggctggactgttttctcacatatggcagaaattcaattggtgttataaaataatcaaaactggtaaatagccagttcttagatctatctgtccaagatatttcatgagcagattgtatttccacaaacaaagaaaaacctgtttacaactgtacctggcatatagtaagtgctcaataagtgttcgctagtatcttgcggcactgctctcatctcctgcagtgttggagagggtgtttgaagcgctttattggagtcaaaggataatgctcccaccccctgactctgtgcgcatgtgtgtgagtgtgtgtgtatgtgtgtgagtgtgtaccagtgtacaaaaaggtgtgttgtagtggaaaatcaagtaactcactcagtaaattatctcagccaaaagttcagttgcaggaaatcaaattcggatttgtaagcctggtgaaattcaaattccttttaaacatttattgccatttctaggcaagaaacatttcccctgatcatatcattctggccgggaagtcttgcgttttaaagcaagtaaaaagtgaaaaaaataattctcagtacatgacacaatttacagttagctcctcaggaatgtgtgtcatgttttaaacttgagtaggttgatgctctccaaacatcctagtccttcgtatttatagagtgctttattttagtgtgttaacaatgaatgagaaaaagcggaactttctgtaggcattttttcctgatgctattttgatttgaatgcagccttgcttctcctgcctttttcaagcactataggattccattctctctctctctctccccctgctccccctctccctctcctttttatccccaaaggaaacactttaattgcctttattgatgaagagaggaaaaatctaaacatcaggcaaccaggctaatgagggacaggcggacatgccaactaacaaagaacaaaaccaattaccccctctttacgcaggcatagcggatccagacggaaacagtgaagaactgtagcagatactatgagtgccctgcccctatccccttggtccagtcggtggtcacctgtagctcagtggaaattggctacacacctagtttctcacctcaagaattgcagtctctctgtctgaaggctttctctgggcttcaggaaagtattcaacacccactccaccctgctgcagagtaactggcaaccaaagttgggtgagggggatgatttggtgggagaataccctagattcctcccggccttggtgagatgtgttctctactctccctcagagggtccccagcaggatggagtcccaattgcccaaagtggcttgtactggcatccttcccttccctgtctcacatccccccatttctttctggccttcctagaattacccaaatcatgcacctgaatcatcctttcaaggtctgctcttttggggaactcaaaataagacaaagacctaaaaatatttcaccaatgatagtcattatcctgcccctttccccactctctccaaatgccagaaaaaaaaaaaagaagggaaaagatggactgtagagctatcataaaacccttcatttgagcattctttaatgccatacactagtttgggatgtacagttctctttaggtactaaaagctaaggtgtcttcagctgctaattttcattaagctattcaacaagtattaattgagcacctactacgtaccacacactatcctgggtactgggatgatcttagtgaacaaagcagagaaagtcccttccctctttctctagtgggagggggcagagaagaaacaataaatgtaatgaatagataaagtagatagtatgttagaaatggataactgctatgaaataaagcagtctagccgaacactgagcacaggagctcagcagtgggaggcgtggggaactggttgcagtgttaactagggttagcagtagcttttctgtctcctgcggaggacagagtgtggagcttgatgctgtgatttgttgctcctgcaagatagccactcccccttctcatttcccaagtcagtctccaaggagaagctaatgctattaatagtcactaaggacaggaaacaaatgtctgtcttctctccagatggaattctttgctcacattgacttctttactcataactagagcttggctagcagtatacatgaagaagtaaatgttcaatgaatgaagcatgcatgtcgggaactctctgattgaagtccagttgaactttaatgggcaaccttgctgtagccaggaccactggggcggggagggcagtgaggaagttggagagtatgcctcgttcaaattcccctgtaattaaaagtgaagcttaatcattagtttcaagggcatggggtggctctcgagcacagtggggaaatctgagtttcaccttctcttgcctcctgggaccatgcagatgtgatctcaaggctgtgactctggatgaggttaccagggagacaggaagcaaggggtaactccaatatccctcttcacagggtgacatcagaatgtgagaggacagggctcaggttaattctggcaacatctattcctcgtattgttcctggagaggagtgaaagtgtggagagagaactgggccacgtctatgactgggaaagaaggtggagaactgatattgaggaaacaatggaggcttgcacccaagagttgatggtagagggtcccccagaaatgggaagagagactggaggtgggggagccaagctaaagaatccagctgagaagacacaggggccactgcagagggtgttttgggcattgggaccaccagccatgaagggaactgaaggaagggagagaagtcaaagacacacaggagaagtgtgttggaattggctaataattccaacagagtaaaatgaggccatctgtagctggctaataattccaacagagtaaaataaggctgctgcagctggtttattctccactctgtgctttctgtggaatcgcttggaggaaaggcaggctggcctttggaattaacaggttaattaggaaattgggatttcctgctttctagggctgcctttcaccttccccttcgtggtgacttgaaactgatgaaggcaagatctcctgcgaacgtttggaatgaaacactttgtcaggaaaacaagcaaggaaatttgacagctgcttgatgtaggacagtcattaaactttcaagaatgtaggtcttctattatttagtgacgttaatctctcttccaaaaaagaaacaaaaaagattccagaattgcagagtgagaaagttgtgccattggctctgctgaaagtcaccaagggccctgcctccacactccctttcttgatggggctactgagctggtcccgtccggccattgaattaaaatcagataattcagttgggttttcgggagctgttatggaggcctcaaatttattcagtttcctcacttactttctcttttctcttccattacctgctttttagctatttccctacttttaaaacccagcattggagaaatggggcgaagaaataaaacttcaatcaaccatttgttctgttgcctgagggtgtttctgggaggaagatttggtacaaagggaagttgaaatgctggccaaaaggagattttacaaaattctgtagctttccttgtttcttgtcactgaagagggataactaagaattgatatatttattttccaagaaaggctgaaacaccatagggggtaaaagcaaggttgtgtagcagggttttcttcaactccatccatacctagaagtgagaggggttgtccagttaggaggtggatgagggaatgataggaactgctcctctggtggctttgagaagagagagtccttggccttttcttggatatgctagagctcttcagacatggaggacagtgcgctccctgggcctgctaggatacaacctgactctgcacagagaagccttttagatgcatggtgtgtttccccacattctaggtggctgcaatgggggctaagtgctcaggggtgaatcctgcctctgcaaccttcctgcagcacgacctaggtcaagtcacttggccttcgtgtgcctcagtttcctgttctttaaaataaagataataaaacccagattgtataagtgtgtgctcacaggcagacattcatacccatacacatatgcacacaggtatgtaaaatggatgccaagttaggaggggccatagccagctgtgagtctgagttaactgggtcaggatggtatgggcattgaagccctgccttggctcccactgggaccatatgccaacctactgattgagtcattggtttggtctttctatcatgagttggagtttaactgctctgggaagaatctggatgttttataacttttggggtagaacattccaccaggctgtttctacatgtcatttggagtgccactttccaatgatcttgcatagctaatcaacaaatatttcttggccactgtgtacataattctaggtgcaggagatacaggggtttgcaagtcagataaggtccttgagctcagagagcttatatcctagggaagagagggagataatgaactatgtcaggtggcggtaagtgctatgggaaggatactgcaaatccatcccataacaagtaatgcctccaactccattcattcatttggtattgatggatcctctgaggatgatgtaacgagcctcccaacttccaggtgtttacacaaatcaatcctctctccttcctccctaaacaaggtatcttgtgttcaagggaatgatctggagtagttaatcttaagcaaaactaattcagccttgaaatgcccaccagacgtggccacccaaacaaattatttccgccaaaggaatgacacaggtgaattcggaagacctagatttggactggctgttgcgaggaggaattccctcagcagataagcaactcccgaaggaaacgaaggaaagtcagtcttcatgccatcccaccttgcctcaccctgccccacttcacgtttaagccagagatgtccacaaattattgtaggatttccctgtatactttcctttgttaggtttgactggggataatatcatagctctagtgaaagttttctgctatttggtgggttgtaaattgaatcttaatgaggttttagaacaatgttcatgtaaaaatatatttaggccatttccaaaatggagcttattaatccaattatgcaaatggatgtggcaaccagcagatgtccctgattcttcttcctctctctctgtctctttttcctgctctgttttctgagagggttgggagttggcatagaggaagccctgatcgaagtggataatttgtttgctgagacaggcagtcctgtgtctctgtaagaagaccagaagctttccttatgggggtatgatgggcagtgaggagagtttgagctgccgagttttctagattctctgatttgaaaattagagactctcaaaagaagtctgtccttcctgagtaattgcatcctgacactgttgaacttcctctgggtttcgactttcatacccctcagaggctctgaggagggaggacaaaggagaggccaccccttccctggggagggagggcagggtggggcacacaacccagctactcgggtggctactgctcctgctttctgggcagagaagctgggtgtcttgtttctccttttcctcttgcctgctgccttggtgggcctcctattggtgtttgttcaccatcagtgtctcgtggcagctgccacacaaagttctgtttttgcaaaaggcggtggcatcaaagataaacgttggatttggcagtaattcatgaattttattcagctactctgttcttgtgatatgaacaaaccttgttagaccagagccactagtgtggaatttgggatgttgattcaccaaggactagaaaatgagtaatgctgggaaagctgggagaatatttaaaatgcctcagaagatgaagcattttaagcatccccagtcacttgaggtcccctttttcaataccttttcacaaacaaatagtctccctagaaaaccttactgggtggtacttggttggcctggcttcaacacttaaagacgagagctatactttcttttaaaatattgttatcaatataggaacttagctttttttttcatgtagtctgaattaggctgactttatagcttgcaacatcctttttaattgcagaagtaatgcagttgcttgtggctaaaaaaataataaacagtaatgcatacaatttttatttattttcgtgaggatagagacagggtctagttatgttgctcaggctggtcttgaacccctggcctcaaatgatcctcctgcctgggcctcccaaagtgcagggattataggcatgagccaccgtgcctggactacagttttttaaaagtggaaagtagcccgtctccaaactgttccttagagttaatcattatttattattgctctagctgtgtgtcgttggactggttacctaacttctctgtgcctgtttcctcatctgtaaaagtgagacaatattagcacttacttcatagggtggttgtgaggatttagtgcaatatctgacattttctgggctaaactactattagctattgttgtgagtagtatgtgctttttctgtatatcagtgctgagtacatgtttcttagattcagacctttaggggtatggcaaacatcaatgagcagtgttttgccagcagcattttcacccaggatggggcgatgtgagtgaagaagcagggccctctgtttggttttctaaagatccattgggatccagtgtggttagattttcttcatggttgctctcttcaataagagaggagaatacctggaatgggccttttgctctgaggaggggtcccccaggtaaagctattccttcccttggaagcacctgcagccttcctacagatgccaccatccagaggaggccccacctcccagggatatcatgggggatttatgaccaaaaataatagtaataataataataataataataataataactcagactgacttagaacaaaaatcacattctagatgagctgatggaagatcgattgaggttttagggttttttttatgaagtgaaaaaaagaactgtttattttgccaatttcattataaaaaaataataagagtgtgtctctgtggttgtttgtacacagaaagcagaagaaatgagaagaacctcgaagtcatctggcaaaaggcgggaccagactggagatgcttttttttctcttttcaaaaccaggagtgtatttgttatcacacaatttaattcaaaaagtccagtggtagagtcagagcacccatctccttgtcttggttctgccaccaaccagctctggggcctgggacaagttacttaacctctctgtgccccctcttatctatttaagaatatgggtctggaagttcttgtcttacagaaccatgttggtggtctgagagcagtgacaatgaggtgctgtgggttgggtgagtgtgggagtgtctgtcctttgtatactgcagactctcttctctggatgtgccaactgagaatggctacaagaacatcagaaaacaagccaccgccctaaaggtacttagatccaaagaaaacccaaagcacacatgtaaaagctgctcaaacacatacaaaggaaagcatacaattatagtcaccacagagcatttaataataataagatgcctgagagaaaatgtagctgggaacccacatgggattgacagaaggacaggacactttgtcacttgctttttcaataaacagatcagattctcctttttaaccacatgctccttggccaccttctgtgagcaaacacaggatttatcgaagatctgagaatgttgctaatgttgcttgacccctggtaggactagaatccatgacttccttagcccagccctctaatcaaccctgcccatccaccaggtcttgggaagctgggcagagatgccataagcaaaggactgctggctgaagcaccatgggaagcatggatgctccttctctgtggccaaaatggcagagcagccctgaaaaaactttcttggctgtgctgtaggctttacacaggcttgttattattttttgaaccctctgagattgacagggcaggaaatggtatcacgattttctcttaacttctaaagtgacttgctatagtcacctaggtttttcatgaattatagaagagaagaggcctaaaaactgaatttcccaatacctgggacaatgctgatttagtaagttggggtttctaggagaagatagaaatacattgacatatattaatccattgattaattaatttatgaggcaactgccatctacattaaagaatacacatttttttcacttaataaaaatgagatctctctcatgcacttcttaagcttcttccaaaaacaaactaccaaactggtaactgtccaattagttggaataaattgaacaggcgccctcagttaattgtcaaactgagtagtctaaaaaccacgtaacaccaccaagcacagagtgttccttcccttcctcaccaggtctgctgctctgggaacagggttgagaaccccttccagtttcagtccagcgaagatgcgttctttggccatgaactagaagccagtcctccatgcagtgcctttcgggctgaagccagttgtccactaaatctgcttgggaactgatttgttaattattcttttccttttgtgacatttttcaagataaacttacttgggccagcctcctagaaaaccttttaaaatgctaattacgcaattgtgcgaataatgtaaaaatgagtcctgtggtgcactcagcacttgactaattaacaagcagtaaatgaatcctagcctaggaaattctgtacagggctgtgtgaacggcagagagcttcctggagccacagttggaagagtggttttaagcaaataggttcttagagaaattgaccagtgaaaatcaagaattatttggtcatagcataatcttttaccaaaattgaatatcattggtggatttgattcagcaaatgtttgttgaagccttgtaaggctctataatagacctagggaacaaggatacaaagatgaattagatatgaaggatgtcctgaaagctaatgatcttgtgaaagacagaggcgagtaatcagagactacagcgggatggcttttaacttcaaggacagaataccatagtaatggtggctccaatgataaagattgtcttacaaaatataatgcctgaatgtagatggttctagggttgtctcttcccattcttttgcttggtcattctcagcatgttggctttgtgttcttaggcttgtcttgtgattgcaacatggttgccttgttctaagcatcatattccaaaataacacggttcaaaagcagtaagcaagtcagggtctggggaggggtgcagtatggtaggagatctatgctcccacatagcattcacaaaaataagtcacatggccactcctagatgccagggttggggagagggtgcctggaaatccagtctggctctgcagctactttccatcagcagctcaagactatggaagggattaaaaaattttgttggccagttggacatctctgctacataatacagtaagcgctgtagtacagatgcatacagaagacagagacagtcaattctgccttaaaaataatgggaggttttgtagaggacctgacagcttagctgagtcatcaggtggatgacagagagaaatgtgcaaagcatagactcacgaaagagcttatcaagttattgtgctgtttgtgggggattttttttttttgccctttttccccattttttggtcaaacctcacgacctagcaagtcatttaactcatcagggtttcaggatcttcatctgtgaaagtgaggcagttggactctgtaaacataaaatgatctccattgttctttcatcccttttttgtttaaaccttcagagtagaagttacatagatattaacagtctcaacatttcttgtacagatatagcagggttctttaatcttatctcctctataaaaatacatttcaaaaatttctcagggaggcaatgtggtattgtaggcagagcatgagattgggaatcacggatctgcatttgaagccaaactttgtcattttcttgctgtgtgaccttgagaagacacaacatctttaagtctcagtttcctcacctgcaaaattgagattatagtacctgtcttccaggtttcttggaagatttagtgataattgtttttcaacacatagcacagtgttagatacttactaggttctcaataattcacaaaagaagaaatacaaatggccaatacatgaagttttatttttattttttaattttttatttccataggtttttggggaacaggtggcatttggttacacaagtaagttctttagtggtgatttgtgagattttggtacacccatcacctgagcagtatatactgaacccaatttgaagtcctttatccctccccaccttcccactctttttactcctgagtccccaaaatccattgtgtcattcttatgcctttgcatcctcatagcttagctcccacttataagtaagaacatacgatgtttggttttccattcctgagttacatcacttagaataatagtctccaatctcatccaggtagctgcgaatgccatcattttgttcctttttatggctgagtagcattccatggtattccatggtatgtatgtgtgtatgtgggtaacattttctttctccactcgttgactgatggacatttgggttggttccctatttttgcaattgcgaattgtgctgctataaacatgcgtgagtgagtatctttttcatatgacttattttcttctgggtacatacccagtagtgggattgctgtatcaaatggtagatctacttttagttctttaaggaatctccacactgttttccatagtggttatactagtttacattcccaccagcagtgtagaagtgttctgttttcactgcatccatgccaatgtctattattttttatatttttttgattatgcccattcttgcaggagtaagatggtattggattgtggttttgatttgcatttccctgatcatcagtgatgttgagcatttttttcatgtgtttgttggtcatttgtatatcttcttttgagaattgtctattcatgtccttgtttgagagcaatacatgaagttttaaatgttcaatgagaaataactctctgtgtgtgtgcaagtgtgtatgtatcaaatgggcaaacattttttaaattggtgatccccagcatgggtgagggtgtgatgagacagagattctcatatattcctaatgggaatatgaaatgatacatttctgggggactgtgtggcagttggaatctgtcttttgaaaatgttcgaaccctttgatctggtaattcaaaatctaaaagcttatgctaggtggaccatctatgatgatatgataggatacgattagtataaagttgttcatcttggtgctatctggaataaataacattggattcatcacaaatgatcaacaacagacaatttattaaatgaattaagctccattcatggtttttagtattacccagatattaaaaatcatgttttgggaagatatttaatgatatggaggaaatggttgttatataaaattatttaaaaagggcagtctataaaacagtatatatagtatagtcccagttttataaaaacaaacaccataaatggaaaaatgactggcagtaaaatgccaaaatgtgaaaatgattatctctgggtactgaaaaaacaagggttttttattttcttctgtgcctctgaattctccaagctgtcttgcattgtgcatgtaatgatgtggaaaacacttataaaattaagagaaaatatcatatcaggttagaaaaattaccaaaaatgtcagaatacaaatggactccaactatgtaagaatacacacacatcccccccaacacacacatacaaagaaaaaccaagaagatgaaaggaactatgtccaaatcttagtaattttctctgagatggtggaatgatggattatcatcattttcttctttatactagtttatatttttccacttgaatagaaaaagaaaatcgccaccaaataaaacctataaaaagaagttttcttgagtactgtgttccatatagtcactggctctggtagccataagcaacacataaatctgaaggccaggacttcttttaccccacagctggggaatcatttgtcctatgtggaacctggtacccatgttaatcctctgcctcctgaatacatcaagtcccacattgtaaaaggcaaaaggacaaggccagagttactgttgatggagaaaatgagtggattttgctggtgtaagagatagcaatagaatctgtgctctaggtcgtagggagggcaccctgcattttgcaaacttgtgcttgctgatccaataggcacccctggttggatgcagggagctctctggtggccaaagggtgtcaacgcagcaatttttgcacttccacaaccaaacccaagatctactagccgagatcagaagccgatgcatacttgcagattacattttaagcccttataatgggtaggaaaacatctgtctctattatttccatggtatttggtatgaagacagaatcctccaccctgcccttaaaatttcacatagaataggtatgctttctgccttcgtgcccaggtcaaactcacttgacactgcgtagttttaaactgtgtaataaattgcccgaggtgcaccaactaatgtgtgaccccggatcacactgcttgccccacaaatccatactgtgtgaaattgaccttgctggttgtttttcaagtgggtctttatagcatcatagaatggaaggagtcttaaaaacaaaaagactgagacagagcttgctgaaagaaatgactcattactggctgaaccgggaatggaatatatttccaatcttgagaatattgtccagcaggctccctcatttccctccggctgcctttatctgaggtggccaacttgaaaccaaaactaaagcttctgactctcgtggttcctggatagtcttgtgtttctgtgtgtttgcatcatactgcgactgtgcatctgagatggagtggtccactgatgtgtgtgtgtgtgtgtgtgtgtgtgtacatgtgcatgcaaatacacatatgtataatagtgtgcagtcactgtaataatcactgtatacctgtctatctctgtcattttatttaggcatagtccatagactcaaccatattatacattccttggagatgatcttctgtgtcttttgtacttcagtataatactatccagaggtgttggagccattagcacaatttaggctactttctttgtaagccatgattgaaaacaatgtctgactcatttgggtccttaaactcaggactttgtttgtagaatattgttctatatttagcttttgtgtcagccctaggttttaaagaggcctgaagattagtggaaacttaccccctgggtattctagaatgttccattgagaggtaattaaggggaagaaaaggaacaacttgtgctccccaattggcaagccagcgacttggttatatatttctgtttgctggagcaaaagagctttgaattctatcccattttaacatcgtctcaacaatcaccaaggtagtttaataatggcaccttcgaactttgcctggcaaatggaaatctgaggataagccctgaaatgttctctatagtccatttgaatgttctatcaaatttattcattttgacaatgactttttaaaaaaagagaaatgtgccaggaaatgataattttaagtggaccttaggaatgttataataaagcccagtgctaggacaaagcaaggaccagcttggtggagggttttggaggcagaccaatggggtttgatttttgacactgccaagctgggaaggaagaagtgcagggggtatagacagggcagatgggccctagatggttgttacatgtgtgtgatgggtatgtggaatttcatggtaaagttctatctactttggggtatgttaaaaattcatcattcaccataataaaaacctgaacatttttccaaaaaaaatttttaaaagaagaaggaaacaagcttggccaaggacattcaacaagtaagtggcagagaaaagcagcagcatgtaatgtaagagcatacttattgaaacatcatggcacaaaattaaaatgagcacaggctttgaagtaggatatgagttcaagttatgactcttactccatttgtaaaccttaagtcacttaacctctctgatgtcaacagtcccctccgctataaaatgaggatacaacactcacctcccagagttgctgccaccatgagaaattaacatatatgtcaagcacctagaaccctatttggccttgataagcattcctgcttttattattaatatagtaagcagattaagaatcccagtggattccagtgggcccactgggaaggaacatattttggagtcaccattcctttggtcttcaggaaaacaggagctcttcaggcacatggggaagaccagccaagaagtcccaatttcttagaacttggtagtttgggggtctctttcaggctgcagcaacttaatggggatgatttcccatcaaatctcaagggatacctagttgttttgataggagaatgcaagaatccttcacacaggaaggacttcaagaataaacgacttatcagtgtggaactgagcccctgatctcctgtttccacctccatccaggtacccctggattcccaaaggtagaggtatgcagctattgtcagcaatgagctgtaaacttcttacatgtctatgtctatgtctgttttacttctgtatccacaatacctggctcacaagggatactaaggtttcgaggggttttttgatgaatggatgagtagatggacagatggatgggaaagtaggtggatggatggatggatggaggaaactgacctgaagcgggatgcctgtgtgtctgtgtgtgctaagagtagagttttctttttcagtttctttttcatacctgtttgtccttttttgaagtctccactaaggagaagcacctactatataccagatagtctaccactgagtacctattgtgtaccaggtaggatacaatgaacatctagtttttatattatttaatcttcccaacaactctgtgaggtaggtcttattaacaccactttacagatgaagaaatctatgttcagaaaagttgaataactggcccgtgtttacccactttatataataagtccatgctctttctggtacaccatgcaatgtaagcattcctatagcaaaagcaaaacaaaaccaaaaccaaaaccaaaaacaaaaaacacgccagtgtagaagtgaggaagggggtcactaactcaaaggcagaagaaagtccaatggaagaaagggagtctttgcttggatatctatgagagggtgggtggcaggtgagggagggcatggatcagtaaagggaagatagaggtacctggcagtcttacacgccaaggcttctcctccaagtggaattcagtcattggttggaaggagtaaggtgggttactctgtctccgttctgcctggggtacccctgggatcaggctattccacctgtccaggcaatctctgtcaacaaattctaaggcaattcggaggcagtgggggagactgaaggtcttgcctgtcctattgtctttgtttaggttcagaaaaagaagcaaacagaacaggagaagacactgagacattgattcttgtgcacgcccttcattgagagcgtcctctcagaaggggcataagggaagcaggctgtgactggggaaaagttctaagcaagtttgtggccttagctaaagactagctacagtgcaatctcactgcagcaggaattgcaccacagagttgatcccaccttgaagtagggcactggccttttgtaccatgctatcagccagtcattagctatgggctgcctctgggagaggaggaatcaccttctgagctagatgattcccattggccaagggcaattctccagagaagtgagttgcttttagcagccaacactcatagctggtggggaggaggattccaccagagttaaggggatctgggtggatatcaacagcagccactacacccaccaagctgctatatatgttcctgctgacatggaatatatgtagaagttctgtagggattttggctcttctcattcagatgcaggctgccttgctgggtgcagatagctcacctgcaagctcattctttgatcctgaagagtgggtaccaagcaaggatcctttccatgagactgatggtatagacactttccctacccattctttgtgagccatctgctgctgaagtcctcctctgtctcagctgagatttaatgtggcaacatctgccctagggttttgactttaatggcatttatcatgcacacttccctttgatgtaggacagccaacctcatgacatcttctgtcttctatctccaggttttatttctcctcttagtttagatgtccctcatattctctctaaactcctgtccaacccttccctctcaaatcttgttaatacttaacctggggtcaaggtttctttgggcgcagaacaatgaaaaggcaattagctagctggctttgagtgctaagggagtgaaaactggttatgactctaacttgagacattcctaagagtaggcctttcctgtatggtcaagactgaaagaaataaacggatgtgggcttttttcttgcctttagactttatggattagtcataggatcttgttgaaattattcagtccagaaataagtgattaacatttaacttctttaatgggcaattactcaacagctatgccagtgggtaaatatttacttatcatctattccaaggagtgaatgttaacttgagtcaaacagttacttgtgttggttctttaatagcggaaaagtgaatttatatggctctaggagttccaatttcccaccaaataagaacttactgaaggatgttcagagccctgggctggagttaaattacagacaatttgcttacctactccctccctccaaaaaaaaaaagatgaagattttttgtactcaccactatttattgaaatctggtagcttcaaatctcacaaagccaaacaaattcactcagtttttcagtctgtaggtctgtgacagcctctgtttaccacaaaactgcctgtatcttgtcactatggatgcaagtcaagacagaggcaaagtctggatgatgaatggcttgttcttagtaatgtgcttgtaattgttcttccttagaatgggaaggatggcttgggaggacctgtctatcatagagggacttggcagcttccaatctctttgcttgcttgtctacaatgcagccaatgggactaattcaaatatcccagacatgcccagatggatacacagagcatatggcttgaagactcagttatggaaataacaggcaccatttctgagactttcaattcacttccaacaaatatattttaatcaacaggcaggaaaccaaattaaaagttgaagcatgaaccaaggtcaaaggttaagggttaggatgtgggattttggtgttcatgctccaggtttggcctaccatgcagagaggtcaaagatgactgcacagggaaccattgggagagaggaatgtggtattccagtttgtagaaagtttgagagtctggaatttggtatattagtcagtgccagccactccaagtctcaggggcttcacacaaagtttatttcttgttcatgtcacattccaggcatgggagtggggaagtgagggatcaggacctgtgttccacgcaggcattcagactcccaggctccttccattttatgacttccctgtgccctaaggcctccaagtccacctcagctactgcatccagactgcagatgaggcaaagagaaagtgtggaggatagcgtggaggttttatgggcccacctatattctggccagaactgtcacgtggccccactaacatgcaagggaggctgggaaatagagtcatctgtgtgcccaaggtgtaaagggaaatgttttggtgtaaaactagccagtgtgtcatacacggcttcaggaacttaagactattcttccgtttttttttttttttttttttgatacggagtcttgctctgtcacccaggctggaatgcaatggcgcgatctcggctcagtgcaagctccgcctcccgggttcacgccattctcctgcctcagcctcccaaatagctgggactacaggcgcccgctaccatgcctggctaattttatttttttgtatttttcgtagagacggggtttcactgtgttagccaggatgatctcgatctcctgacctcgtgatccgcccacctcggcctcccaaagtgctgggattacaagcgtgagccaccgcgcctggctattctcttttttttttttttttaagaaaaaacaaaaaactggcaggggtagggacaagggatacactcttcctcagtgagcatttggaagagagctggagaaagagcaaaagaagagagcaggctagaaatgacttaaaaattagtgggatattcctggagagttgccaagctagaggagattcacttccactcataatgggagataaaaattgttctcatttgggtttattttttttccaggcacaggctttagagggtgagttaaacttcctaaagcaaaggattagataagagggaactcagctttgattgaagagccagctgtgtcagaaagtaacagggagaggaagagtgggtcgagccacaccgcgggtacctgattgtggtggactctggaggttgcctgtaaaaggagacactcctcaggctcctcattcactagggatgttcagtgaagaacaaacccaagcgagagagggtgcccagaatgatcgcaggctcatttctaggagggtaggacactcctgcttgattctctctcttctctttcttttcttttcctgtctatgaatgcagccctgtcttagtcagctctttttggaggagacctgtgatggaagggaaggttctgactgggagctagaggaaaggccagggttcagggcctgcctacccagcaggtagactcagggggctgtgtcctggcatgggtcctgactggatggcactctccctccccagcaattccaacaggccttcttgggcggactcttttgtggcagttcctggcagtcccagatgtggctcgttgtcaagcctctggaccaatgcccggagcctgttgggagtccagactccaagtcaagaagaacagaattaactggccaggcgccaagataatatttttccctcataagcaagaatgctgcctaggaaataagtttaactcctttcttatttccttaactcttctttagtctcctttaaagtagttagtgatcatcaaaagacatttttaagtgtgcccccacaaagaaaacttttatttaaaaaacacttatatgatgcctaccctgtgccttacactagcgttgtacaaatattaacctattagattgtcacaacaacccacaacaaaggtactatcattatcctcacttcacagataagggcatacaggtgaaaaaggcttcatggcttccctagggtcatgcagcttacaggtggtaaacctgggatttgaaccaaggcaatctagtttagagtctatattcactgtattgaccctttctatattcactatattgacctttctttccccaaagaaaacgtggattgctttcataaaatggtatacatatagaaaaatgcacaaatcctaagtgtacacttccttgaattttcacaaactgaacacacctaagtacctactctcctcacaaaaaaaccccaaagatcactggccccagaagagccccttcatttcactccccaccccaaggataacccgtatactgatttttccttcattgattagtttgaactgttttttgaacttgtataagtggaataatacagcctactttctcttgtgtctgatttctttccctctgcatcaccctggttgttgagtatagttcaaatttccttctttttgttgctttgtagtatttcattttctgaacatatcacaagtgatttatgaattccattattgatgggcattttgctaatatccagtttgggactttacagagaatgctgctatatacacatcttttggtgaacacatggatatagttccattgagtatatacccagaagcacacagccatagggtaaacaaatattctgctttcacaggcactgccaagcagttttccagagtgggggcaccaattcacaatcccaccagcagtgtgcaagagttccagttttgctaacatttggaatcttctgtcttttaatttataaccattctggtgggtggcagaattttttttttgctttcttctgttttaagaaaaatagactttattttttaccacagatttagatttacagaaaaattgagatgatagtaaagacagctcccatatatctcccaccctattaacatcttacattagtatggtacatttcttaacaactcatgaaccagtactaatatattatatactgatatattatatatactaatatattatcattcacataattatttttaaattgcaaacacatccaaaaaatgaataacaatgttaatgtcttttatataaaatgaggaccattagataacagtttgccagttacattatttaacgggatgggttgatgactctagtaccgttctttgctggataaagtcaaaaccaccagttgatgcagggaagttgttacctagcataaacctttatgatgatcattctgtatcagtggggctcctatttaaatgtccattcttgtgcccctccccacactaagaatcaaaacctctggagatgcagaccaagaatgtgccttttgatcaagaaatttcaggtggttctaatacatcctaaagcctgataacctatgttttagacataggaaagcaagcccaataaatgcctgtaatattttaagtctagggggcatatcattttctgggctgggcagctagtactaagacactaatttagttctgattttaataatgtaaaggtatatggataaaaaggccgcctgtcaataccagagttctaaggaggatgactcttgagttaggtttcccaagaccttgaataaaaaagtttgcgctggaaaagttaaatgatgctgccaaccccagggggcaaggcagctgagacagagagagacagagagagagagagagagagagagagagtgagttggggattgtggctctttggcatctcaaaaggagcttgaatgtcagacagggtgtggaggacagcaagaagagatcagtgtgtaaaatattccaatggaaaattccaaaaaagcgtcagccacagctaaatgggacaagaaacaatatacgttaatttaagacgacgccgtcaatttagtggcatgtttattgaaatagccctttgcattctaaaaacagcactagggtatggacctctgaatccttgcaggaaactgtacaaattcctaggagggaacagcagccccaaatctgactttaataacaaaaggcaattatttttagtattttccagtagatctcagctgtctggtattgtcaggctctattcatggagaggtggaatttggagagagttagttcagtgaatggtgagtgggggagggaggaaaggaaggaggaaaataaggcagggaaaaaacacagaaaggttgggtgggggagcgagaaggaaggagagaaggagagagaaaggagagaatgagaatatgagtgggagcttgtgagcttttccactctggtactattatctggcatgatggccctcaaggcaaggtgccagtcatataataataaatgccaagatcaaacctctaggaacaaatataaagggactctaaaacaagcaatttgtcagactggtttcagggtacggagaaacataaagaacttgggagaaagtaagtcaccgataaattctcatggaaacaacaggaaagccattataggtgctagcattgtaactaattaagaagtggtaaaaccatagagggggtggcattggaggggatggtggcaataggttatgaaggagaggaagggtatggaattaattttttaaaagctgcttggaaaacccaaacttgtagattcagcaggtttgatggatgaatacctaggtgaggaagagaaatggacattgtgtttcttgccaattgtgttttgcgaaatcatggagaagcaggaaggttgtcaagtggagagatgactctgtagagcatttgtcatttataggaggtaaagcacaatcttgtcaataacaggccagaaaaagaacattattttgttctcaaagtaaggaataaacatggaggaaaatactaaaagattctaggtgtggtggaactgtttatgatgggcagtttccacatcttaaatcaagacaaatggatttgatgatggaaaggagccatcatccttaaaaacttatgtaactgttggacaaggaagaagaacattatgtctagagctttaaaagatgtttctatggtgtcctaggaaatcttgtgtggaaattcatccagattggcttggatactagcagtctcatgtagatttttcaagtggcttaaggagcacagtccgcaaacgataattcatagaaacatttcagcctgggaggaatataacgacttagtttttaaaggtttgctgttcactggtgcttcattcgatcccaccctcgatactctgggaaacactgtgagagatactagcctcttttacataaaaggacatataaactcagaggcattaagtcactgtctaaagtcacaaagcttatttagaagctcagatcaagttcccaactattgttatttaaccttgagagtcacttttcaacacgttctcttacaaacttggctttaacatataaatgtgaggtgtcagtgcatgccaggaagataagaggattgcaaccaaagtcctcctgtggagagctgttgattaaaacagcaaacaattcctccttctaaataatgcaagctaggattcctaaggaataggattggtgagatcaggcataagaactgatcacacacacaacaacaacaacaacaaacaaacaaacaaacaaaaaaacagagaaccaaacctatgtggctctcaaggcattccttggtgaactaggtgataatctgagaaatcattttagaatcttcccaggaaagcatactgagtgcttagaactggtaaggcagggaagagatgaagaatcaccccttccatccacatggcctctggtctttggtaataactgacaatgtttcctactgtgcctcagaaattgggtggggcaggctttcaaggatgaaaaggggagattgctcaactggagagggcccactatactctaagaaaggagtgagtctctggaaggtgccaatgggacactgctagagaaaggtagtgtatttgctgcaaatggagaggagataaatatcctagtgagatacctatgaccttgcatggaaaacagtatggagtagcctagcatggatgctgcaagtggcttgctgctttactaagcaagttaactttgactttttttttttctctgagaactgagaacagtatttagggaaagagaaaggttcaaagacagaaggcaatgtttatggttctttttttttacatttttaaacttttaatagacaaataataattgtggatatttatggggcacaactacaatttttttttttttttttttttttaaagacggggtcttgctctgtcacccaggctggaatgcagtgctgtggtcatagctcaccgcagcttctaactcctgggatcgggtgatcctcctgcctcagcctcctgaatagctggggttacaggcatgtaccaccacgcccagctaatttgtaaaatttttcttttgtagagacaaggtcttggtatgttgaccaggctagtttccgactcccagtctcaagtggtcctcccactttcaccttccaaagtgttgggattacaggtgtgagctgctgcaaccagcctataattctttaagtggggtttcttctgtgtgtgtgtatgggggggcccttagaacatgaggctacttggcaacagcccagctgctgttaacatgagaaatttgttaaacttttaatttccatttttatgtgcatttgtgcacacatttgtatttcttttctttggaatttagcaacggtgattttaggcttgggggtttaaatcaagataaactactttccttctttctgaagagtgaattcaagaaatacggtggccaagagccagaatagtctcagacgaaacatactggcttcatttggagatactgaattgattcttgtaaccatttcaaatctctctccaagacatttcagagctcagaaaatagaacaaaaggaatttgctttttttttctctttccagaatctacagcttctcaccaatgcctaccaaacctactatacagttagacatttcttcatttattcacatactcattattaatggttcaaacaaagaacataataaaatagagttataagtgctaaaaggtgtttctatgacttcacaccgtggctcaacaccaccttaacattactgctttcatagccaagtcagtaagcctcttaagccttaagtctgatttacacccaaagctagagtggcagtaagagggggcacatattttaataagctatggaaacttcttttgcccatagcattggcccaggtgctattagcttgatttcaattacctctcatagtcattgaaaggaagactacagattcctgaagggctatgagtttgcctctttgatgacctcttatctttaccccatatcatactactctgggaccttatgaatatcacttaaacaatatctgtgtcctcataataaaatattattaatattcttttaaataatagttttaaaatgtatcagttaataatagtgtacaaatacaaggtattttatgtagcacaaatatatattaataaattacatctccagataagagttgtttatatcaagttaatggtacattgctttaataaagtgtctcccaaactacatggtttcctcaggatattaatagatcacacacacacacacacacacacacacacacacacacacattaatgtggtccaaaaagtttgagaaaactggatgatttaaaaataaaatgggtttctttattgcagaacctatcaaagcctttaatatcctgaagtacattataactctctcaaagaggatcaaacatgaagggttttctaaactcattggaagatgcagctctgttaccacatttgggattgggttctataaaacacattttcagagatgctgttttagaaagtaacttcctgcaacagcgatcctttatagggcaggcaggccatgcctctaggaatgaggaatttctgggactatttaagaggaagaaggggagaaggagttgttgaccaagggtaaccaggtatctgaataattaaggtcttgaggccaggaactccttgaggactctttgaggtcaccatcatcagcatgtagcataggtatttgttatttgattgttgggtgaatgaatgcatgcatgcatgaatgaatgcttcctctaaacctgagtaagccaagcaccagctggtcctgattacctctggacccagggtcatatgagaatgtaaaatgcatcctgatgatttgaggtccctcacattagataaatgaccaaatcagatgaagaaatgtcaaagctggctcaccctcgggtgtctcacaactgtagcccaaccccaataaaacattcaagggcaattcaggttggggcaggaggtgcctgatgcctcccagtttgacttgagaaagatgaaggcatgtctgtttacattctgaggtgggttttaaagacaacatcgtggatattctcctctgctcttacactgacataaaggggcatctattctcagatgcaggtcctgacaaatcagtgtgtcagttgtaagctatgcctcaagtactttgttattaatgccagacatttgggaatgtcttacttttaaatatgaattagaacagatttaaggctatagctaacttcactctcactcccagcttgatatgctttcttgagtgagagagaaaacagcttgcttgccaggaattgtatttgcttgcaccatcagatagatgtatcttattggaacaaaaatgatgagagtgctgtaatagaggttggagaaatgcatcttccacacagatgctaagcgagaaactaggtaaagcgctggtccaaagacccttaacaacaagccagtgggtagcttcgttaacttagattttcttctctttctttggggctcataatgttttccctggtggtgccaatcttgatgctctctcaccatgggtcagccacctcagcccctttagtataggggccctaaaggtctcttgcccattgtctttccttcatacaattagccctatcccccatcctaagcactcattgccaaggagcgccattcctcttagttttctgctggccgttctttgtcctcagccctaggtggaggtccaacttccttgcatcttctcctgtccctgcatacaatgagcaggggctagccggcctccaactctggaggagtttgtcactgtggggaaagggttaatgtaacctttccccttctctgtggaaatctgtccttgttttaactttccagctctgttgccctggaaacgtggtgaaggtggaatgtcagctgtgttaccaggcagtattgcttatagtagaaatgacccaattgttaaattgcttttatgccacaggattgtaaatgaatttgaatacctggtgaaaaaccatagctttgggcttccctgagtgtcaaactcttggtactggcatgtcccatatggggcccctggaaactttagttgtttacaagacatattagctcccgtggggtatggggcttctaagccaagatggaccctatactctctgaagtgcttcttgtctgtttgcacctgagctgccacttggagttccagagaggaggccctggacagcatgtgggctgctgtaaagacccccacagaggagggatgcctgaagctatcctcctggccatggtggttcctggcagtttgtttgtgagtagactcccagaagcagtgacctacagtggtcttgtgagtcagtgttttgctgaactgaaggaggcccctggtagacatgagagtcatgagagggtaggtttgctctccatacttgctggggccgacgtgacatgttgtcttcccgccaagtttcctcacacatgctggtctgactcttcaaacataagtttgcagggagttgtttctctgtcactggaagatattcagagcccatttccataaaaaatgaccctgttgatttattgtgtttgatcaaaaacgaccagttggaggggccaaaaaggatttctattcccagtttttctagaagttttctatttcctacagatggggtggttcgtactgcttttaaatctcttaaatgccttgcactgccagaagcctccttaacatgtaagtttcagaagactggagcatgttttcagtgtttcgttttactgagcatattcagctctgccactgtttgtgggctcattggcacgattcatactgagactcctcatttagtgggctgagcttggcaggaggagttcaatagccaacatttatcgagcacttataacgaacccaggaaccgttccaagtgctttacgtgtattaacgcataaacaacaacactatgaggtaggaaatattatttatgatcttcgttttaaacgtgaggcacatggggcacagagtacattaaatgacttgtccagggccacatagcttgtaagtgacagagacagtgctcacactcagggagtctggctccaggactcaagttgcccctctgagtctcatgataaaagcaagatcttgtccagcctcagggagttgagggttggggcagtttgagggtgtccttggtggtccctggtgtacttggtggatccagacagcagtttcccactggtcaagcaaggaagtggaggatgtttttgttccctgccttgtagaagaaagcagagataacctaccccatcggattactcatccaacagcatttaccaagcatctcctcttaagcactgtagtgactgccaaggatacaacagtgaaccaaaaggctccaactcccagcccttggggaggttctactctagtgtatgtcctggtcagattctcccatccacaaaaatgaggaaggggagactcaggaataggaaaataagtacaaaagtaaggaaagaggaggaaggagaaatggttcaggcttttctgtttctccccctagtaaggagttatctgtttcccagtatgactcctttccccctgcctaaccccatcacaaaacaaaatggaatcattgataacactgcctaatagaactttctatgatgatggaaatgttctaaatttgtgctgcctactagtgagccacactcaatcaagtgctactgagcatttgaaatgtggctagtgtgactgaggaaccaaatttttaattttcttaattttaactaattggaatttaaatataaatataaatatatgtgactactggcttctctagtcgacagtgcagccctagaactttcccatcctgaatatggcatcaagaccccttttcccagcctgatccaggtttcgtttcttctctttttcttttcttttctttttttttttttttttgagacagggtctgtctctgtcacccacgctggcgttcagtggcacgatcatagctcactgcagcttccatctcctgggctcaagcaatcctcctgcttgtctccagagtagctaggactacaggcacgctaccatgcccagctaatttttttgtttttagtagagatggagtctcactatgttgcccaagctggtcttgaacttctgggcttgagcgatccccctgcctccgcctcccaaagcgtttggattacaggcgtgagccaccatgcctggccaggtccaggttattccaataaattcccaaattgcactgggaaaagtttaaggaggtggccagagctgtagctttcaaatgtgcattgatggattaaaacttaaatccacgaacatgggccgcaaaactccaaatccagtctttctcttcagagttgagtttccacccactgctgtttcctttgaacacatttccaggtagctaagtaaaacaagagatgctcaaaaatcgtttttgttcaaaaaggcaagtaggaggtaagagaaagggcaggaggggagtgaaagaaaggctgatattgtagcatcctaccaatctttgtttctaaatctcagcagccttgaaagagaacattaagatatcttttactctcaggcctggcttcccagggagaaggagccataaatgaaagcctgctttgtgtggctatactatgactgcagaaacaatgaaaagacttttttttttttttggggggatataagtttatgtgtgtgttgaagcccttgtcgctacaaagcaatctcacaattagctactgttcaccttcttggcttcagtctttctaaaaataattatgatagtaactttttaaaaacctgctatctatactcaaggcaatttcttggatcctaaaggatttaacaaatagtactcaaagcctcaggccctagctgacctaatcagcttgaaacttgagcagtttttaaagacggaatcagatataaaatacccttcactgaaatcctggctgttgggatttaggccaaggttgagctttggttgggacacaccagcccagccaggaatccacttgattggtcagtgctcagaccatacagttgtgaaatattttgaatatcacccctggatatcgtggctgtgccaggcctccaggaaatgaaatgattgcagtgggaagggactgagccaccccatcattgatttatttaatgccaaattgagtcagccagccagggagacaggtgtgcaaataaataattaccttatggaaaaacttgagccaaggctgaagtggaagtgtttataaaaagctgtgggaggccagaggaggaagacattgttttgacctggggtatcagagaagtttgaaggagaagctgatatttgatctggatcttgaaggatgagtaggagctcaccaggacacaaggcattctaggcagagggaacaatgtttgaaacaccaaagagaggactcacaagttccatgtgtttgagcatagcatttgggtggtggtggtggttagggtaggaagtccaaccagagataaagtggaggatctttgttggtgtcatattatgaagggcttccaataccatggcagaaattgacttaatcctgtaaataatagggaggcaagacagtttatgttagcatgttgagagatgatggggtttgatttggaggaagacatttacagtcatgtgacaacatcaccagaggagacaaatggactagtgttggagaaattagcaaggagacaacagttcacatgagagttaaggggaccattgatctatggcagtagctgaggtgatgggaagtaaggagtggctggagttgagtgccactgagacataggattagcagctgttggttactggatttggaagacaggaaggaggtgaagatggttctgaggactctagcttggtgggcctagtggagatggacattttaaactaagatgcggcagccttgggtagaaatgggatgttcagctttagacaggagacttttgagacgcttggtccaggaggtaattggaagtccatcagcatgttatactagcccgccagttgagcatgaaggcttttctctttcagttctttctgagttgttaatgatctcttatatccaactggctttccttatttgttacacaatcgaatagtcaatgttccctggtgactgcagagtttctacagaagtacttaaagatgatcgtctggctggaaggagacttctcttgaagtctccattgcataggaagcacattgcttttaactgaattgtgtattatgggtctataaaaataggacaaggaaaaagaactaatatcaaataaatcactttaggaatattaccaaaacataattctttgcctctcacatgagtggtataatcagttgccctgggactgatcaacacaaaataaaacaaatataattaatgaaaatgtattactgcactttgctctcattataagggatacttaaatggttttatagaggcagaataattatttgttcatttggggtagattttggtgggaatctgatggatatttggaggggctaatagccctccaggtcatcctttagtgctgccattatgaagacttaattccaatacatcaagctgaaccttgtggccacattgcttcttgaagatcctgtttcaactacagagatttagctactggagttttgcttgttcctattggattgaattctacatctattgaactgtttctctcatgaatcattcacaggatatagccaaagtaatgtaactttgtccccgtttattaaggcttttattcccccttgtctgggcggtgataacacttgcctctccaaagactgtgagaagtcattgtatgcagtgaatttagataccttcctgggtctgtgatctgcaaacttcactccgtgtaatcacatagatctgtaaccactactcatgtatgatccttggtgaagtctgctaaagattacagcagatatgcccatttagaaacttttactggctactgttttgtttcaggatggctggcgggaccacaaattgcgcttaagatgaatcttgaaaccctttagccatgtcccacatttgattagaatcagtcaacccctttgaaagttatcatgaaacaaataggcagataaaagcaaaatgctgagtggccgaggtgaaacagaccccttgttttggttggttatttgatctcaacccatatcctgtcatttggcacattgtcagatttaagaactaattctagacttccatttatatgagggaagccagtgaacacaataagaggggaggggaaaacccacatggtttgttgcagccatgcctaccctccgctttccttttcctagttccagaggcacctttcctgcattcaggctcaaggctgtgcctgcacatatggacccaaatcagtggacaaaatgtgctcttagctagttgaaggcttttagccctccccctacggaaacataacatgtgattttctggtttaaaataaaaagttaaggggaagaactatcaaagggaaagaaacattttgaaaagtttttctttttttttttaatagaaacttgtctgactgtttcataataaagttggcttagcaatgttaggtccatttaaattatcatcgacaggtaggttagggaagactatagggcaaaattctcaaactttcagtattttcagcagacaaacaagaaccaaattatccacactcaggtactcagagaagagatgagggagtctccttgggagtgaaagccaagggtcttcaaatccatactattaaggaggggaccttgtgaaatttgtgttctcagggtgtgtagatgcaaccagttagagaactgccacggaagcaaagatgtcagtgttggttgctgttcagatcttgtgcatttgaagagaaccagaatttttggtacttttggtaaagaacttttggtaaagcacaaatgcatggttagttaatgagattcaatagtaaaattcattactgcacctcacccccctccacagacaacaagtttcttctaggattgccccctacacccccagcatgttattatgaaaagtttcaaacagcacagtttttccccaaagtaccaaacatcaccgaactggaacaagtagtaggaatttgaatcaggtagattcagacaccaaattgactttgcatgtttcctcatgacttttttttttttttgggcagggccagacttacacattattgtgaaaatgtggctgttcatcttgctgaaatagacaaacacgatcttctggcactttgagcacctcaagtttgaaactgctaatcttctatttcctgcctctttcccccggttctgtcaatcatcctcccacactcccacttccaagacccccgaatctcagaggcatcttttgtgctccctgtcctttgcttctccaggtccagctgggtgacaggtctcccttggaaacatctctcccagccttccttgttcctttctggttgctactgccctactgccccccaagtttattgagcattttttcatgccacatcccatgcaaagcactttctacacattaactcatttaattcttatagcagtcctataaggaaggtaattattatcctcattttgcaaatgggaaaatagatccacactacttttgccctgattgctgccctgttcactgcactctggaaatgccttggatcttccatctggtccactgtttcccatgtttttgtgccttcctcgtctctctatccatccaaactctgcttattttgccaggccctgttctggcttctacagcaggaagtgatcattccttaaatcagagctctcaccacctataccactctcttgttcaacctcaaacagagccttgcaaggcatttctctcccatgtgcacgtcttatcttccaaactagattgcatccccttggctgcctgtgtgtgataggtatgctgtatggatgtactgattgatcatttttcaaaagtaattgctgttttcatcactttttttttttttttaacatatctcatagtcatgatgcagtaatgacgttgaacaaaaaagtaatggtgctaaggctgggcacagtggctgaggcctgtaatcccagcactttgggaggctgaggcaggtggatcacttgaggtcaggagttcaagaccagcctgcccaacatggtgaaacctggtctgtactaaaaatacaaaaattggccggatatggtggcaggtacctgtaatcccagctacttgggaggctgaggcaggagaatcgcttgaaccctggcggcagaggttgcagtgagctgagatcgtgcctttggtcttaaaggtagtgtcccagtgtttccaagtgccagggttaagatccaaatggccattcgtactacaagaacaacccttccccctagattcagtttatttgcaaggcctaacttcatttccttgagaccttctacttgttctgatcatcatgatctttagaacaagagctcttcccttctgactgcctgtgatgaaagcattttctgccccccttcttagagcttcagaaactgactttctgaaggcacatctaatggtagcactggaggaaaacccatccctggcatctgaattcaacccaggttcatgtttagagcacaaatcccacttctgttcttgtaacttctcataatgacccttcccctccacagtgcatgcattctattcagttcctcttaaggtggccttttaaagaaatattttaaatgtactgtgacagtgggataaatactgaagagtgcagttaaacacaagagacttgaacttcagataatggtcaacaagatcattctgaccggtggttctattgaggatgacaaaaaatgatgcaaaaatataaagaagctacagatccatcagttccccatgaaattgaattaattaatgggtttgtgattaatctgctagtagacccattttgctcaatatgcactttcttctgggggtaggtataggggcatagtgtttggtttgttcttgtgagattaaaagagacacctggtatcacttagtatcaattggactggggaggtggtgttaaagtgctgagcgtcctccagaagaaagtctgcactgttgtgaatacagggagagagagaggatgagtgatagctataagcagtggccctcacttttcagaggcgtggagctgttgacagaacaaataatcacatctcaaagactttgaagctcctcacatggtcagcagacaagaggccgcaaggctcaaccataaatgctggaattagttctgagagcagaaggaaggacttgcctttgcttgaagccaaaaccaatctgaaaccacagaacctcagcctgagggctagggctaggcagaaagcttgcttttgaaacctgagctctccttgcaacggtggtgggggtgggggtgttggtgtatgttccacttgtacaagcaaaccctctcataagtttgaccctgaaaaaattacataatcctttcatcacagcgggttacattttccaagggcagagctttgacttacaactgattataggtgtattgttaggactccagcacccatgcttgatatgtgtttgtttcatttccagtgttacatgtattaagtgtcaacaatctacactcatgctacctcacgtttgaaaattaactcaggaagtcacaaaatgaactttttcccctccttagcaatttcccatcttcattgtgtgataaaggtttttgctaacagccaagtaccacactagacattaggtaggttcatgggcctgtggtctgttatcaatgtcttgtgttaatccaggctttcttccaaagagtttgcagtgctttttttcagacatcatatcatgtcacatctctccttcctcctgtgttccctaatctcacttaatgacaacaccatgagctcctttccctcttcccttacttccctgatagcttaatattcctccactatgccttttgcatcttccctctctttctcactttttctttccctgtcccagggcaggctcttgtcattcatacatatatatatatatgtgtgtatatatatatgtatatatatatatacacacatatacatatgtgtgtatatatatacgtgtatatatactatatatatacgtatatatatagtatatatacacatatatacgtatatatatacgtatatatacacatatatatacgtatatatatacacatatatacacatatatatatatatatggtctcactctgttgcccaggctggggtgcagtggcacacttatggctcactgtagcatcagtcttctgggctcaagtgatcctcccacctcagccttctgagtagctgggactacaggtgcatgacaacacactcggctaatttttttttttttgtggagatgaggttcctccatattgtccaggctggtctccaactcctgggatcaagcctcctacctcggcctcccaaagtgctgtgattacaggcgtgagccactgcacccagccatgctcttgctgtttcttgcttggagtattgccatggtctccatgagcccatcactcctctcctccaaaaccacactagtctcaactgattcacttgtcgtttggtccctttggacttttcaaacctcatctgtcaggacctctctcccttttcccccacaccattccctgaacgcactatccatttacatgcattccttggctcagctgtttacatcatctgcactgcccacccccccaccccaccgacaacatcctgcatgcctatcacagttcatcttaagtgttactgcatggaaagcccaccctgattgatatccataggcagaattcatcactgttcacccttatgctctgggagccctttattgtgagctcaatttcagcatttagttcagtctaactttaaaaaaatagttaattacgtgcttgaaaacaattagattgcaaaccccttgagccagggactatgtcttatttgtctctgtggcccactatagcaaccagctagtggcctggccctaatgacaacctggtaaatgaacagagtgagcgatatccctgtatcaaaggtaaagaaagattagcatttgctgctgtaaggatggctaaagggattcatttgtccaaagtccttcaaagggcaagtcaagttgagacactgtcacttctgtcacaatccccagttggctgggtggcgccacctcttcagagatcttggcagtagatttttggttgccatttgttattttatacattgggtgggtctgtatgtatgcgcatctgtgacaacaacttggctgggcaggtagatgacatctgcttgtgcaaatctcttttcattcttgaatatagttgtaccttagaaatacaatgcaaaacacagatgtcatttaaaaatatctaataatgaaattacaaaagtaaaaagaagcaggtgatgttagttttgattatgtgttttatttagcccaaatgtccaaactattaccatttcaaaatgcaatcaatattttaaaattattaatgcgatgtttcatattttttgtattgtcttcaaaatcccatatccattgcacacgtgcagtgcatcttaattcaaatgcttaattttcatcagaaatacttgatatgtatttagatttcataaaatttacagttgaaaaagtagatacacatatccaaattcttccaaatgtatttaaaattttcccaataactggatttaatatcagcctgtacatttacatttgaattaattaaaattaaacaaaatttttaaattccattctttggacatactagccttgtttcaaatgcccaatagccacatgtgactagtagcaattgtttcggggcatacagtcttagggcacaaagatttctaagtatcattcagcttattcctctgtcctcgtaatttaattgtaaaagaaaaaaaagtgtgacagggatagttattagagaccttcgattagccagctgccttttctctccagccttgccatcagctttgtgaaactggggcctactgctggcttcccgggactgtcgtgaaagtaataggattctgttgacaaagcacttgaaaatccagggatgaaagggcctgtgtaattcccgggtttgttggccaggctaggctgtgaattggggtctgcgtctatactgcagctgcccctacgcaaccacactgatctgtgcttccttctgcagccaaggtctacaccagcatctcacagcacatgagtcaactgcatgttttatcgtccacagcaccgggatgccatgtttttagatgctcatggctttgattagattataacatatttgacgtttcagtgcttaactgcttttgggtgatcaaatatgtggaaaacatctttctcagccaaatagcatattttccaaatccaaaagaattgaatatatttttcgccttccttcaagtttcccattgaatgtcaccccagagaccaatttaaagcttgaaaagtttagaccaaaaatgtttgggaacaaatgaaaatgagatgtgtcacctaagccagtatccagtcggtgtctcatgcaaaactgtgaaagcactcggtattatttatttataataggaaactggggttaggaattgatttccccagaatgctgctagggcgaggcatggggccctgtggctggctctgatatgagattcgagacctaaggggaaactgaaatgactctagacccttaagggttttgaaacaggtgcagtctctcttctttccctctgggaagcatgctgtccacagttggatgaatgcttcagcagcagttcactgagctcttggatgaaaatggcaaatttctccccaaatgagcttattatctgctgctgttgggtgcaaggcatccctcagctatggcgggaattacagcttccatctgttccctaatgtgaaaaatgtgtgcaggcctctgtgctaccaagctacatgaactttagacattcagatctgctgacacatttgggtcgcggcctcagaatggcttttgtcaattatttcattacatatccaaataaccatcctgagggtggtctggatttgtgatctgtgacagtgtggtgctgacatatttcttgcccttggaactatctgttttttggctttgtttagggattgatgatatataagtactcagtatatttaatcattattacttttgaagttagcacagtaccaccattatgaaaaattcttgagtacagttacagccaaatccacatcattaattcttggcttcttcccaaactctccagtctttctccttgctccattattttgttcagacaaatcaaataatgctttgtgcttagagagcaactttcatcagaaaattttaagaccctctgcaaatttttatttctctaagtacaaataaatatcttcagagagccatgcatatttaagcatgtttatttgtgctgggttttttcaatgggtaagaaaaattatggctttctgtgtgctcactttggaatagagacatgcaatgtacagacttaaattttacttgacatatttaataaatatcccttgaataatgattagatacagagtcatatatgttcttgagaatatggccaggcattagtttcttctactaattttatatacttgaacattgtcagagttacagctggtgcattaggtggataatttgtttctatcaattaataactgcttctgattgtcacctggaggaggaaatgctttgactaaagtaagcagcattaactcaccaattgaaaattacagtctgttatttaagacttaacttgaagtttaattgttgtcgggtggtctagtggttggttaattggtttactcaatactacagatctattttcacaaactgatccattctgtattttttcacactgttaggtgtccttatggcatagaaaatgctagatatttacccaactctatattctttttgttctggacacacagagagactacatttcccagcattcattgtagttagttggatagaaccctgtgattgagttatgacgaatgagatgtgagcagaagtaatggagtccactttcagccctggccttaaatttttcctttctagtcctccaaatagtctctccttattggcctgttggctagattcagagaatctggtgacatacactaggcctgttggagaaggtggggccacaagatagaaggagcctgattccctgaatgacttcatggagcagagcatctcagctgaactgtgtgtgtgctcagctccagtgtgacagaagcaggaaactgacctctgttgcctaaagccagtgaaatatgagaattgtttgttacactagttagcccaccctaactaatcttgtatatgtggccaaaaatcagtactgtcctcatacacattctacaagtttcagaggggcatgtagaacacacttctctgtaatttgcactgaacagtaggtcgtgaaaatgcataaccaatgagccatgtggctctttgatcaccatgtccaattaagccacatggttatgtgattttctggtttgagtcagctttttatctggggcagatgcaactgtggacagtttcttgtagtaaaaactgatcatttcagtaagtggcttctccagaggatggagaggaaggtacagaaattcatgttaattaccaaacacttcaggctttagcttcagattttttttctctgagaaaccttttctaaccccactcatgtctgggttgcttgcctcccatgcctcccaccctgtgttcttgccactgcccatgcacctacagcgacttcttacctcactggctggtaatgtctagctcttgatcttgactctctttctttgtagaccatatgtctcagagggtaggggccatttaaacttggctcagtgttgtgtccccagcattctgcccagtgcctgacacatacacattgttgactgaatgattaaaggaaataaatgaatgacaatgggattttggttatcaagcatgagcaatagccttaggatcattcatgagctgctcctcagaccacttaagtaaggcaggctgtatttttttttcctgcctaacaataggaaatataagaagggaaactgacgttcatttttaatcaacagtcaaaacacaaatcagaattagaaacaagggcagaatctattttcaggttttgttttattagcccctgtgagtttttaagagttgaaactcaactaattggtagcccaaattccttaacaaaaacgttttagagcaaaaatacaagtagaagttagagccagatcatctgtttatggcccaagacagctcttgatgttttactcttttgtgcattcatttgatgaacatttattgagcctcttctatggcagagtctgtttctaggtgctgggacacagtagtgcacaagacagaatgaaccagctctcaagaaggcaacagttgagtggtagacagactgacaataaacaatcaagaaaatgtcagatgggataaagttccctgaaaaaaaaaaaaagggaacggattgatgtgatggaaagttcctggatcccgaagattccatagtcaggaaggcctctggggagggagtatttccctgacacagaagttgaagcctgaatgaccaaaagtagtcagccatatagaaatctgggaggagaatattctgggcaaaggaacatatctggatttgtctgctcctgagatgagggaaagtggcctgtccaggaatgggactatgtcttgagtggtgggagcagagagtatattgggtggggaggggaaaagtggagggttgaaggaaggagttggggtgagagacaggtagagggttgtttatggaaagcctcatttgctctgtttccagagtctggatttaagtcagagagcaatgggtagccatgagagagattttaagcagaagagaagaatgagccaccatgcattataggaagaatactctgctgctctgcaaagaaatcaccccaacccaggccccagatgaaggcctgactacgggaaaggtcagaaggtgtgaaaagaagcagccaggtctggaaccgcttgggaggtagaatttaaggcccttggaagtagactggacctggggattgggacagaggacagagtcctgggcaatgcccaggttcctggcttgggtgttggatatagaggttataggtgtccacctctgagacaggaagctccgaggaagagtgagtgtgcagaggatgctgaggagttggttctggccatggccaatctgaggtacccatgacattgcctacagggaccatagaggagacatttaatatgtggctaggcctagagaaaagaggtaggcattctgggtaaacaaccaggtgctaatacagaggaagaacacaaggaaaggcaggatgaggtcagattctgaatgtttaaccacttgattttatatgacatttatttttgcttccttgtccatctcctcaagatggtaaatagtcatttctgcctctccaacctagtctgctgcaatctgggctttccctggtctcctttctgctcctacccattagcttttatcctcagagatcttccccttcccgacacatgatcttgctatttctttggtcctttctctggggctctaggaaatgagccccccaggtagtgactcattccctgaacattagtgatgagcaggctgccgctggagcctgtgtgcaagcctgggtttatgccctagctctgctgttctctaacagtgtggttcaggcctccctttcctcatccgtaaaatgaggggattggactgaagagtactttgagctttaacattttctaattctaagttgtcccagtcctcagggtgaagtgaatggcctcttctgaattgggagttggagcttgtgtaatagccatcaatacctgagagagaatagcttttgtttgtgtgtgcaaggccctgaggaggctgggtgggctgcagctgttcagcttcaattaaaaacatacacaaacctcctgctttgtttcggtttcaaaccttgaccatttgactgagtgtgtctgaattcctaagactccagtgtaggtgtggggaggcactactccacaggcttcattcaacccccttgcttttcaaatttcatttattgagggcaagagagattttgaagtcctggagatacaaggaaagaatgtaccttggctttaaaagccattggcaagcagcttcccgtgcccatttatccatccctagtcaagggcgtcttaaatgccaacatgggcttgtgagccctggtatttgggcaggcatttctaagtggcttaagagagaaaatgagtctgtcagttatgaagagtctgccaactgcctgtggtggtcttgaagcaacctcacttcctccaacaaaagcaggagtccccatggctaaaatcatgttctggaacctcaggcagctgtcctgtcacttcagggtgggatgtgtgcacaggccctaggtcctgaggctgcatctgtacctgcttggggcgggaataagttgatagcctccgggctgttggggtacacccagtaagcaagccatgaccagaaatgagttgcaattccactgagtgtggtgatggcctggagagcagggcacagagcaggatcctgggcagatgcaggacgatgggtgctgcaggccagcagagcaagcatttagggccctgcaatcaggcgtggtttgagaggtctagcagtcaggatcatcagaagtagaggcaaggtgtatgggagggctccacgggcgggccaatgcctggacagagaggggtttctcagtgacctcttattttattattaaaaaaaaattttttttttagatgggttcttgctcagtcacccaggctggaatgcagtggtgtgatcatagctcactgcagcttcatcctccggagctcaactgatcctcccacctcagtctcccaaacagctaggactatagtcatccaccaccatgccctgctaattttttcttttattttttgtataatagaaacgaggggtctccctatgttgaccaggctggtctcaaactcctgggctcaagcaatcctcctgcctcagcctcccaaagtgctcggattataggcacaagccactgtggccggccctcaatggcctctttgatgtcccctgcaaagtgttgttggctttccaagcagggagaagggaattaacatgaggcagaggcagttactgcttaccaatatgcatgttcttctcttcttcctggacacacggccaggaagactaaatttcccagcctcccttgtagtggtggagtcgtgctagacagcgaatgaagcccaggctctttctcctcctttcatttgcatgtgcgtgtgggaagtggggatgggggtaggggggaggtggaactgtggctaggctaggagatgtagcttgttcctgatgaaggttggagtgaagtgctcggtcttccaagaggccttcacaatcttcccccagagacctggatgaaccacaggatataggtatgagtctcaactgacaggaacctagggtattggaagtgatagagatggcaaaaagtgatttcttgactggaaaaatatccccaggggcctgctggtgaggccacattcatgtcccttacatagtggtgccctctgtgaatcctgccctctcagtccctcctcactgtctccctcagtggaagaaaggaacacaacctgacacacccccatcctccatgctcttcttcctcatgccacacccttccttgccctctgtagccacaccctgggccttcactgtcagtgtagcctgcagggtctgcatagcacaatagcttgcgtcacatctggaattatcattggagttgtaggtctcaagctcaactgcctacgcagccaggcagccagcttcaacgtgtgacagagttggcatagcatactaaggagtagtggggactgagatgctgtgtgtgttgtaagcaaataaaggcattcaaagtcaatttaaatatacatcattgtactgtttaagcaggacagctccccgcaagctgcctacctccaaatgaaatctactattatttatttctcacaaggactaatgaaagggcaaaactacaagccatgtctaaaaattctggtttacccttttctgtgcctagcagagcatggtgtaaaaacaataattagtattcgatttctttttttaccctttgagtgatgtctaacatacatacagaaaagcatccaaatcatacaattcaaggaattattacaaagtgaacacactcctgtaccggctactaggtcaagacttaaaacattattagcttcccaggataccccatgagctgttcttcctccccaaaggaaatcactctcttgatttctaacaccatagattagatttacctgatttctaactttagaaaaatggaatcacacaacatgtactcttttgtgtctagcttttactcaacattatatctgagattcacccatactgcatgtgacagtggcttgttcattctcattgctgtatagtattccatggtgtgaaacaccagaatttctctatccattctactatcaattagcatttggttatttgtgggttttggactctcactaatagtactgcagcatgagagaaagccctcaggcagaacaacagagagaactggatggttgtggtgggaaatggtcacagtagcaacaagtggacttagaggtgagccaaggcatgatgggaagagatgataacagcatccgctaccaagcccctctagaacagcaattgtcaaacttatagatcaggatggttttatactattaaaaattattaagggccccagagggcttctgtttgtatgagttatataaatatttatcatattagaaattaaaactgagaaataaaaatattttcttagtaatttatttcaaaatcaacaaacaataattacatatactacattatatataacatgtttataaataaaatattttgaggagaaaattctatatttttcaaaacaaaaaatgtcaatgagaagaatggctttcttgtactttttttgcaaatctcttgactagcaagcaatgtggcttaatagaagactgctggattctcatatctgcctctatgttccatctggtatggtatcacatgtcactcatgaaagaatgagtgaaaatggcaagtagtgtattaatatcattataaaaatagttttgactttgcagactccctgaaaggatctcagggatccccagaggttccctgaacaaaacttgagaaccactgccctagaacaccatggccaagtgccagccagctttagaatagaaacgtccaatgaattgaaagctctaagttagcccacacaatggggagttgctacttactgcaaatcaccatgaattaatttgcttcttagctgattaaaaacccatatgttcttctcaacactttataatccttcagtttgaaatgtattgcttttgttcattttaagccagcaatgtgcattagaaatatgatgtgagtcatttacgtaattaaaaaatttttagtaaccatttaaaaaatgcaagagaaattggtgaaattaattttaataatgaattttatttagcccactcttttcaaaatattatcattttggtatataaaatcaacataaagtataatcataaaaatcaaatcaatataaattattaatgagatagcttacgttcttttttatactaagtcttcaaattccagtgtatatttacatttatagcacatctgaattcagatggtaaattttcatcagaaatacttgatctgtatttagatttcatatcattctataaaatttgaaaaagtagattcacaaatccaggttcttccaaatgtacttaaaagttttccaataactgaatgcagtatccatattcaaattaattaaaatcaaatgaaattaaaaattcagtgccttattcacacttgctacatttcaagtgctctataaccacatatggctaggggctgccatattggagagagcagatctagatttttaatcctttgcttttcttatctattctatccctttgttcttcagtgcttagaaacttgattaggaaaaacttactcattctcattatttgcctagaaaactggtgccatgatggatttcttcataggcaagttaagatatttgacaaagagagaggtaggggtgggagaatcactgtgtagccgtagtttgcaatggcaggttccctttcagcttggcttccaggactttctcatttgatattttcacaaaactagaataatctcaccttgtttctgaaacagctgtgaaatatgctgcagcccccagccagccctggaatggacttctttctggttggacatggcagaaacttcaatgggatgacactatggacttagaccaggctgctgtgcttatttgaactaagcactgggaagtttgctaagtgcttagtgatgaactccacatcagtgtcagaaagataaggcaggttttcttgccgtttgtctccttgccttcattcaatggtatgctatccaaaaggtaaagggacataatggaatgaaattctaagccgaaaatgcagctctgaggttagcatcttataactcaaaggcagcaaaaataatttaacaagtttcaaaggggagagccgaagaacatctgtacagagttatttaaagattttgttctgtttgtgaactgcatcacttccaagccattttgaatacaggaaaatgaaaagttactccatttgacacaatggggatctcttacttattactctccaaatgaaaaagacgaattccaagtctaaacatttgatcccattgctgcaagttttgtggctggtcagttgtttgtcattgaatgggcaaatgagaaaaatgagttttatctccctctaatatttccccttccccaagttgattgcttaagcttttagccaatcttaaaattccatcatatccattctcctaatgttggactcaacaagaattctgcatctgggtgcatgatgtcatttacaataaatctaaaaggaactggaaagcttctggaatttccttatctgaggtagccaagctaaatagacttgattggcatccatcaggagctcagtgagggctagcaccattctggttgaaatgatttcacgctaaatgacatgccaagactgaagttttcctgggctccttgttgaaccagatactctaacttttctgtttccaagcccacagtgcagagtgtcagaggaccaatgaccacacaatactactggctaggcacaaaatgcctttcaattaatacaatcaactcagaatcaggagttacataactaatacagcaactgtgcaccatcttgaatacatttggattggggaagccaagcctttctttagcattcacactaaaggcaccagagtcatcaagagatgaaccaaagttcaatctgagtgctagaactattagggacctcagtgatcatctaatgctgtctctcttttcctgaatggtcttgctcttaggaccattttaatgttctttctcttttctgggtaaaatacagttaatacagttttgtttttactaggatcctcatgcaatcttaggtgaagtgttagctagttctagaactgtagaaaaccccatggtttctcctcctctcccatgcccaaatcctcttctacctgctggctgatgcctctagttttaccattccaggttggtcctctcagcaataggcttgatttccattaaaatgcaaaaaccctaggacaggcttaagccattatcaggtgtttttcactttgttgtgaaggaagggtcaaagtaatatgttgtggaatgaaagttttatttctgtaaggccagagggttagagaaaggaagaggaagtgccagcctggagggcaaaaggttctaaactgggaacttgggggcccacatggcagctccacagactctcactccttctcccaaaatgtctttatttgtatgtatttgtctttggactccctgtggtgatcaggtacttggtaattgttcttgctacaactggagctctgccaagtggaaggttcccaattgagaggcagctcaaatccgggatgagggtccccagccttgtcagaagggtgtgttagtgcttttttttttaatcccagtttgtggaagcagcagtggggatctgtgcaaagagggaaggttagagtgttgttttcaacttcatttgatatgggaactctttatccaggctcaaaggagagcattgcataagggggcatatgtagcctctcatgcatgcatatgcatgcttacacccatggactcacacacaaacacacacaactctgtctacacatgaatgttcctcctgaaacactcagcaaagcaagtgacagacgtttcctgtgggtagctgggatttcaatcctgctcttgcttattgtctgttttactaggattggaatgtgagtgatgggagatggtaaatctgtactttctgaggcaggataatgggttccctaccatttatcattggggtaacccagcatagtggtcaggagcccaggctctgccatttaccacctccaatgccttgggcaagttgtttaacctctctacacctcagtttcctgatctgtaaaatggaggtaatactattatctatcttgtagagttgctgtaagaattaactgaaatagcacatacaaagaacttaaaaccatgcctgacacatagtaggtgttcaatacatatttgctgaatgaataaaccattacatttatcattattatattattaccatgaagaaacttccattgcatgttggctttagatttagtggaaacagtgaggagagagttaagagttgtgacttctgttattacagtagggccagattgccctgcaggctcatctacagatatttctcagtgtgtgaaggaaaagagaaaacaacaactaaatgcctgaaaacaaaacaaacaatgaaatctggggtgagggggagagggagattgacatcttgcaattaaagaacagcttctggagagacagttgagtcaggcctggatatttcctgtttctagctccagacttcagttggaagtattgtgcttcctcctgagttgaaattaatcacaaaagcaaagcatattgttctcttttttgcagcactcctcacttcttgctcccttctctgcttcttgtcctgggtctctgccctgatatagaaaccaaaatggcaacacttccttgatgagagcagagactgagtagcgtggggctctatagtggtatggagtactatgtaaactcttcttggttaatctcctgatgaaaaacaactgatggactcaggaactgggtcctgagtgctttatcactgaggctccccatttcttgaccatgtggtgaggacggcttcaatggacactggcatcaggcctggtggatggaggttggagtagctgaggggcaaggcagctccaggccacagccaggcctttaattttccacacatgttcacacatgtacaggaattcagcagatgggctgcaagcaagcttgggcagcaatccactgacaagtagcagtagctctgaataaatcacattggcctgggctgcaaatttagctccagggagtggggactcaggcaaacaaggagaaaaggcattcacccaactttttcctgaaatgccagaggaacaaaacaggtcagtggtgaatacaaaattagcttctggccaccctccaaagtgatctgacctatttgggactcatcaagaataaggcaaaggaagttcagttgcctgcatcttgatctgtcaagggagaagagagagggcacaaatcgccaggtggccagattccctgagttactggttatggagcatatgaatggatatggctggaactcatgagaagggctctgggacaatgactttgggccaacccctagcacaacttagcatgcgaatgataaccccggtggatgcattggtaatctagtgtgccagcttggtggccctggccactgaaaggattgtatcgcattctgaaactcttcctgcagtctaaggccataccaccctgaatgcacccaatctcatccgaaacccttcctgcaagttaaactcatatccaagacccttatgtaaaaggggaccttgggccaagccagcaaagggacattagagccctagcagagtgcaaagctgaccacaactcctagcaggttggagctggtagtggatgctgttagtgccctgcctacatctcctttacaagctagtgcatgggtcctccagctgctgtgagtgttggctgctaaatgctatagctgccctcttccccagagacttgctgttggccaaatgcaagccccatcaaccatctcacctccaggtgacaccagctctgtggtgcattttgtgccccagagatctccgtgggatcaggctggagcaaatatccagctgagactatactcctgctcagtcccttcccctaccatatccagcttccttcatgccccttctactaagagcactccctccatacattacttgaacaatagtgtcaatcttaacttagactttgcttctggataacccaatcttaggcagagttgggaggaggggcatttatgaatagtctcaaacctgactgcacctcagaatcacctgggcagctttaaaaatacagattcccaggccccacctccagtgattctgattcagtgggtctggagtgaggcctgagattctatagttttcctgagttcagtgtttggtaattttaatgcagctagtcctttgaccaatgagaaccactcattctagcccattgtctttatttcttttcttagatcttctaagaaacattcattgatcaagttcaggaacaaatcacacaatctgtcaaagacactaagaagcagagatttaagtcaaaagatccacagtctttggcaaatctcttggagtccagcatacgatgctgactctcagaactttctcagcaaattgcatctttaaatttttttcatgtgtcctgaaatgtaaaggtctatttggttgggaaaagggagagacttttgagacatcaagttaccatggagttttccaaaaagggatatttgaccaagtttagaatataattcatgctttccatcctccatgctcagaagtattaacctattaaccctcctttcactaacagacctaaatcttcattattgttggttgtgtggatgatttagtgatgaaattcaaagagaaacattttgttttgttatcagagactctatattaggaagatttatgaataggttctcatgaaagacacaattctagggatttttaagcaaatggacaattaaataactgaatgaaggtggctcagactaatgcagaataggggagtattctagattttgtaatgatattgatgataatagtgataagaacagcaacaaaacatgattgctaagatttgtttcagtgcttagtatgtataagaccaagcactaattatttgatctgtattatcttatttaatccccccagcaactgtttgaggtaaatgtatcagctggggatcaacaaaggctttaaaaagatgaaactttatttttcgcttgtgtaaaagaagttaaaggtttgtatgcagactcagcaataatgaggtaccgaggcttcttccggctcctagttccactatccctagactgtggccctcatcttcacagtctaagatagctgctggagtgccagtcatcacattattggcctaagcatcaggatgaaagaaggaacatgccccttgttttctggggagtctttctagaaatcctgtaccacagttgctttgaccacattgaccaggtagcaatccctagctaaaagggagacctggatatgtagaattttggttgtatggcatgggtacagttttttaaatgagattttataaatttgaaagagaaggagaatgtggaaggttcactaagaaattgacaacttatgccacagtaggtaatattcttatccccatgttgcagataaggaaaataaggcactaagagactgaatgagttggtgaagttcacacactttataggtggcagtcacagtaggacgcaattctctatgatcatccctctcctgactgctatttcatcctgtccatttttttttccgattttgtaaaacagttttttttttttagaaaaacatttgttcatttcctgctttcttcttggtgtgccttttaccacctttgcatagatcctagccattcttcaaagttcagctccaatgccccagaaagccctcccttgcacccacaactgctttctagtaaatatttattgagcacctattatgtgccaggcaccgttctaggcacttgggcttcatcagtgattaaaaaaaacaaaaacaaaaaaaaacgaagaccccggctagcttaatagttctgtgaccttggtcaagttctctgagcctcagttctacatgtgtaaaatggaaataataaaaattactgtgcagagttattgtaaagattaaagatgttactgtatataaagtgcaattactggcatatcattagattttgaaaaatgatgccttttagtattattattgttgttgctattattgttatactattgtactgtattattatattcccctaatgagaaatgctattccttattaggctgtaaacttctgggcaggaatagtatccaaagccttctggtatcactcaaatacttgatcaaagtcagggcttattaaatgtttgttgagtggataaaaagtgttttgatgtagagagaacttcctgcttacttatgctgtagatttaggaaacagtaataaacagcctgagacccataggaagggtttttgtttttttttttagcgggggcgttgcccaatttaaactgtgagtgttggtgagtggtgtcctaaagcaaaacaagaatgagtaataatctactcctcatactcttccggaaggcctcagaaagaaaatatatcctcttcctttcagtttctttttttcaccttcactgatagatttcatgttccaacaagtcctgctgatctctttttgtgttttatttctgtcttctaattctcttctccatctctgatctttgctacctatgggaatagggctgctggcctagtgtccacagaagaaaacttctggaaatcaggaggcattgtgcatccagggtcctagagctgttacattctagacctacggacagcaccccagcaagagctaaccagtgcttgcatcaaaagtgcacatcaggtttgttgagcaccaaactccttttattttgccatctcagcccagctttcccctcagcccttctgcaaaggtgaaaggcaagttcacaggatgcagggccttctttcttccctcacatctggtttgattctgggcagctaaatagtggctttgccatgaacaacaaaagctaattcactgtggtggtttttaaacaccaagtgcaaatatttttccttttcagcttggggtcactggaagggaaaaaacagggctgagagggagattaaccttttaaaacctattatgacttcccagaaaaaataaaacaatggcagcatttcctttcattcgcgacagtctttttatgagtgattgttgtttgaggcaagattggggccctgaagaagatttttaaatactagcttagcttggttttctactcaaaaggccaccatgattgcttttaagaacccacacaaatccctgtaaagcccagggccaccctctttgctttctctctcttctgtcttcatctctggctgaccttccctccttttctccagccctttgctttcttccctcaatcaggagcctgactctctgctaaagggaggggatcagtgcaatcagccatgccagccactgatgccactgacagatgcttgggaggctgaagattctgtctgggtcatttctctgaggttccagccagactttctgttgatctgggctgtcttaatgcatcccagagcctcagcgccgttcagttcctcttcggaaatgaagtcgcccattctggttcttgctgcgcatgattaaggagcagaagtatccaatacagggagtcacagccatcagcacaaatctggcagatgagaaaaaagcaagtctatctgcctcactagtagtccttttaatcttctctctggactgcagaggaaaagctcgtctcccactcttcattagtttatcttctttccttctctcttccctttcagcttctgcacacagattcacttgctgggctcaggtgggaggcaaatcatgtgccatgacaacataaggctattagggcaaagatgtggaagtacctaaactctccctttcttgccaagaggaagatctgaacagggtccaggatggttgctgtttgtgaagtggtttgagtattcttgctatgcgctattactgctgttatcagcatcacgagagtctaacatgttgatacaggtggtgtgtgttgagggcgggtgggtgggaagggatcagaaattgatttgtaacctgcaaagagcaaactccagttgtatcgcctccacctgcaccattcttgtcctttcggtgtgtgcgcaaatatttgcaaacctgttgaatagcgcaccctcacaccaacctaaaatttcacagccaagtaagccagccccatcctggtgagaagaatgggtggcaacctggggcagctatggagtgatgggatgaaatgtattccttctcctgatcaggcagttggtgtaggggctgggctgctgtggctccctggatttatttgtccagcttcctgtctctggcagtgtgctaatggtttcgatagccacatggcacttggcagagcttcttaaactggtgtggcccgagactctgcattctaacaagctcccaggttgatgcctatgctcctaaccccctggccaactgcaattggagtagcaaggctgtaaagaagtcccactgcaacctaaactgctccagggatgaaaaaggaaagtgctaagcccctcctctggagacagggtgtgtccaggctgccctggagtcctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcaggtatttggggtttgcagcatttcttggcaagacaaaggggagggggaggctgggtctaacgaagaggggcttgtgctgtagccacttcctattctgggagagaagataactatgtttcccaatgaaagtgagccctttcacaggaacagctgtgaggaggggaatctgcacttgaccctcactcaaggctgactttgacatttagggtcagtggctcctaagctttgaggaccttgcattgttcatactggctggccaacgttttcgcctttgctctccttctgaggcatcaaactacccaagacaaagaggacaaccctttcttccttctcctcttctgctccgacatttgaacgtcttaaagaagggccagagggtagctccagtagagattccagggcaggattccggggctctagctcaggacttctgggaaggggccccatcctgcatgggcttgcaccaggccctatgttgctttcttctcctccagcactgccccctccagtcttcttggaattcttcagtatcttaccttcatcctgagattacagagaaagacttgtttatctcccagtgtccccaaaacagccctaaactgagagtccccagacccaaatcccccaacctctcgtttctgttacatcttcaatggccttacacaaatctgttaaaccactgtggggcctgtcttgatttctttagccctctaagccctccttcactatacttctttatcacataagtttggccatgcaattgaaccctatttgaaaagcattgaactttttacagtattcttccaacactggggttattagtccttcagttgtaactcaggctccttaatgtcaaggacagtgccttactttcatttcttgctatgcgctattaggttgttctgcaggaggtggccagtgtgacagttgacgctggccactctccttgcctcagctaaaccccttcactgcacatttgcctccactgcctctgcggaggctgacacagggccaagtttcaagggtctcctattagcccaacagctaccaacaccgtgtatgcagcctttcttaatgaagggtttgtcctacctgctgtctgagaacactctctctgagctgcctttccaggccatgatgatggggaagcactgttgtgtgcagctttgttacttaagatcgctcaggagaagaaggaagcattcctgtgaaccaggcagcttccaatgggtgtcatggagcctctatcagtttgttcaggacattgtggtttctgaattttatggcagagaagttgttcaaatgcaagtccctaatatcatatatatttatgataaataaccattatttgatgggcaggccaattataacaattaaacacctcagaccaatcaaatcagaatctctgggagtgggtcccgataacagtgcatgtttttaaaactccccaggtggattccaatgtgcagccgtaagaagtaagaactgcacttccacccaaacccccaattcccctcagggaaccaaggaagacaactaagggcctacattcatacattttcatacagatcagtggattcaggagagagcgtccaacagccagatagtctttatttattaggcctgaagaactaagtaatgggagagtaccaaagaaataaggccctgccagaagtttcagtttaggctcaataagaaagatgagaaagcctttagaatagctcgacccagttttccctcaagacttgaagatccaaggcctatacgtggctgacagaccaggaagggactgggcgggggtggtggtggtgacagggctacttgacagagggctcaacttttttgaagctgctggcgtgtcatgagtttggctatctttgggcattagtctcagcaatgtcatggtactcctgccaactctggatggttcacaagtgggaagactaggcccttaatcaaagatgccttcaagtaggacttggcagatactgcattcagcacaataaaagctgaagggaaaatgactgcttttaccttaacgcaaattttattaccaccaggtttcattataaaaatgttacaggtttgggtgtgtgtttattacataaacgatggagttactctgatcttcaccagctttcaaactggaatctcaaagggagttctatttgctagatttaaagctgtggaaccattgtttctcatgactgccttataagcataggaataaaatgcagggaaaaacaaactctctgttttctttccttctcgacccctgccaaatttccccaatctggaggaaggcacagccacgtgctggatgttgtagctgatagactatatttgggctaggcttaccagggataggatggtcttcaggaaaagtgggaatgtgactcaaatttcaggctcctgttgcgtctagcttagaaaggtgtcctggaggcttggacaggtgtgagaatcacttaagctgatcaggcaaactctcagaaacacagacccttatgccaacccatagtcagtggtcacaaagtacaacagctactgtcattatgtgttcccagatctctgggcatttgtctttcccagaagcaaagctttcatgtcattatcagtgtcatcttaggtcccttagttcattcctgggaaccctgcattcagagggagcaaggcataggctgccactgtcttatggcaaagaccattttgtcaattttactgatgttctgtattttaaaattaatgtacctgattttatattctttacttgagattttaaattattaaaaatatttcttaaattgaatgtttcaataaaaaatgtgagaattgaaaactacaaatttacctcagagtatagctttggtaatttccattggtttttctatgtgggcttattgttattggtttcatcctctgaatagttagttttgggcaagacagcatggtgtgaggaaaatgggctttggtgtctgccagatctggatgtgaatctttactctgccctttatcagttgtgtgactaagttataggatcacaacttccttatttctaaaatggagataataatatctgcttgttgtattctttaaacgatgatgaaatgaaagaatgcaggcaaaggacttagcatggtgcacctagtagatgctcaatccatggttgctatggataataatagcaaaaataatacatcactggcacaggcaaaagctttgtggctgggaagtgctctccatttgcatgtcttgggcagagggccaggacagtgggtatcctttctggatcaaactacttatcctaatgtcctccagagacactggcagatgggacatgaaataccaacagtgtgcctaggggagggcatgcagccaaatgttacactgaattgagcacgccaaggcaatccaggaaaaaactcagcacaaaaactcaccattcagaaattcccctgaactgtcttgatctcattttctcttgtgggatgttcctcaatgaactgagcttccctaccccagatctggcttctttcctggctacccagctgggttgctttcccctctgtagggttttgactgcacattatagccagagccttgagggaagtgagcatttggggagcaaaactttatggagcagcatctctgtgctgggaattaggcttggctctgagcatcaaacatgactaagtcacagttctgttcttgaggacttccaagtcaggtgccttagtccattttctgttgctataacagaataccacagactgggtaatttataaagaaaataaatgtattacttacagttctagaggctgagaagtccaagatcaagtggttgcatctggttggcttctggtgagggcttcatgctgtgtcataacattgtggaaggcatcccagggtaataggggggttgcaccgagagccaaactggctcttataacatatctactcttgtgataaccaccccattcatgtgataacccatttaatccattaacccattaatctattaatccatttaatccattaacccattaatctgttaattcattaatctgtttatccattgggttatggaaagagccctcataacccaatcacttcttaaagaccccatctcttaatactgttaaattggagattatgtttcaacatgagtttctgaggggacaaacattcaaaccatagcatcaggagaatactgacccatgaacatcagaaaggctaaacacagtgcctttaggcccatccacaggaaggaggaaccaactctttcttgtggagtggcatgggaagccaagtgaggctgatggaggagaggacttttgaactgactttgtcaggataaataggttaagatgtatcaagttttcggtaagtttttaaaaatacctatttgcctttggttgattcttgccttctctgagtctgaggggcataggaggtgatggaggagatggtaaggtttaggaagagataaggctgcaggaagctataagcaactgtaatctgctatccacactctctccatcctgcagaactccactgtatatagaggtaaactgaagtggaagttacttatctgtgttcaaagcagaatcttctagttttctctgaagcccaccctgtacttctgaatactttggtgggtagcatggctctttctctcctagtctttttggctcagcaagaataccggaaactccactctcctgaagggtattacttttcatggccttgcatgtggctataactcattgatcttgaatgtagctgcacccccggctcctgaaatggcagaaaggacatacagaagggaattaatctcagccatatccattcacaactgaaacacagaactggttcttcagcatccagaggccaaatgtcaagctccaataagaggaaagatgcaaatgcttcctcagcttcaaggaactgaggcctcccaggaatgttgtctttgctcctttcttgatcccacctttgcaattgagtgaggaggaagttttcatttattcttcaagatagagtaaatcactcttctctcaccaccttgtctttgtgttaatgcttgccatggatgacatttggccattaacagctaagctccctcttccatctaagtttttatccctggaaacattcacaggcaagtaagagctggatgattaattttcgaataaggatgtgtttgagaacaggccaggggcacacatcaacagccacatagccgttggcttaaatggatgataaattctgcatcccaactaatacaggcccatagtccctgctttgaaaaccaggggtgatgacaggggccatgggtttctagtgctttccacacctgtctcagaaagcaagcaaaataaccacttgggagaattaagataattgtgtgttgagtgtttttccctaagaaagagttgatctgttgcttcttttgattaggcttttatttttgccctttccctctctccactgagtttctagttgcttcttttttattttattttattttatttttttacacaaaagacatcatgggtaagaagaggagattttattttgaagaacaatgaccacattaacaaggtgacaacagataagctaaaagtcactccattttctgccagggaaaaatgtcctttgctgccaaatcacattctgcttctctttgtctactctccttttataggagggtggcaggcccagccactgatggactcagaagaaatatctgggagataagatacacccttgattcatatgagaaaagaagcttttgagttcaatgataaaaaataacttcctttcctgttccacaacattcttgtggctggagccctctgtaggacaacgacatttctctccccttggtccaacatatcacgctgaaaataactatgaatttggaaacttggtaaagggcaaaaatccaatttcttgcatttaatagatatctaggcttagattagattctgtaggtatagaatctgccctacatcctgctctatatttggggcaaagctgagaacctctctatctttaaagtgtcacagctgcatttagagacccaacccattcagcattctgtgaaagaacagtagaaccaaatatccatgtgtgattatattcccaagtgtgtctatttaaaaaaaaaaaaagaaaagaaaaaaacaaacttcaaaatgattggagaaagaaaaactggatgtgggatggaggaggtgacaagggaaagggaaggaagcttctaaggaagtgagatttgagctaggctttgatgaattggtagaaatgtattagccagagaaacattttagggtatatctttttgttgttgttgttgttgttgttggagtcttgctctgtcactgaggctggagtgcaatggcacaatatcggctcactgcaacctccgcctcctgggttcaagcgattctcctgcctcagcttcccgagtagctaggattacaggcgcaggccaccaggcctggctaatttttttgtatttttggtagagaaggagtttcaccatgttagccaggatggtctcgatctcctgacctcgtgatccgccctcctcggcttcccaaagtgctgggattacaggcgtgagccgccacgctcgacctagggtatatctttctaagttttggtttcttctataaaatctcataggcttgttgtgaagatttaatggcataattaaaatagtgcacatggcacactgcttgggacataaggactgaataagtggttgtagttgttgtcattgctactgttattatcattgcaattaggaggtggtattggaagtatgtgaaaagaaccttcgtagggacatgatgctattaccacaggtaattaaacccctttttcctgacccctttttctctgatcttatcccgttctttctgagactgtcatcttttatattttggcatactttggttaatattagttcgcttctggcaagatgaaagcagacccaaccaagtatcaaaagattttttttaaccccgctccatttcccaatataacatcttatacactgatttacaatttcagtagtgggtggatattcgagtgaagatgtaaatataaaaccaatagcttatgctataatttctccaggggtctttgtttttagcaacttattttagcaatttcaaaaaatattcactccggttattttgattttcttctaatctgtttatcttccagtgatttcattcaagtcacaaaggaaaggtgtttctggaaataagcaatgaaacatttcttttttaagtttagtagttaatatggcagtatttttgcctcataagtgatggatataatgtgtttgagaggggcttgtccattgatgttagggactgaggagattgtcacatgcagtggttgggggaaaccaggatggtaatgttaaaagtaatttaatgactcatgtgctcaggaggattatgctaattgcttggtcatagcttatcctcatcacaatcctctgatgcaggtacagttattcttctccttccatagatgaagaaaatgaggcttagaatatttacataacaacttgcccaagattacagcttagttgttgcagagccagaatttagactcagttctctctggctccaaaacctatgttttgtgtgtgtttttctttctttctttctttctttttttttcccagtaggttatactgtctgcagggatttaaaaataatgatcccaaactaaacatgggagtgatgtttttaggttatcatacagtgccttggggaaagtgggagctctcaatgaggttaagggttaaaagatgtgctatggcctgtgctacaatctctgtttagttcgtccaaagtagaaggaatttagttctgatctgaaggtgtaaaaactgatcagaagaaatggcctcaatcaaaatacaagactgtgaactgagaagtggtgtcacttggacaagggacagagccaatagtgtcctgtgtcttgaaaaaagggaggggcatggtaggtaaagcctgttaccttcacttttggtttctttaatgacactagaactttttgctaattaacttgattgcctgcaactgatatatttattactaagcattgtttatcaatgacatattgttcaaatatttgtttcccaggagaaggctgtaaatgtcctctgggatcataaaaggtgatggattaacaagtgctggtagttgtggtaggtcaagaagttacaatgcagaatttcccatactgttgtttggatatgttggcaggtcagcatgaagagatggtgtttttccatgatgagaaagatgatagtttgtcctctaatttcttagctttagcatccggtgaagttgcttgcagggactatattttatcttatctcattcaaagtctctgaatgaaataacaagtagcaaatatgattacaactctttctgtagttacaaaaacctatttttaaatgtctcccatctacaattggctatcttcataccaccatctgctttctcaaatttcccaaggccatttgctgtggataaccacaaagctgcccggggccaaaaatgccacctgttgactggaacagagaactcttggattcaatatctttttcccctccacctcctttcttgcaccttggaatgataatgcatgtgtctctgaagttccccacactagccagatgttccagtcatacaaaaaaattgcttgcaatttctcatcacatcatgctctctcacacacctacaggtctgtgtacactaaaacctctgaatgcttttatgacctattttacctggctatttcttcagtttagaagccttaagcatcacttttttgggggaagccttccctgaaattgcccagggtgatttagatatctccctttccatagcctatatgtaaaggaaagatagttgtgcctgtctatcttttagtggatggtagtgcttccaagggaagagggtgaaccagtacccctataaggacctgagccagtggtggagatagggagggataaagtcaggcatggctccaaacagtcttttatatcatcatttgaatttttttttcatagttgcatgcctcatcctaaacattcttataaaattagcactattatctatgttatgtaatataaaataatctctcctcaatcattgagtaaagctagtggtccaggaagatccttctatatttatcctgtggcttcctgaactgccaggcacgctacagtgtatctcgggagtatgcataagtccctctgaaaaccaggtataaaatagcgtctctcaaggcagccattcaatggtctccttcagagtaggccctaggtctttcatctctgctatagtattgtctagtggattttagatactcaagaaatattattttttggaatgagttaatctttcaagtgatatcagacataataaagaatcagtgtcattaatcttcaaaaagacagataattcatttgtagaccccaaagtctccatcaatctactactctttctctaattattcttgcattttatgaggtactggcatttaaaattaatttttaaaactatcttcttgagttatgttaacattggttactcactaccatgataccagtattattttccactcttcattgcaaatacatgttttccagcaatattatgggggaaataagccttgatggaaaaacctggaactctaaacaccatctgtagtttcttttccatgggaaaatatgtcctgaattaaaagggaaaactgacttagaaatgagcttcggaacacttcaaggctgaagaagactgcattcaagcatcagacccctgcatcctacagctccaatttatacagcttactgcccgaagcctgggggcctaagggagggagcctaaatccagagacacaaaatgacatcctagaactgctgaagtgggcagggaggacctcagtgtggtcccccgctgggctatttcagagttctatcagcatcatcactaggccatcttggatacatattgaccatcccagaaagccagaaaacttctttcttacaaatcctactgagatttacatctctgtgatcccaaaactgttccctcttgagacaagaaatatccgaatcatctgttttctctgttttaaaaagtcaatttttaaaaatattgtttgttaagaaatatttatgagagaaggagctcctgtgtgcaaagcaactttctaacacatggtccatttattatgaaattattctgcagaaacttcctgttgctttgtctttctccttttatgtatatatgtatgtatatatgtatgtatgtatctctttagagataggttcttgctcttctgacatccaggctggagtgcagtaccgtgatcacggctcactgcagcctcgaactcctgggcggaagcaatcctcccaccccagcctcccaagtagctgggattagccaccatgcccagctaattttttattttctgtaggaacagagtctcactattttgcccaggctggtctcaaacttctggcctcaaataattctcctgcctcagcctcccaaagcgctgggattacaggcatgagccaccatgcccagttccctttctccttttagaagtgaattactctgaaccaaaaccttacaagagcaagccaaactgtgccttgattctctttcatgtcaaagtctaggtggtaaaacatggataaggggcttttgacaagaacaggagacttctttacctggcttctctagtaaagcttctagtatctcagaggggccattgattctccatacctggtcatttctccatacctggtcatttctctttcctgctattccactcaaccctatcctcaaacaaggaaaccttccctcccaattgagtacatgatacttttatgtctcctctgctctggaaatgtcatttctgattctgctgggaaggcaaccaatggaggtctcagcctagagccttaatccactgtcctaggcatgttctcagactggaaaaaactgttgggaaacaagttcagaacctgaactaggtgagactgcaaatactggtatagacaggtttgttttaatttataaggttgctcagcaaaacatccccttttctggaacataattagtatgtttttaactgcagatgtagaaaaaattgtttagggtacagaccaatatattttcttatgtttataaggaaggtttccttctctctgtttctcctttatctactctttacgaaaccttgcaagagtagactaaaagggacctcctttcattacacatcttttttcctaagaagcaaaatgaactaaattagttcattcactcagtactgtaaataccaaataaaaaagtcatagacgtatagatataaatactgcttctgtaatgatttttttgtgtgtgtttgtataactagagggcactgggagaaagagaaaagaaattattcaaagttcaaaggctccaagatttactaagaaaataagaaaagggaaaaaaaagcccaagcattcacatgctaagatagctgaaggatcaagtaatatgttaccccagcattttcttcaaaagaaacggcttttgtagaaactggtggaaagtccaaatctgaacattttttctgattataataaataaagctagtaatccctgtagagattaagaatgcaggctttggagttgctttcactgtgctgaaattccaacatacagtcaaggttgagaacactgctttaagtacttagttgtaacttcctttctcagatagttcaatttggccctaatttggtttataattacagcattctttccttccttttgagagtctccatctgtacatttcccaagtgtgtggaaagggagggtggacatctctttccctctctcccacctgtgtctttgcataccttatcttcttaggaagacagcatgactattgttgttaaatacaaaactgaccccatattctaacaaatcatagttcttcttggcccacagcattactttttaatttcagtgatggatttctaggggtcatgcattggcattagcagtctttaaacacatcatctctttttctcttccttccatccactgattgtttcttgagggaggctctgagccattcaccttggtgattctttcccccaaaccatatcacccaaaatcaagctgccaagcccaggattggaggaggaaaggtggtcttctggaactgtatccataggaatcctttccgaactggcactttcatggggcatattgaagtattgtgaagaccttgagcagcgacagtatttggagccatcagaaaggatttaccttttttttttttaagtctttagtttatgatccttgtgctcaaaccaataatctttaaccattagtacctgttttgacatatggccagaaatttattttaaagaacggcattagttagccttttctgcataaaaagtcacccagtacttagtggcttaaaatttagtgggtggttctggtctgggatggctcagttaagctctgtggagtttgcttatgtgtctatagtcagctggggctgaatgacctagagtggccttattcatgtctggtgattagcagaccaagatgggggtaggggacaactgggccacctgtacctcatcatccaacaggatgggccaggcttcttcatgagcagcagtaagcagggcaggtgccaagatcagcagaagcagaagttgcaaggcttcttgaggcccaggctcagacatgtacaatgtcacttccaccgcattcttctggccaaatcaggtcataaggcctgctcagattcaaggtggagaaatagactccatatcttgctgggaagagctgaaaagcaccatggctattttttgaaatctaccgtaataacgaagcacctgtatttgcaaatttttatacacataaattaaaatggatttgaagttcttccaatagtagggtaactctccttgtattcaaataaatgggagaaaagggggtgggaatttcccatggttatgataatgagtggttcatgtaaatatcatgggtcatgaaagaaaaaggttttgaacagctgcccaagagacagtgtagtgaggtggaaagagcatgaatcttaaaatcagacagacctgtgttcaaactccatctctccaacttgttagttggatggccttgggcaagttatttaacctgtctgaacatcaatttcctcaccataaaacaggaataataatacctaaggcacatatctgttgtgaggattaaataagattatggggtaatgcccagaacctagtaaagagccatttcatggtgctagtttccttccttgaccccttaattttgtgaaatcggtgtgtagtgggcatagtgattctttcattcagaatcaaagctgtcccacccctttcccttccagataccagcctgtcttttttcacatattgcatatctttgagagatgacttcaatacaatatttttcaacctgggatctttgcaatgtttgcaaacataaacttacagttaaaaattccaagacaattattagctttggtgctatagattattcacatttttgagttgtgcatagcttgctttttctttatggtctggatatactgtgcaattttggaaacccaccatcagaaaaggaggctttgaaatagtagaagttgggcagcaatgtatgggaaccatgttttttcagaaaggatgcatttacattggataaggttttcaaacatatccaggaattctatgtagtgaggttagtctttgggggctagaggaggccaggttgggcaaaacctttgcttaatcttctcctctgatgcattctatagggctccattttggctaaatcatcataattcccaccaagacagcacagaatgataatggttttatttattattttatattcattgccggtatatgcaaagttttatagcttgctataaatcgagagggattatcacagctgttacttattttaacaggtcacaatagagtagtttatgccagatggtttggagaattttgagggagaaattttatacaggcagccatatagatactagcttgggtagtcacaccctgaaattaatttacatttgttatgatataaaatatatatgaataaacacatagttccttatgaatgagtgatccattttatagcagctatttcttctggaagtcaagggagtccctttgtgagcagtggtggggcaggagcaatagtaatgtgctgctactgggataggtgagaagtaaagctccaccacatgcatagctctggaggggacattcaacttgctccagggaagtaagccttggagacaaaattgagttttcataattgggtctcagcacgtatttgagtcaaagagaataaagcaggaaactcgccctaggtaaacataaggagagaatgggtatggtataaatacagtagagctagaattgggatcctcgaggtcaccctcaaggtcagtctgggaccaaaaggttatccagccctgggcaaatcacagaacatattacttcccttgcagatgctgaagtttatgggttgaatggccaattctggatgctcagcagaaacaggaagataaaataagtactgatgatcagaaatcattttagaaggtatttttggttccaagtctcatagaaaaattgacttacacaatgaaagacgtagagaaaattttacagatctctaccctccttattttatagatgaagaaacagaccaagaggatcatttaaatatgatcatcttagttttttcagtaaagaagtaaaatcagactgtcaaagtatttgggctccattggcttcctccaatctttctccccttgatccagccccacgagttcctctcctgtatcccacctcatgatgggaaaggaccacattcccacctatcagaataatccaaagaccaggtctaaagcacacctggattttcttggtaaattgtctgaggcataaagttaatataccacctcttgaactgaattaaaactatttagccttgtagagtcaattcttccagctcctgtaaaataggagtcaattaagatctgtttgtgtcaacaaaatagtaaattaaccagcaaaggtaaatttaaaatgggagatttggagcatataacagctaaaatctatatgtacaaaatcaggaaatgacagtattttgacaattgaatagtccatgcatgttgaaggacagaactggaatctgtatcgtggagtcccccaagatggctagtagaagaatgaaagctttgaaaatttgtaagctcagcaatacagaaatacccccactcttctcagggctgctgaacttccaataacttcagctttcaggaatacagcaccaaacctggaagtaagtgaaaagagtttcccaaggctacaaataattgtcagcaagcccacatgtatccttttggctcttgctggagaattggtaactcttctttaatggacagatgtttcccagccatgggtgtctgttatccccagctcactggagacttaaactctggggaaaggagctagaagaaggttgagaaaggaatgataatggagaactaaataccaaggaaagagcatggaaatccacaaaggagtcttagaaatgtgttaccatagagaccaataataagctttcttaataaagaccctaagtaatcaacaaaacattaaattgtgttttgtagcatctgattaaagagacaggaaagtgaattactcaaggtaggctaattctggtaataaacccccaatatttcagtgtcttacctctcactttccttgcagtttaatgctggttagcttgcaggtgggtacctaggctcttcccatcttaggaatccaccatcccatagagcctctgtgttcagccagcagggaagacaagaaagtgtgtgtaggaataggtaagagtttttatgtgccaaggctggaggcacacgtaacttctgcccacattccattggccaggactcagttagagggctgtacctaactgcaagggaggctgggaaatgtagtttagctgtaggagaaaggagacagtttggtggacaactaattagccagtttcttctaaagaaagtataaaatatgctcagaacaataaggggcttcagaaaattgttcttggttggataaactttagttatatggaaaattacctgtgtagactttaccatttcctggcaataccagttaaaggaaatagttatttcctgagccacactgtagatcagaggttggcaaattatggcccatgggccaaatcccacacactctctatttttgtgcagaaggttctattgaaacacagccacatccatctatatatgcaccatccatggctgcttttgagctacaacagcagagtagagtagttgcaacagagactacatagccagcaaagcctaaaatactttctacctggccctttacagaaaaagtttgttggcccctgctatagatcatcactgtcctaaaaaaggacacatttgcaaaattgtctgtgagacctggtatccttggctttcagtaaaaacatcagtatgtcgaagagacatctgcactcccatgtttattgcagcactaattgcaatagccaagatatgaaatcaacttatgtccattgacagatgaatggataaagaatatgtggcttgtatacacaacagaatactattcaaccataaaaaaagaatacaatcctatcatttgcagcaacatggatgaaactggaggacattatgttaagtgaaataagctaggcacagaaagacaaacatggcatgttctcactcatatgtgagagctaaaaaaaagatcacatagagagtagaatagtggttaccagaggctggggatggtggtgtggggataaggagagtctggttaatgaatttaaaaaattacagctagataggtggaatacgttctagtggtatatagcactacagggtgactatagttaacaagaatttattgtatattttgaaatagctagaatagaggattttgaatatttccaacacaaagaaatgataaatgctttagatgatcaatttgctaattatcctattttgatcatttcacattgtacacatgtattgaaatatcatactgtatgccgaaaatatgtataattattatgtatcaattaaaataataatttaaaatatatatcagaaaagtaggatacctatatggactgggatgtaaactcagtccttagaatgtcagctccaactgggcccagactctgctgtatccccacaagcacccagcacagtacctggcatctgagagatactcaataagggcttatatttgaacctttgatccataggaagcttcaggtaccctaaccaccatacaggggatagggggacctaaaaaaatgcaatatgagcattatgtgtgaagacctcaaacacaggtaggaaggaaccatctttgttgagcttttattacgtgctgggcactatcattgtgctttattgttttatttactcttttaagcaactctataaattaggtattcttattttcattttacaaatgagaaactgattcaaagaaggttcaagattcagagagtcaaataattttcccaaggccacacttgttaagaactggaggagctaggattcaaacacaggtctttctgggtacaaagcctatgtggttttcttttcttttctttttcttttttttttttttaacctctctgccatgggacttgctaaaatctcattcaaatttaagcaatctagttatatcattatttttgccatcactgttaacaaccacctcattattgtaaagatcaatacaaaggagaaaagacagggccattttcattgctttgtggaattctgcagacttcattgtcaaggctctcccgtgatagagcagacctgaaaacctggagcaatgcagttcatttccttgggctgtgtgattagtgacttggccactagctacccatgcacttgccagggattgctgtcgagggcagccattttgctcaccctaatgtaaattctcatgtcaagacctgagaggtttgagtctgtacatggtgaggcttcctgtttgaagttgatctgagagcttgttaacatacagatggccaggcctcaccccagagtctgattcagcaggtctgggaaggcctgagaaggtgtatctctaccaaacccccaggggctgccggtcctttgagaagcaaggctaagggaaggacttccctttacctttgagaagctctgactggtattcccacccacttcacatctcccatcagtagccaatccatcaagccttcccaaagccttaggggtccaggtctgcccttggcagcagaactcctcccactgacccctcggtgacatttgacattataaatcacccagccttcttaaaactctttcgtccatccccctgtttctgagatggggcccttccccccttccatcctggtctcctgcttctctgagtaatgtctcttcctctctgatgaccttttcctttacccacccaccccttaaaccttggggtgcatggctgtcttctcaccttcactgggggagtggccatgccatctcctcccacctcatccttcctgtcccagccacactctgtcttccgggggacttccaccagattctctgtcgttgccagcagctggcagccctccaaggaggctagtggagaacagctaacccagactgacttgggttctaggtgatacttcatgtgaccacaatcattaattcacagtaatgccaattaggaaatattctttatttcacacacaggcaaaccccaagatttcttatgaccttggcaagtggagtgtttcacaattgtgaattctggagaagttacaggcctggtggatatagtattgcccacacatgcaaatctgcccagcgcctaaacatccctagttgaaaataggcaacccagtcagaaaagagtcaagttttccctaaataggtttcaaagacatattaccaaaaacaacatcccacaagtcatctttggataatttcattcactgggtttcttcttgttatgtatggtattaggatatatcccataagtgttgtctttgaagtggccctaaatggctctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacctgtcccctggggtcaccatctgtgcgcatgagtggggcagcctgacccactggccattccagggacagtgagccaaagctggacttgctcagggcatgctaggccaggaatgtgtgggcagtgaaagagcaacacccttcctcacccccctgcggggaagactcagcaggccccgccatgatggtgcacagtgttttgccatactgtggtatgctctggagttttggagctcttgttttatgaggcttttattttacagtttcttgcctcttggtgaccagtttgtttttcacagctgcttgtgagcaaggcaaagataacgagcatctaaaaatagccctgcagttggaggtacagcttggcttgaccccgctattagaggggtggggtctccgttaccagctccctgagggtgggccaaacttgggcccccagacagcctcagaccaggtccacacatccttcagagcaattcaccttcaggtctcaaggcaaggcagggatgctgagtgctggtccatgtgagaagggcagcagctctgagaagcctcatccattcccgggtgaggcccaaagccactgggctgcaaggctggaggatgggagcctggacaggggtccctcttttgcccccagccatggatatccatccctggctttacatcccctggttggatccagccatatgtatggggcttcctcctttgcactttaaagccaacaagcaactccctcacagtggagttcgttccagaatacagagggacaaaaggggccaggtggcactcaaaccatgccaacttcctactgtgttcatagcagctgggctactactctttcctttccaggtggaaacccctggacagttgggtgaggagcctcttcctggtcagcaggagggtggcgccagcctgtctgaagggggccgcctccagctgatggtgaagaggccgcctggaatggagataggaagggactgaggactttgcagtgattgcagtggaagcaggaagtgcaggtcttctgtgggtcctagattctgtgagcctgctaggctcccctcattatttattttcaaaagccttcatttcttccctgttcactttttctttcgtggtgatggtggtaaagtccagcttgaagaaaaaaggccccctctgttcttgatttggttggatgataggatttttattttttttggcaagaatgcattagcaattgctgaaaaatgtaaatgcctatttttttctccagtgaaataaatgaactaaacagcaagggaatgtaagggcaagcattctctgttcaagatggaatctaccaagtgattttctcctctctttcaaaatgaattttgattgaaaatttttacctttattttctgtatgtcataactataatcactgggcaactattaagatagagatcgtgactggggggaaggaagagaccaggaaacagcacctttgagatatccatcattcctctagtcttctagtggagacttgcacacagttgctagtttatctttaaaatttccaccatctttgtgttccccatggaagacaaaggattaatgatgatgaaatgtagtataaggccagtgcaacagtggccaagtttggccagcttagaagagtagatatgggaagaccacgggttgagatttcagttttttaagaacatcattggcttggctcgacctgtaccaaataagatatcaatgatcccttggtcttaaatagaaagggctgcttcctcttgaagatcagaacctaaaccagcaattgactagagacccacagtgagcatattggtcagggaaggataaacaccataataggtgagccccaaatttcagggtttaacacaatagcagtttatgtcttacataatgtcaaaccagctttttgtcttgtgattataaggaacctagtctcttctcttcttatgaatctaccattccctagggccttgaagcccctgctgggtcttctgcatccagaagggaaaacaagaacatggaagattatcctggaagcagcacctctcactcccacccacattccatggccagaactcaatcacatggccacatctaactgcaaggggactgggaaatctagtctgtgtgcagtttgtgctatggcagtacactctctggcatggaggggccctttttaagctctactttgagattggactttggctctggacaagtcatatggcaaatacagatctccatcttaaaaatggtggtaattccacctcctctttcctgtctcaaagggatttggaaagatgtagcaacataaaaggctcctacagggaccatctggtccaacctctgtaggcaaggtcattatcattttcctcaatttatagagaactttccccatataacacagctggtttatggcagggctgaaatcatacctagatccccttctcttggcttagtgctccttctaccatgctatgttgaccctggcatcttatgaaaacagttatataggatattgtttctgaaagctgacatgctttcataatgtgtagtcattaaaagtgacttcatatgatttaaaatccaagtatgatcttcttctggttcttactgtataatcacttataatcaggcaaagaataaccagacactaatctatgccctgcacacatatagctcatttaatcctcacaataagcctaggaggtagaggttattattatccccattttacagatgaagaaactgaggcacagagagaataaataacttgcccaaggttttacggcaaacaagtgacaaatttgggattcgatcctgggcactatggctccagaatccaaccctggactattttaccatactacctttctgatctggtagactccttctccagccctttctgagatgtccaattgggacatttttaatttcctttttaagtgagtgaccttgaagatccatgaggggagtcatttgtaaatttgctgaggcatgtctttgagcctcaagcatataaaatggatacacaggattgagctactcagctagtgaagaagctcagctcccaacctccagctccaacagcccaatgaagctttttttttctttcaagatttttgggatagacactactgtgtagtccgttaccactgtgaagtaataaaaatgtctgtttctttgtgaaaagcagccgtggtcaaccataacctttggtgcaagattaagaggcagttgacttggtaggggcaggcaaggccatcatagtcacttaactctggaagaaattgctttttgtggttgtttatctattgttgcaggagaaaccacccccaaaatttactggcttaagatacaagccaatctattggttcaaaattctgcaatctgggaaaagctcaacttgacagctctgctagtcttgctggtggttggtcagatggtatgtcacctgcaggcaaggttcagctgggtcactgggctggctgtgcttatgtctctttctgggtagtctcagggattctccctctccacatagtctttcccagtggtctttccatgtgatcactccagcagggtaactggatttcttacctggcaactcagagtgcccaagggtgcaaaggcaggagcttccaggttttcttaggttgggcctgtgtcttgttttaccaacagaatgaggcaagtcacaggcccagcccaaacctcaggtaagggaattgaccaagggcataaataacaggagacctggaagtagacatccacaaaggtaaagtctgaagcttctgtatttacaaagttgaggattcccaaagatctcaggaggagttgatggtacattaaaatgtaggttagataaaatccattccttttgctccaatggagcaagactattatattaatagatgcttgattctttcttcatcctgaaactaacgaatcatttatgccctacggaagcatcaaggctgtagatgtgactgcccaaagagaaggggaacagaagtgtgtgacttctgctctcttgccgctgccatactgtctcaaaggtatccattttttaaaaggtatcaatacctatcctcagacataaactaaggatagtttctgaaaaggcaggagcataccaattggatgagaagacaagaatatttattttttctttttattatacttttaagttctgggatacatgtgcagaacgtgcaggtttgttacataggcatacatgtgccatggtggtttgctgcacccatcaacccatcatctaggtggtaagccccgcatacattaggtatttctcctaatgctatccctctccccttgccccccaccccctgacaggccccggtgtgtgatgttcccctctcgaagacaggaatatttctaatctccatttacttttctctggcaagtcacacattccgaggggattcagcatgcacaacaggagtccctgcctgcctcaggaggtagagctgctctcctgcagaaacaggctagtgggttcaatccattgggactccatttcagattattttccccaggcttctgagtcactgtagtcagtgagggtgcagtggctactttgattcactgtctacccctcttcatcagggctcaagcacttattccccaagcactcatttgccagggctaggcgcggtggctgacagctcacagctgcatccctctttgggaattgtccttccctgaagaaagtcaccccgtctaaggtcacattccttccaagggcagcactcatctgatgaatggtcaatacggtagtataaaggcccactcaccttgcctcaactcaggacaattctacagggccatcccagctctagagctccccatgggatgggctgagcctttgttgtgactctcctagcccaacttctcgctctgcccagccctgcttaatccatttcctccacaggtgttgccccagagaacatttcctgatatgcttcccacaccccaatttctgtctcaaagcttacttccagggaactttcctggaggtcaagtgaaggaggggttatagattgggctacttcctactacaggctgggccactgtgggcacacacagaagtgggacgtgcagcctgggccttccccaaacttccaattgagaagacatgacaagcacttaagtgacagcatgagaagttaagcaaacataatgtaccagagtcacaagtaagtctgatgcctcaaggattttcccctcctcatactaccccttacaacatcccccaaagttgtattttgtgtttttttaggggatggatgattcatgacattgattatatggttaacaattgtgcctaagtgctctcccacctgattatttcttcctttgggcatggcactggcaatcaaaatttatctttcaaattaaggctataattatattttgataaagatctagcaattcaatgagaatgaaattttgagggttgccaggatacggatgactctgggttatagagaagggtttgcatgcagaatactaataggtggttcagcgctcttatctagacctttccaatagcgtctgataatgcaggcccatcaagtactgtttctctgctattattctagcagaataaaagtgatgaaagatataagcagggttttatgaatgaaaaggtgattcatcagatgtcttttggtctatctcaccacagttaagaaatacagtaataataatgtggtgttacctcaaaatctaggagacaaaaagctttctcttatttccttgcctcctcttttattgtaaatagaagcaaaatgtcttagatattgggttattgtttttcattgggaatagggacctgtgtttgcaatggtgttgactcccaggaaaatagaaacagtagaaattggtatgatgttatattttgacttttctttacttttcctttccattttactctgattattattcattcattcattcaacaaatgtggactccctagtattgtgcaggctctgcttgaggaatctaagaaagtttaaaatggataaccatgcatggaaataataaataatgacacaacacagtagcatccaacatgtcatttcgtggcatggaggggagagggaaggagtaatattttttgttaagtgagatgtaatttacatacagttgagttatgcataagtcttaagtgttaagttcaatgagctttgacatatacatccatgtaacaacctcccaaaacaagatataatgcatttccatcatcccaaaatgtcttcagtactcctttccagtctctctcccacaccttttggcaaccattattctgatttctatcatatagattagattcacctgttcaagagcttatataaattgaatcataagtatgactttaaaaaatgtccagcctttttcattcagcatagtatttttgaaatttatccatgctgttgtatgtatcagtagtttattctttttattgctaagcagtaatccattgtaagaatataccatactttattcattgacttaggctgtttccagtttggggatattatgaataaagcttctaagaatattcttgtacaaatctttgtggatttacattttttgtttctttttggtaaatatctaggagtgaaattgcttagttatagggtaaatgtatgtttagttttataagaaactggcagagattcttcaaaaattgtatcagtttgcactctcatcaccagcatatcagggttctagttgttctgcatcctcatcaatacttggtatgtcaggagccattctaatggatatgaaatggtatctcattgtggttttcatttgcatttctgtgatgacaaataatgctgaacaccttttcacgtgcttagtagacattcatatatcttgtgaggtgtctaattaagcctttttctcatttttaattctttgtctttttattattgatattttttatttgtagtagctcttcatatacactgagtaaaagttctttgttagatatttgtattgcaaatatttactcccagtccttacctgccctgttttttaatagtgttctcttgataagcagaaatttttaattttgacaaagtccaattatcaatgttttcttttatgactagcctcttttgggcacggtcagaacaatctgcttccctcaagttcatgaatattatttcatacattttcttctaggagttttatggttctagcttttatgtttaggtctatggtccttccctaattaccggttgtgtatggagtaaggtagggtcaaaattcatttttccccatatgtatatttagttgttccagaaccatttgtaaaaagaaaaccagaaaactccttcctttctcccatggaattgacttaacgcctttttcaaacaatcagttcaactgtgtatgtgtgggtctatttctgaattctctgtgctgcttcattgatctataatgtctactttcttgccaaaaccacactgtcttgacctctgtagatttatagtaagtcttgaaatcagatagtaaaaatcctccaaatttgttctctgtcaagattgttttagctattctagaacctgtgcattttcatatacattttagaatcagcttgtcaatttcttcaaaaaagcatggtatgattttgattggcattcatttgaatatatggatggatttggagagcatggacatttttaacaatgttgtatcttcaggccctggatatgctatagcttttgatcatataggtcttctttaatttctcttagcaaagtttgcagattttagtgtagaggacttgtatattttctgttagatttgtttgtcctttgtatttgatatttgtgatgctatcataaatggtattcttttcatttcattctctaatttttcattactagtttatatataataatacataaataatatataatcaattatatttatatgtatgtatatataaatgcaattgatttttatatattgacctttttgtatccagcgacttttctaaattcactctttagttctagcagttttttgtagattccatagggtttttaacctacacaatcatgttgtctaaataatgacagtattcttcttttttatcttttgtcttattacactggtgagagtgttttttaaaattcttcccaatcttaagggaaatcaacatttcaccattaagtatattacctatagattttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagcagagacggggtttcaccgtgttagccaggatggtctcgatctcctgacctcgtgatccacccgcctcggcctcccaaagtgctgggattacaggcgtgagtacctatagatttttcagagatgcctgtcatcaggtttccatattaggattatatagacttcatacaatgagttgggaagtgttctctcctcctctattttctagaaaaatttatgtaaattggtattatttcttccctaaatgttggatggaattcactggtgaagccatctgggtctggaattttccttgtggtttttattaagaattccatttctttagaatttacaggactacttgtattttctgtttctcctgtgtcccttgctaagtttttcaaggaattttctgtttcatctaagttgttaaatgtatcaatactgtaggctagagtaggcagaaaaaccaaacatatcacctgaagtaggactttgaagagaagagattggctagacaaggaggggagtcctggggaaagaatggtgtgagaaaagacatggggtgtgggattaccaatggtgtgggttgtttaatatggattatccccatctggttgtagtggaagttttgggtaaagaagaagtggaaaatgatgatagaaagataccttggagccagatcaatgacaaattgtggagtttagatcttatgtaggaaatgaaaaacccctatattattttcaaacaggggcacggcctgcagaaatggtattgagggaaatgatttagaatgatggattggtgaaaggagaagggtagaggtaaatgcaactcttttagaatggtgcagtatgcagtggtaagcactgcctaggtgaaacaaatttgataaagaatggagctaggaccaagtagggaaaggcctctgagtatttctctgtacacaacgtggtgttatgcacctagtacaaacttatcacactcttaatattttctctgttcccatatccatctcctcacctggacatccagctcctctgggaaaagaccccaaggtttatctatgctaaagtactagtgccagcatgcagtacacacttagttaataccaagtgaatgaatgaaagctgaaaatatgaatgagcaactggatgaatgaatgagtgaatgaatgaatgaatgaatgagcaggcaggataaaaaactggattcatcaggataggataggctatgctatgataacagataagccaacaaagctcagtgctttaacacaataaaagttctcttccttccttacacaaagtctggtgtaagtcatgtaccctcctagcagcacgcgaaaagagagaacaaaggctcttgggaagtttggttaaggatccagcctggaagtggtgtacatcacttctgcctacatctccttagccaacactgagtcatttggcccccatagaactgctgagaaagctgggaaatatggatgtggaatggaaatttggtaaacactaaggacacttagaaaggagcaaaagggagctctaaaacctatttgttattgcttccagcctgagagaaagctaagtcctagagatgttaagggacttattgaggactccccatacggattacagattacttctgccaatagagctcagactctctggcctgcctttcaggctttaatatttataatctcgtggctcacttattgctaactaatttttagaagccaactcctccaagaggaactgtgagcagaacgaagcactaatagactctgccgttggttacgtggtagctccagccagaagcacaaatggagagaggcaggatatgggttaaggcagggagttttgaggataaacctcccaggagtcagcaaagcagtcctgctttgggaggcatctgtgctaagctcatgccagctgcctaaagagaactccacatcgtctgtgatctggagtctcctgttcaggatcaaactagctgcctccacagggcctggaatgcacggcgagggctctgtggctttggaaaatgctgccgaggtgtctcaggtggagccaaagatgtgaggggaagcacctcatctgccgcaggagggtaaactagatggaaggaggttgtgttcctcagccagatgtaggtattgtttggttttcagagtggtgtgagcatcacagatgatgaaggccaagcacatgggatgaagcttggcctaaggcgagttctcaggagaaggtgttggcaataggaggataaccatggagcaggagaaaagaagcctctcatctttcttagatttggcaaggagagggggcatcaatgacaatgcatagagcctgctgccttcccctggaggcagcttccctaagcggggtcatggacagtctcccagctcccctgcaccaatcagtggttccacatcagacttttctgcctcacatttttttttcctttttaaaggtacagttaagggccaggcatggtggctcatgcctataatcctaaccctttgggagacaaggcaggcaaatcatttgagcccaggagtttgagaccagccctggcaacatggcaaaaccccatctctctaaaaaaaaaaaaaaaaaaaaaaattagccaggggtgttggcacacacctatagtcccagctactcaggaggctaaggcgggaggactgcttgggcccaagaggtcaaggctgtagtgagctatgatcacgtcactgcactctagcctgggtgacatagtgagaccttgtctcacacacacacccacacacaaaagtacagttaaatagagtgaaattaagaatacaaaaaaaaatgacagaactctcagaaaatgagccatcagagaaatgagaagtgagcatattggaggaaatcatgaaagaaaggattaaaggagatactgtaactgtgaaatgaggaaagtaagacctgttctaatgccctttgcctcactccttctgttcctgcattctggctttgctgttcctcaaacattcaaacaagatctgaccttgggtcctctgcacttgctgttctttctgcttggaattctcttaccacacattttcacacagctcaccccttcactggatcaggagcctgctcaaatgtcacctttgcagagatgccttgcctaactactatcttagtttgaattcccccagaagtagaccctgagacaaggattcaagtacaagtagtctatcagagagatgaacccaagtaacacagcaggggagtggggaagtgagagggagaagggaaaggatctaagaaaggtatgctatcaagcagccaccgtgtgggtagctgtgcctcagtcctgctgaggaactctgggagatagtgtagaacacacttcagagttatcttgaccacagaggagggcatctgttactgctccagtgcgtgccctgtgtgtgggccaagcattctcccattgtcagaggggaaaaaatcacccttaggcagagggtcttggggaatcatgagaagcagccttctgactgttgaagtgaatgctgaaggcacattggcaaggcaagaagcatctgccacaacatcctctctaaaatagcaaccccatcacgctttatcaccttgttccactttctgacttcacagaatttacgccacctgacagtacatctgtatgcttatttgtcatctatctctcccagtagacagcaagttccaggaagacagagaactcatatgtctttcagtgcctcagacggagatagtgggtgtttggtaattatttgttgagtgaatgactattcagagaaagactgaaactcgttgacatcaatattatcctcagcacatgaaagagtgagagaagcagggcagaaatcagttgcaggaacgaacgtaagcattggacaatgagggccatagtagggtcttcaatatgaatggataagaacgttattccagtttcctggtctgatgtttctggggacttaaagatttcatctttgccatggccataacagctattattttttgacctatataccaaatggaaacaacaacaacaacaagagtttctttgcaggctgggaaatttaatatatccaaaagagggcaccctagtcttgatccactagagggctcaggccaaggacaacagggaaagaaatgtgaacgggacaaaggaaggaagtagggagagagagtgatggagaaagtgcggttcagggaagcaggtggcaaaggaagggcctaacaaccttggagtcctcactaaaaatggaatattcaactgggattttattaactttgagatgagcttttggggacctattcaagtaaacacaacccaccccaaagccccaaatcctcacttgttactgtaaaggcctgttagtcccatagttcaggccctgaatgctctgctccaggcccctggcttgaattcaccccaggaagaagaaacttctgcagtatgttgttgctgaaaaggcagcttgcctgggcagccccagtagatcctgctctctgtggcttcgcagaaaaccccatcacaaaggacactggcatttctagaatggacttgagcccatagctactattgaaagaagactcagaagtacacaatgggaagctgacacaatggtgaaagggatgggaatctgggcatctctgtgtgccacttgtccccagtggcttttgttctggaaagaacagacttttctgtgggtggataaaaggcaaataaatgttgtattcaccaaacctattggtttgacagcttttaaaagcaagttacaaaaagtcagaagagtggccaaagctcattcttaaataaaatgagattcccaagttgtgtttaggttccaattgccttctcttcaatacctttatcttttcatgtaaacattcttgccctgatatttaattcctcacagaactgacagaagaagcctcataaccacccactaacaggggtctgtgctatgtctacacaggactgaatccgcacatttaattgaattcactggcaacttttgggaaacatccagttagaggactggtttatgggttgtgtaagtgtaatgaaataattaatggttctcatttgttactggaatgaccagattagccagctgtttttgcaatgtcaaattctgtcaaaaatgcttgtgtctggagttgaagatccattgttagaacagtcagtgtgaccctacatgtggtttgggccattgcttgggttcaaaacagacctttagtctgatgacactgactcattccattcggtttgcaggttggtgtcatctgcaatttcacctctattccaattgctgcatgggtttgagggcttaaaaaaataacacacaaaaaagtacttccttactctttgaggttatggagtagcccgttccttttctgatcatgatctttggccaagttggtctggcctggatgtctctgagtgagtgaactctgcaacgaaagtcactctctggggctgaagggtgcccgaaggccagaggtggtgttgggttgggtgacttcctgagagggtgctgggaaggcatctgagcatgggctgggccacaggcactcccagttcctaatgcactgcctgaggatcctccctgaagagaaatcaaactcaccctttgggccaaccaggtgcttgcagctttcactggcaagtcttggcaaggggtgtgttagaacaaagagttactccacctgcagattccaagagctaatttgaaggttgagttagagaagaaaaagcaaaagaggggagaaaaaaagccagcactcagcagagctgcagcagaaaagcagagccccatttagtgtaccctcctgcacaatcttcatttctgtggatgccccaaagcaactcctaattcagcctgactcctatgcatcaggctttcaaggaaaagcttttgttaatactgactgtaaattgagggggtggctttagcaatgttttctgaagaacaaaaactttggcagattatttctgtagcacactggtgtatttaacaacattagacaaccttattagttcatagaggaagcatttatgcagtacctactatgtgtccaacactgtgcttgatgctgaaatatagagaataaatactccttgccctgaaaaagcatctagtttgacagggaaacaagcaattaaaacagtgtatgggtggtcctgtcttgttaacccaggtccccgattcagaactgatcaccatttagggaggggctgtgataggattacatttgtataatagtagtctagaaatcatgtcttctcagcaaactaaaagaggaaaagatgaaaacattggtcttccccttacctaaaagttccaatgacttaaagggacataaaagcatccattgacatgatagagcagtgaaagcagaagcccacttctggtaagagctggtaagataccaaagcactggaagggcgagcctctaactgcactcttgccatctgagttgagagggatgggacatacaggaaggaaaaactaaagaaaagcacataatcaaacaatgatacaatagaagccatgtcctaggctaaatagggaccaaatgagtactcatagcaatgatatagcgagttcattgaattagtgtaccattagctgctgtaacaaaccccaacatctcagtggcttaataaaattcaggtttattcctcacttgcatagtgtccaaaatgggttttgcctcattggtgggtagctcttctcctagctggaattgaaggatgcagattccttccatcttaggaatctactgtcttcagtagatgacttctaaggtctctgtactcatcttcatcaagaacatgaaaggggatgtgtgggaggtttcaatgggccaggctggaagtggtgtgtgtcacttctgctcacattctaccaggtggacctcaccatatggcacacccaactgcaaggaaggctgggaaatatagtttagctttgtgcccagaaagaagaggaaacggctttggtgaccagtgaagccagatggccactctgagctacaggaagaggtcattccactagctttcagctccatgtggacagggaccctcactccctctccttggtgtctctgatgcctacacttgagaatctcaggccttcctggtcagtaggtcgccattgtcatttcctcaatgccgcacctcccactattcttactctctttcacatctccctgttttagttcatcagagtgcttatcactaccaatgacattcttccttattaatcaatttacttactggcttttgtcctacctggaagtaagttccataaggacaaggacaatggcgcatgtcatgtccaccattctattgcagtgcctagcacagtggttggcacatgggaagtccttaataactcattgatcaatggatgaatgaaccaactgggccttgggaggtcttggatggcttcacaaaggaggtgcaactcgagcttggtattgagtagaatttgtctgggaggagagatcaagtaaagaaaggacagattaaaaggagacaaaaaggaccacaagatatacagattgaaccatttatggaattgagccagatccattcaactcacgtttgagcacctattacacacaggtcagtgttctagaccattgcttagctggaagatgaaacacacacacacacacacacacacacacacacacacacacacacacacacacacacacacaagaaagctcgtctgagccagggactaagacacttccctttacataagagggttaggcttcagctccacatcccggccaccaaggccctccactgaaccacttcagtcttcctttctggggtgaacatggtctccccacaccaatatctgctcctttgtggggaagtgatgtggggcagaaagatcttgggccttggaatcagatgtatgtgcttccagtcctgcctctatggccctcgagcaagcaacttaacctttctgtgcctatacagtaagttggagataatgaaatgttcatcctgggtttatcatgggaaccaaataagattagctatattgagggcctaacctgctgtgtggttcatggacatgctcactaagtcatcttcatcttcttcctaagcagctccctacctgcgcctctctgattcacatgactcctggccaagccacagtgaactactcctgggacctatatcaacagactcattctaaccttcatattaggttggatcacaggaaattgctaatattaaaaaatttttgcctcaaaagggaaattccaaatggtttaacctaacgctttagcatatgctgatctctcccagcatttgctgatcctatccagcccttaaccctcctcctacttcaatgttacctcttccctgcaccccttccctaaccagagagcatgtcttttgaacttgtgtggcagcccacttgatcctaccttggattatcacctaatttgtctaatatggctaccaggttataaactgcttgacggcactgacggtgttcctttctctttaaagcacctctgcacagtcccttggacataataagaggtgacatgtttcctttcccagacccaagtgtgattagctggggcctccagtacactcggagggattggggtcaagctttgctgatgatcctccgcaccatgccagccagcaccggggcccaaggcacttattctccaatgcgaccctctagaatcagttgcctgttataactttgctctctcttctcccctcatctctgtctgcctcaaaccaaccggagaagagaagcacaaaatgccttgaacttgggagggggaaatagggtgtcatttatctggcttgagcgattattgagtttttggctcttcatttgcttacttaagagttgtaacgttgaaccacatgaaattgccaatattcaactattttgacctacaaaaatgtcaatttcatagggttcaacctagtttttagtatttggactcaggcacaatcactcaggggtgaagctgtctgatccctgtgtgtggtctactcaccaactccttggtagagagatccccatggaggctactcatagcttctgatgggcctgtggcctttagtagattctgtcattgcttgtggagtttccatcataggctctggattcaaaaagggctagttcatatttcccttttccctgcaggtgccaacatatgtgtttgatctctgggataaatgccaagacctccagacttgagttttcaagtcttctggagatcaaaggctctcctcatcactgtgtgggcttctctgtgctgttactcaacaaagcaaggccagctcctgcaagggccagtggcagagttcacgagtcaaggaaggaaggggaggagctcctagttttcgaaatactgcaacatgtggagcagatgaatgtgaagggaaggaaggctttatgtttttctcaaataaactggaaacttaaaatgcaggaactttacatgaattttagttatttattaactagatccacctgaatgggatggccaggagcctttcatagttttctcattttatgtacccaaaggaatacacaggaccttagcaatcattgcactcaacaccttcagtcatttcatgtgacttccaaacaaagtaccctttactgtacattgctagtagaaaatatcctaatgacaaatgaaaaacaaaaagaaatctaaaactgaattaagttgtcttattgtagtcattttgcaactattcaaataagtaattatgccattaggaatcaagattttcagcacaagagaaaatagatcaattataaaatcaaggaagttaaattaaaatctgtaatcttagatttgaattggcaataatgttttaaactcatgatttattttcaccttctgaaacttacatattttctagtcctgtctactgaagaagtctagaaccaatgacaacctagcaacgatgaatacccctaccatgcagaatgtggtctctaaagtctgtttcctctgagaggagtcagggcttcttcaagaaagggctgattctaggtctgaggcagcaaatgtgcaagatgaacgtaggacacctcccttgacaccactgcacactcagctagactcaagctaattgagtctcacaagagaacccatctcttctgacaccagaatgaatccattatgggttaagtatttgccactcatctagctatgtctattatagagagcacataactcattacaaatacctaggcttttgggatggaaatgtccttggaaaagaatgtcttttggcttgcaggctcatgtatttatatcttctttgttggcccaataaagagcatcacttctctgctacctgcaaagatactaattagcaagtagtgattctaagtaagtgtagtggaggtggtatgtggggccttttgtaagtattttaaaattttccatcatcacttatgctctctaagtagattttaagagactaacctccacctaggagaagggatttattagcatatataattggatgtcatgtgctaattaccttactgcttcacaatctaaccaagccaagggcatctgtccaagaggacagaagaggctccatgcgccatattggaaaatagaaccctttttttcttatatccagtggctgagtgcagtggttcttgaataaaatggcgattttcacatgctttttctgacctgcctgtcccactccagctccattttctttcctgggatgtcagaggcacccatgtttatgatacctcatcttagtttgaacaggagtgaagcgattttaacatgtcatactcatcttcatgggtgcattgcctcctttcttctctatttttcccatggagagagcctgctctcaagaaactatgagtactaaaggatgatactcacggtcttccctgtaatcagcctcacctggttcatctcaaataatggaaacagatttgtgtcattcaccaaggagttttatttttaacccttgttaaacccataactatttgtttcgctctcctgaaagagcaaattccttatttccgatcagtattatctttctatacttttacttgtttgcaaacttgcaacactgacagtgtctcttcagggggtgtggggctgatgaagtaaggattgggtcaagcccccatttctcctaccctggtttaagctcaggcgtggaagccttgaaaactggcacaaatgtttcatgacttggtgatgggctggtcattttcagtacaggttgctgaaaagcaagcactttactgctatctaagagcacagtggcccttctggtaaagctaaccttggagttgaactaattattagattgaactattgagatagttttttaaggtcaagatggttgaatatcaccaatttaatatgcttcaatctaatacctaccttgttacctggcctctgtggtccactgactggcaacatcagcatccccctgggacttgttagaaatgcagattctcagatcccatccgagacctacagcatcaagatttctggcagtagaatctgttttaacaaagtctccaggtgattcctatgcatactggagtttgggaagctccattttaatctattatgttaatatttaagtctgcctttgagggcagccttcttagttccccaatggtgtggtttgtatccatacagcctcacatacaatgatggttcctggttaagaacaaatatttccatcagcattgttgaggcaggatggtacattttgacaagaacaattatgaatcctctgcctattgtgtgctctgtggaatggtagcttaaacagtacaatttctagctttgccaagcgactgccaccttagtgtctggtgtttttaaaaggatgtaccttgctgatatatatatatatcaaacactaggccatgtgtacatctaagatgccagtctgctccccatcctttgattagggagctggactctggggttagctgtgtcttgatagcctctgttcaaactggccaaggaaaggacagcccagttcatgctaaggagagcaaaatctccagtctggcccatagcatactcacaatcacatggagaatgtggcctcgacaggggtttttaaagagagatgctccttgcggtctgtgttataactgggagctaatccaaatccaatgctgggagaatgggtaaataaactacagtgcacccacctggtagaacattatacagctgttaataagtattgaggttgattcacaaaggaaaattctttcatttcgttttatttttgagacagggtctcaccctgccacccaagctagaatgcagtagcacaatctcagctcactgcagcctccacctcccaggctcaagagatcctcccgcctcagagtacctgggattacaggcgcatgccaccacaccaagctaatttttgaggttttgttgttgttgttgttgttgttgtttgtagagatggggttctgctgtgttgcccaagctggtcttgaactcctgggttcaagtgatctgcctgccttggccactgcgtttggccaaattcttttatttttaaaaagcagtatacaatagagtatatatgctatatctcaactatttagaaacgtacttgaaaaaattgcttggaaacatgctagcatgctaacagtggcctttggtgacaggattaagagtggctttttgttgttcttttagacttttttgaatgactgtgggtgtgtgtgtgtgtgtgtgtgtgagagagagagagagagagagagacagagaattagtctgttctcacactgctataaagaaatacctgagactgggtaatttataaagagaagaggtttaattggctcatggttctgcaggccgtacaggaagcgtggcagcatctgttcctggggaggcctcagggagcttttactcctagtggaaagcaaagcggaagcaggcttcttacatggcaggagctggactgagaggggttggggagaggtgccacacacttttaaagaaccagatctcatgagaactcactattgcgacggcagcagcaatgggggtggtgataaaccatgagaaaccacccctgtgatccaatcacctcccaccaggccccacctccaacactggggattgcatttcaacatgagatttgggtagggacacacatccaaaccatatcaaagagagagagagagagctgtattttaatctttgtagccctttcactactacataatagacatttaataaatgcttgaaagaaataaagaataaatgaatactacctcataagcacttggagtgacagggatcctgtcttagccatctgtgtgtcccctagttcctagcccagaactttgcaaaagtagctgctcaatacaagtgagtgggtttgaatgaaggcccagactcccagagctgctggacatgtcaactttatctaatacatttttcctgctgaaaaaccaagtttgtactgcacctgagtcagtgctttctataaatcagagactcttctaaaatatcatcaggccctagaatgtgtactatctctctaaggttgtgccctcccccactcactttccccacccctgcaatttttctttgttttaccacattcccctctctaccccttctctctaacctcttttgataatgccatccatcccctctctagacccctgtgaatgagaatttcttctttgtattgaatctaaatgtcttctattgcaatcctgtggataaatgaaacccatagttggtgcaaaaccccacttgagctatttgtgccaatttcatttccctgccaaagtatacagggagtcattaacaagtaacaaaagcaatcaaacacatttccttcaagaatttacatgggacaatgcctggcattgtcagggatctcaagaagtataagctgtggctcctcttgtcagaggcataaggatgtggctgcagatgtgtatggcaatctaagatagtctgtgaggagtgcaaatgagaggtgggaaacagtgagtggcccagcagcttgggagtgggaagtagaaggcttttgttgaagatgaggcttggagggtagatagatggcaaacagtgcaggcattctaggtatacaagccaaccaaggtaaccaagttgggctctcctttttccctgatccaatcctcttatgagttatttgctctggaaaactcagaatgcaaaagagacagaacacagggaaggaaaggagttcagatatttcatatactgaatacctgagtacactgaatacccagctatctatctttaaccagaatgaagaaagggggggggggtgtgcgtttccactgctgtagcaaaggttttccatcaatgtcatctttccctgatgatatgtatactctaagtctcaaagtggcttatagttgttactggtaaatgggcagggccctctcttgcagccatagtctcctcagagcagctcttggcgggtgtgtccttctgtaaataaacacaaggcaaaccctggcttctgtggctggttcatctcaacaactgctctctgagctgaagtgcacctggaattttaaaataaaaatggatggaatgtgtactatccacaggtgagaagtgttttttttcccctcctaaagacaacctgataaatgtgaaaggtagaaaataatgactgagagatatgaagggtgcagaagctaggctgattatccccatgggaggaagaggctgctgagggaagtgcatgggcctgggctcagaagacattggctttggtttttgcctctgccaaaaatcagctctgtgatctagggtcaaatattttaatctcagttttctcatcagcacatgaaaggagtggcctaaacagtggctttcacagtgttttgactgctattcagagtaagaaacacatttttacatcacaacccagcatacacacacacaaacacacacgtgtgtgcacatgcacatgtgtgacacaagtgatagcttcacaaaacaacactgcatgcagtgctcttgggtattttccagtctgctctattttatttcattgtttctgtttgtttgttttttaattatactttaagttctggggtacacgtgcagaacgtgcagttttaaaatgctagtcttgacctgctaaatggatttcacaatccactaatgtgccatgctcttgcagcttgaaaaaaaaaatacagaagtccaaatttctgaggtcccttccattagtagaatccaatgactctgctagatgcctaaaggaattttcttaaaacaatagctgagctgtgacagatgactatgtgcttacattctggaggaggtgtctggtatagaacatggcagcagaatgacctgaagataaacaagtaaattacaaactgctgctaagaagaatgtctaggactgcaactctgccactggctcagagagttaggatcgctgagtcattacactaaatgctgtccaagtcaatagatggcagagacttggggacattgaacctgtcagagaggtcacaggctccccagttgtgggcagtcttctttccagtttccagaaatgagaccctcaaagagtgatctttagtagcctcatctttgtttatacttcactcaacaagaagacaggcaaaataaagcaaaaagaaccttggagagctccagactttcctcttgtgaatttggaccctgatcctggcctcccaatcttcttttgttttcagcccaggaaagggaactaatatttattaagcagtgacacatgccaaggatgttgttacttaattggagcctgaaccactgcatgaaggctctgtgattcccctttcatagaagacttgctctggatcacactgatgctgtgatccatctttccatccaagagcccaagctctttccaccagcccatcctgccatagcttaactacagagtctgggtggattttggtgactggcatcaaatggagggcaggacaggacagggcagcacatcactcagagatcaaaaagttcaaacccctcctttgtaaagatggggaacttgaatccaggaaaggttcaacgacttgcacaatgtcacatggtgtcagaactgcaactagaacccaggcttctactggtctttccacaggatgttggacattaaaacaaccatggtaacagcaataattaaacagtcttcctggtatgaagcatcgttttgttttagaagctgggaaaactatttctaggggaaaaattgttctagatccttttagcgtacaaataaacacacagatatgttctcctgttctgtaagtgttggaatgtttcaagatgctggaatttgttaagagacctagatctttctgatgctgagaggtgaacatgagacacctcatccatagtggggaacaaatctgaattattatggttctacagaacaggaagcccagcaaggaaagactctgggaaactggctctggctttgggctgctctgcaggtgacaggagccttggtggtccttgctctccttgtactttaccctgttccttcctccaaactgccaagcagagtgggcaaggggatggttaccgaggaagaaagggcaggcaggaataaatgggttcacttggtgaaatccccttcccatcctcccaatagatctgagcactcaggcagcagcaacagacaccttagggaaatttcccattttgcctaccaagctgatggctcctgaggattggcttcagcatagcagggacctggagaacaaactggctatgtatctgtgacactgacaatttcaggtgcttattaattgattgatatgccaacacactcctccctgtcatggggcaccagaacggatggtttgtggagggatgtgttcctgcccacaaagctatgtgttgggggtggctgtggtggtagaagggcaggaagaagattagcaagatgtgggtgggtaaatgtgtctgcaggcactctgagaacgtttaaaaatttttcttccctcccttgaaggggtacaaattccatttctgagtcattttgtgcatttttctgaaaatttcaccacatgtagcagtcaaactttgatctcagctgtcacctcccccttcttaaggaagaaggagtagcaggggagaaagccagtgtggggtggggatgtgaggtaaggaggctttctaggaagggaggccaagaataagcattttgcactgctcccgggggcataaagctgtaaggcaatgggatgctcacaaggctaggaaagagagaatcaaatgagtagcacccctaacagggcaggggagatggggttagagaggctggggcaagactaagtttgcccctgatttttaccccttcccagtcgttcataaaaccaagcttcctcctgctcttagaaacgggcctagtctttccaagagagtggcagccactagttttccttaatgtctaagttagctcatttcagaggaccccagtgaccatatccatccttccaatacattactatgaatcaagatcttgacaattccattatctccagtgtttgacaggggaatgaactaagatcagtctataaagacttttcattgccctgtggacatttcctgcgatggcattttctttcagcagtttgcttttgtggttatctgtttgtggtgttgtctttctgatataatagaacacatcttcccaacctcctgctaggcactttctggaagagtcactcagttcttggttatacctgatgctatggatgatacagagagtagcagttctgaatctttgttctttattttgaaaagcactagatcctttttatgtggcagatggcccattctcactcccctaccccatcacccttagcttagggaaacttatttcaatattggtttgggaaagagtggcagcttagaagccaaacagagatggtttctgatcccaggtcttctacttaccaggtggatgacttagcaaatttacttactttctctgagttcccatttccttatctataaaataggggcaatattttcctctttgagttgtgtgcgggtaccatgatattattaatataatgcacctggcttagaacttggcatatggttggagcttcccacaagagcttgtagtcttagatgagggaaatgatacatccaaaaaacctttttcctgttgtggaggataaaaatgacacatagagccttatttcctgttgtaacccttgtcattatcttcccctttcttggggagcagtaacagaggggaggaattgacaagacaaagcaagtgactgactctagagaagtagataaagtagtgggagtgtgcattagtgatatggtttggctatgtccccacccaaatctcatcttgaattgcacctcccataattcccagtgtcatgggagggacctagtgggaggcaattgaatcatgggggctggtttttccaatgttgttcttgtggtagtgaataaatctcgtgagatctgatggttttataaaggggagttcccctgcatatgctctctttgcctgccaccatataagacgtgactttgctcctcttttgccttctgccatgattgtgaggcctccccaaccatgtggaactgtgagcccattaaacctctttcctttataaattacccagtcatgggtatgtctttattagcagcatgagaatggacagactaatacaattagttttctattattatttctattattgcatagcaaatcattgcaaacttagcaccttaaaacaacacctatttattatctttcaatttccatgggtcaggagtctgggtatgagttgactgggtcctctgctcagggttaactgggctgaaatcaaggtgtcagctgggctcatcccatctcatctcatctcatcttaggcccagagttctctttcaagttcattggttgatggcagaattcagtttcttgaagttgtaggagtgaggccctcagctcctagaggccacctgccattccctgccacatgtccctctccacaacacgacagtttgcttcttcaaggccaataggagagcatctctgttgctttttgtctcttttaagtattaactcaggattatactctctcttttgattaactcaagtcgattgagtacagaccgtaaaacccttttcgacttgtaatgtaactaagtcacaggttcttcccacactcaagggaaggggattatacagggtatgtgcacaagaaggcaggaatcttgggaatcatcctaaaattctgcctatcacacagtggcccctggacgtatgcaaataaacagaggaaaaaccttcttgctttgctttgttccatttttatgagaacaaacattcctagggcactaagcctgctatcttgcataacttagccatggtgagattgttaaaaagggaggaaaagggagcatggtgaacccgaagatgcagggcagccttacaatggcagtggagcagctcacgaatgaatggattcaactgtggttgaactgttacttaggaaaaggaatagattttttaaagaaggaaaagggggacagttttccctggaagagctccattagtggctgtctgcctgcctctagtggacacgtaatactagttaatgctctgtgaccaaatgacgtcactgagagcaaaggcattaaagagttttcctcctttccctgtctaagagatagacaggatggtggcaactgatgagtgaaatgttcacctgctaatgtgtggcagaaatccgatatagcttctcaatggagaaagaaaaagattttggaaagaaaaaggtgatgatccctggccctgcaggttgtcattgtgagggttggttcttcccaggagccatgactaggctgcccatgctggaactcatgcattactctttgtatctgtgaattcacagtcccaagcagcaggcagagtttagcagcccaggaactcagcactggcttgcccaacaagcacagtagaaatgtgtttagggtatcagcaaagcatgggcaccaaaaaatgctttttttttcaggtaacttgatatttaatatttaataatgagggaagagaatttgctgaacatctttacactaattttatgatatgccaattgattctgaaatttgggatcacctgctgcagaaaggtggacgtggaggagtgaggactataacctttttggcgttcaaggcctctagagtcttgatgcctgagaccatccctagggaactgtataataccaaaataggaaaagtcttccagtgtcattgctcccaaactatttcatccaggcagaatcacagttaaaccattttgcacaaagccagagaacaaatgctttatgagggtcgggattcctgtgtgttttgttctgtgctgtgttccaacacctagcaccatgcctgagactaagagctacttgggaatgttccatgggtggatggatgtttccattttcagcagcgtcttcccttccctcatgttgcccaactcctttcactcctacaagatcccaaggcatcatcagaagacattttgtgtttctcaaacctgcctgatgataaaaataacttttcatgtaatatagattaccaggcctttcttttggaaattctgattcaaagtctaggttgatgcccaggaatctgtgtttttgacaagcacttctgatgagccttttcttcagatgaacattaagataaataggaggggctcaggttttccccacacaagaattaaagagccatggccacttgacctggtttctgaggggctgtcaaaagttaccaccctaagcctctggtcagcagtgctgagggaatgagggactagaagagtcttctggtctacctcttagtcaccttggcccagccctgtatcctggctcccaccttcctgaaaagacgagcctaagggaaggggtgctcagaagcccctctacttctaggactgcccacctggcttcttgcccattctttccacagacatgctttctgttctgtcccttctcccagctgtcatgagcacatgaattcatggtcctctctgttgggtttggtaacgacctctgccccattgggtaggagttgacttttgcatgcagggagagcctgatttctcagtcaatcccccattactgaaccagagtggaaagagatgagactgggaggtggggggagcagggtgggcccaggacaggagtctggatctggatagtgtgtctggagggtaaagcagactgggccagttcatgccattcccgaggctgacaggctacccaggtgcttgtgaggtcctctttgcagccatttcttagtaaaaatcctcctggttcctaacatctgcttccagcagaatttctgtttaactcatggagagttccatcctaggatccctgtgtacatgaagaagatgagagtgagttaaatgctgtgtttgggggaaggaagccttccttccttgatctcttggatgagttgcaaaaactcatcttgcatctgcagtttccctcccttaatactcattacctctatgatggtttctttaatgcgtatgctcacccctgggtgaaaccaaggaagagcaatgctttgaaagatgacaggcaatggagccggtaggtgtagggcatgataaggataccttggggacgggaccacaagggacagaggcagggcaaggtataggccgaagttcaggtggacagcaggggcggcgtgcagaactacagctctgaggccctgcggccagaaggctggagctgaggcagcctttccattcatctctgaggctttcctccacatttttcagaaacaggacccccatctccacccccaagcaggctagccaggggcttgtcagtgttgatgagcgactgtgccaagggtgaggaatgaaggtacggagaggaaattagctagtcataggtagacggttggtgtcttggagcctcccgtgcctcggctcaggggcaaaagttgtccctatcagtatcataaatgccaaacctttctccggccttgagttagttcttaatgtgaatgcagtagtctggacttccactccacccagactttactcctgtcctcttccccaccccagggttggccaaaagcacaacttaaagccactgatggacaacgccctgtttcttgtcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagaggtgacagatcctgggcttgggggcttttgcgggagacaactcggaggttgtcccatccaggtgtcctctgtcccatcagccccaacacacccccttattatagcaagtactttgaaatgctcccgtttctaccctgaaatgaaatccatgggtaatatgcccaacccatacacataagaaaaaataatattatggtctaaatatgataataaagagaaattaaaaggaaattattgataataatatctatttcaatatgcaaatgctcaggcatgacctcactagaagacatcatgaagcagtcagatgtctgcacttgtcaaaagcaagtctggattaagtacagaccttcagaaactattccgaggggcaggagggcatgaccataaaaactggtacattcagtatatattagatatgggcaaaaaataaatactttggattagaatgaaaagggaatttggcttgactcataaataggcactaggtttttcccctataagagattctgatggaacatttaaaattgtgtgagacctgggacacattttcattgaccatcctctgcattatgggatggctgtcatctttggctcccatccaatcattgtaacaattagaatgatcccctagagggctcttctgcttctcttgagaaccagtgatcggtctaatgcccccattctttagtgggacacgcggaggcctagaaaggtgaggaaacttgctcagggtcacacatagcaggttaggtgtggtaccaggacccaacctaagcctctgaaatgcctgccagagctcttttcctccttgccatacactgtgtctcatggaaataggtactgatgtttacatgtctctcacagtcctgagaaagctagagataggctcatagcagtcaaaataggaatacagttttttcttacactggttgcttttcagtgccttaaaaccattctaattaggacaaggggaataaaaagtagcttcattgttttagagccccctaaattgggtatcagaaggggacatgtcagctttttttggcctttagattcttgctatggagatagatggtgtctacacattcaatgtctttcttccaaattccctacactcttttaagaaatggcattttgcaaaagtattaaaatgcaagtaaaatattttaatgtcattatcaaagtggagaaacaaaatggtgatattgttttcatcttatttattccacatttgtataactcctgccttttccccatccttatcttcaatagtttgttgccttcaattatcatcttttttccctcctcatcttttttcccttcctcatctttttttccttttaatgaaagagctaacctcctaatatccctaaagcaattgtttctaaaaattttccttggttattaggggaagacattgtgacacttacaatgaagagtgatgatcagtatcctgtagaagcatctttggcatacttaccattcacttcaattttatagttggctaagaagttcttttttaacttaagccaccttctgaaaatctttctttccacacttgccattcctttgcagcctggattaggcacccttcccataatatcctgtgcatcctcccatcctgccacttagaatcttataatcaaccactatgggcctgttttaccaaccaaccactaataagccattaatctatgagcaactcaagggcaaggatgatatcttattaatttattttattcaaagcacttagcatgaagctgacatatagtaggtcctcaatgaacatttgtggaactgaatcaagttttgcaaaaaactggttgaacattgagggcacaggatgactataaaggaatctgatcgttctcaccaaatcctttctcaggtcccatcattagaaatcttgggtaacattagccctttaggtataattatttttatccctttattttattaataagtcatccctgattaggattttatggattccaccagataacaccaagctgctcgtaaactatcacatttcactgctttgtcaggtttagacttaaagcagaactgaagaacagcaagtgccgatatcaattttctctgaacttcctcctgtggggcggtgagagagggatgtggggcctcctggggtttggaaggaagactgtggagatgcgttttaccctccacagactggcttgttttgcggttggctcaatagcatatcttgggtgtagtagttttaatagcactgcagagagccataaacaagaattatagccatcatggaattaaaaacatgcagtgtagaattaaaattagaaagtgactttttttttaaccttgtccaagaaacacaatagcatactgctgtattcatcagcataatctgcttctgccatctggtggccatgaataatactgacctatcagacaactgccatgctcagcaaatgctgcagtgagcatccctgtaggttctctatttggacagctggaatagccttgcttccaccatgagggagtggataatgaaacacagacaaatgaggctgtggtgacagcagctctgtgcttcttttggaggtgagactgtaaggagagagctggaggaccaagattaaaacctagaaattggctgccttcaagatctgcttgatagcaaaccccccaacaaattttattgaaggcaagggagtgttgtagaacctaagagtcaaaaagcaataacgtatgctgcccacaaggaatccctggtctagtggagagacagacaagtaaccaggtaatttcaatacagtgatagggaggctaagaagaaatgtaccaagtcatttcatagagcttcagggagggttttgtggaggatgtagcatctacatgtatttcaagttatttaggctctgattactttttttcccccttagtaattctttaatgctcagagccagtaatggctttatgtgatgctatcatttatgttcataaatcatggagagagagattcataagcaactataaatagataattatattttatatttcctttcctttcaagttggaggctgcagcataagtttcattggtctaagggaataaggagcaagattccactgcagtttcaggctgtagtggactaatgttctccctacctcagcaccagaaaaaggtattattagggagccattaatctagcctgcctactcccagcctagagcaaagaaagatatatgtttaagattgtgtaggaggggagcgattgaatggaaaattgagttgatgtctcccttccaactactcccctcctttcacttcttcctaaccagtaacacctgtaagtgactcttctgtacggatttaagaatgtaaacacttttccttgtgttacccatttagaaaagcccactgtttgcttgcataatgatggtggcattggaggtgggcactttaacaaggaagacatttatcttaaacagccttcggataaacattgactttggaggcagtttagcaaagactacctacatggttttgaagactttgctctgattgcttatgggagccaacatttgtcagaagaatcccaagcaaagggagatggggaatactatcacatcttctagacacagacactacgttcaggcagcgaggcacacggacagccaagtcagacatggatagaatcagaaagttcaagagtgctcagttcctagtttagggggcagcacattgaatggggcaaagaaaatggagccagcattgggcaggcctgtcagaaacaagtaacaggacctagaaaagcgcatggcagtaaaggcacccaccacagcccattcgaaatacagagaaatgtaatacattctaattttaaaagactagactttaatggaagcataaattcactctcagtcactcagcaaacatgtgatgtaaatactcccaacatgagttatttccaggtaccaacagttgaaaaatggactcacacaaattcctgaatatgtagcaatcagctcccctgagccagtgacagccagctcccgtacccagtgggtgggccgggcagctctgttttgtctgtgcctactttccactccagtactgatggcagcaaatcttccactatgttctcaacttttgttgttgttgttgttgttgcttatgttgttttgaaataagtcacactgaactcagaagtgagccctcttgtacagattatgagatggatccactgaaatgtatgcatccaatttcatattaatagtaagtgaaagttcaattaaaaaccattctgaaaatcttatttggtattcaaattagctaaagtaatgaaaactcacttttttttttttttacagccttttgctaacactcccaaggggaaaagagaaattgaaaatgccaagtgtatttcagtattactgctttttctccttctcagaacaccggagccggagcgatcgccgagagcaaagagcagctgcccccctttccattgcagctcctccactgccagcctaccctccagctcacagccagaggaggcgtgagtttaaggaccgtcactttttaacggtaagtttggtggccacctgcagccctatgcttgctgctgaggaaacatcagtttgtctgggagtcagtttcctgcctcccagtgagagaggctgggctggctaagagctcaaatcatgggcatttgggaacaaattaatttcccttcctttcattcctgaaagaaacgcctcttttttggaatacagacatattttttagttaactggtagcacaatgcagtaaagcaagaataattacagactaaaatcaggaaaaaaaatacatacttcaaacctcggttcttctgcttgcaagctgaaggattcaggataggttacttatgttctttgccctcagttccctcatctgtaatatagggatattaatagtacctggtttatagggctagaggattaaatgagataaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatcagcagccactacaaacacatcaccgcagatgtgccttctggggcctcagtggggacaactgagcactttgtgcctctgagcaggcatcattgaagtgagggactatggcttttgtgaccaaatcagcccacactgcctgtctgaatgtctgcattcctgctgtcttgtcattctggttcaagacccaaagtctaaagaagttacaatagtgtgggtacgagttaaggtttttattagaaattaaaattgcgtgtatgactctaaattgtgcactcttacggcttttacaatatgcaagagagatgcaaaatatttgggtcacatggtgccaaatatccagccaaaaacagactttatctaaatgaacccacatgatataacatccagataagaccttgagtgataatggacaaaatataaaaacatttttcctatttgtagctggactgcaggcaggtccttcagtgctcatcaagtgcacactgagcgccgtgttgcacttactacattgctgcactgcagcccaaggataagaaaaggagacaagggcctcttagggctttctagttcttcagatagagcagtttcacatgctagtgatttgtcataaagcagaagttcttaagcagctcaaatctgcttgctgaggcatttgcttttaatgaggcattttctgcataaaaatgctaaaatattttcccattcattataacatgttttatggctaattaagttggttttcttggaagggggaggtgaaagagaagaattttgagcatttacagaaattacataaaaatataaccctttctcatgatctgcataatttttaataatgtctaaatactaaagtaagactataggaaaaggcttaaaatgacgaatagcaacgagagtacatcatttacttacccaacaaacatcaataagagaagactatggattacacttaggtaaacttcagtaagtttgtccatcccaaatgataatacttagtatttctaagtaattttaactgttttatttgttcaagagtttgggtcactacaaggattagaagattttcatttgagttatatcccttaggcctggatagaacatagttcaagctcacaagactgtatattgctgaaagacaaatggctgcaggtatagagacaggaaatttgtagtcaaattgctggatagacacattttcttagacaactctcctttcatgtttgagatttggtgaaggcatgcttttcttcctttaagaaagcattcataatgagattgacatacagtcttctgcaactctgcaggctattgtactgtaccttggtcattaatggcatggaccatgaagctaaactgcctgactttgaataccagctctaccacttgcgagctgtatgaccctggcaagttagtcatttcagtgtcttggggatagaagtagatagtacctcatagccttggcatgagaattgaacgtggtaatacatgtaaacagtacctcatacataagcactacataaacatcagatgttattattattattagccaatcaattccctgaagtatctataatatggtgataagatcataggtccaaccgtgtttaaatcccagcactacaactttttggatgtgtgacttggaaaaagctattgtatctttctgactcccagtctctttatctgtaaaatggggataatatcaactttacaaggttgttaaggaggctaaatatgatgttttagaaataagattaaactatgtatatgtatttgtgcaagtgcctagcacagtgcctaaaatacctgaatgtgagtctatattcaaaatcgtttacaataaaattcttaccatcaaatgaaaagcctataacatatactcacatataagactagaggaagtataaattgttacactctttctagagggcaaaactctaaatattcataactttgatccagcaattttacatctaggaattcaccccaaggcaataatcagtgtatgcaaagatttattcactagggtgttcatcaaagcactgtttacaatgggaaagttaatcacaaatatcccaaatgtctaacaatagggacttagtttaatgaatactaatataactataggatagaatacaatatcaaaaatagtgttagagaagaatatttaatgacatgggaaaatgtatattttattatcagggatttttacatagtttataaatttgtgtatagtataatctcaaaaaatgtcaacgagtgtatatgtatgtgtacatatacatacgcatagggggaaaaggctggaaggttgtatatctgtgattcccaaactgtgtgctgaggtgccttagggcactgcagtgaactcctaagggtgccgtgggatattttaaaatttcaagggacaaagtgtcatctgtctggtggcatctggtgatggctccaaagtaacctcataactcctacaagtgagaagagaggatgcttggtttcttgacatttaatttgtaccaaaagttctccagggggaactcacaggaaacaggacaagccaatttagcataaaaccctaaaccctttgttagctgaaaattcaaggagtatctctaattaaagcccatctaagagtccttacttatcaagggtggcaaaggaggtcatttcagggaaaagcttccttaaaaaaaaaaaaaaagggggggggtatctattccatcctgctggattttgaaattctatagccagagattagtttaagatcatttatttgggacatgaagttactgtggacctgagctacagagaagagatcgaaacaaacgtcacgaaatcaacacttgcacatagcatctcaaccttttctttaatgcaccacagaaactacagctttaggctggtaaaggatctgaagagttatctgggcctagctaggaaccaaatgtaaaaagtttgtagtaaaaatgttcccaagggcaatatgaaagagaaattgcctgggatcaacttctgtccacatgaactcttggctgcagactgacttgttaagtgtcagaatactgattatttagggaaaggtagggagaggaaagggttcccggagaggtgtgtttgtgtactaaacaaaaacccagttactgaaagtcatttgcctccaggcagaatttctgggtaatttttctaccttgtctaggctgtggtcaaattgagaatggcaaatgtgtatcaaaacaggagcgtttgccagagctgtaacaggtagcctgttccctgcaaatccaaccatgtgttttcactcttggtactaaccattagaagtagtctacacagcctttctttggtaagaaacaatacttttatgtgctcaaaaactattagacttagacttacagtgctgatggctggaaagtagcctgtttgaggcaattgaatacataggttttttggtggatcgaaatatacactgagactcccaggtagctgactataatggtgataccctaggtccccatctcccattatttcctccaaaaatgatatagaacaagaagggaaaaataaaactacacagaaaaacacaccatcagcataacttgaggacagagaattcccaaacatcaaattgactgttaagtaaaagagagaaaacaccaagtctcagcatatttcctcctgttacaaggtgagggagggcagattcagaaagccacatggaagaaatgaactagcagtgggtcctaagattgatctaaaaccaccaccagaaaaattgtctgccctaagtctgaaaaatactacagattttttcagatagacacaaactacaaaaaagggcctaaaagtatgcatattttacaggagcagttttctctatataaagcttctgggggagacaaaagacaaacaggaagggaaatctgcccttcagcaattgggagtgaagaagaaaagaggcaaaaaggaaatttctaggaccctgcaagacaaaataaaaccaaaaaattcaaggacacgcaggagttgtatgtgtccttcaactcctgcctcaccaccaaaacaaacaaatacactaaaatatttgaacttcaacaaactgacagaagatggtgccattaaactagggatcttgtgaaacacaccaaagccacacaaatgagtaagagatagattagcagatccacatagagtgattgcaaaaggtcaatgaaagaatatatgaagcaagggttttatgtccaaccatgctgttcatcaagtatagaaaagcaattttcaacatacaggaacttagagaattttgcacccatgagtcctttatgaggcatctaccacaggacaagcttcatccaaccaagggataattggggaaatgtcagcaaaaggatgggtagcatacattttaatacatgtaaatgtagatctaaaactaaaagtacagtggagatgaagatagaaaactaaggtgcaattttaaatgttgtgacaacagagaatgatacaactaaaaatgagagaagggagaggtaaagaagaaaatagaataagctaattgatcactgtctaggcaataagtggctgttaaaggataccaataagaactagttaaccagatagtaaaggcttgaataataaaacagaggactaaggacattaaaatggtataagaaaaaagaagactactagcaaaaaaaaaaaaaatacaaatcttcctaaataccaaaaaattgttttatataaacagagaagacaacacatcttacagaggaagaaacataacaaatataacaaaatacacataattataacatttatcagagtttagtcatatcaatgaatatgagtgagcttaatttgcctatttaaaaacttttcaatttggctcacaaagcaaatccaactatatgctctatacattaaacacacacaagatttttatttattaattaggtcctgattatttgaaaaaacatgaccaagaaaaagagagagaaaacacaaataaaataagcaatgacaggaaaaaataccactgaaacaaaagaaattttaaaaattataagagactattttgcagacctctgtgcaaataaatttgaaaacctagatgaaatggataatttcctagaagagtaaaaattgccagaattggcgtcattagaattggtaagcttaaacagactgatttccatgggagaaccagaagaagttattaaggagccatgccactaaaaaacatcaggcctagatggtttcccagaggaattctactaaaccttcaaagtccagatgttcccaatgctctataaattgtttacaaacattgaaaatgaagcaaaacttccctattatttcttttatggagcaagtataacattgacacctgaactgataaagacagtcagaccaatatcactcatgattattgattcaaaaatactaaattcaacattagcaaacagaatataacatcatattatattaggagattaatatactgtgaccaatgggatttattctaggaatggaaggttggttcaatattaggaaatctattagtatcatatatcatattaacagatctaggaggggaaaacccatatggttagctccttggatactggctaagccttaaacaaaattcaatatctatttttaattagaaatgcccctaatgtttccatacatatgtatatatgtatgtatatatatctaatgttagagaaaaccccatttacagcaataacaaagaagaccaaatacttaggaattaatttaccagaaatgtgtaaaacttatatgagaaaaactttaaagcactccttaaagacacaacattagactttttcaaatagaaagacatcccctgttcttggatagaatgattcaacactacaaacaaatcagttctctctaagttacttaataagtttaacacaatttcaataaaaataccaataagctttattttatggagttagatacttatgggaaaacaaacatataagactagccaggaaaacactgaaaaaggaaacctagccctaccagacattaagatatagttaaagcctctataattacaatattgtggtattggcacatgaatagacagatatatcagtagaataaaacacaaagtccagaaagagaccagagtatatataaaaacattcaataaaggcaacatcacaaataactgaggcaagagatggagttttttaatgatgctggaacaactgcatagccatttggtgaaaggaaaaatttgatcagtgtttctcaacctcagcactgttgacattttgggccaaacaattttttgttgtggggaccatcttgtgcattgtgcaatgtttgccagcatccttagcccctcccctcacttgtgacaactcaaaatgtctccagacactgcactatgttccctgaggggataaaatcacctctagttaaaaatcatttaatgggatgcatactaccatacacaacagtaaactccaaatggatcagggacctaaacctaaaaaatgaaaccacacaagtactagaagaaaatatgcatgaactattctttgacctcagtccagggaaacactttctaactttggctaaaaatacagaggaaagaaaagaaaaaagaaaagattgatgcatttaaacagtaaacatttttgcatgcccaaacaccgtaaaggaaatcaaaagacaactgaaaaactgggagaagatatgtgcaacagaaaaagggctaatacctctaattgataaatacctcttaaaaactgagggataaagaaaagagcaaaaccttggaagaaaaattgaggaaaagatgtgaacagacaattcagaaaaaaatataggcatgtttcttcaactgaagaaaaattgttcaagctcactctcaattagaaatgcaggccagagcattatgcagcctgtaatcccagcattttgggaggctcaggtgggaggatcacttgagcccaggagtttgagaccagcctgggtaacatggtgaaaccccgtctctacaaaaaaatacaaaaattagctgggcctgatggtgcatgcctgtagtcccagctactcaggaggctgaggtgggaggatcacttgagcttggggaggttgaggctgcagtgagctgtgatcacaccactgcactccagcctgggtgacagaggagactgtctcaaaaaaaaaaaaagaaaagaaaaaaaagaaatgcaaacaacactgaaattccacatattacctatgagactggcaaaaattaaacaatgtaacaatgtattctgttagtgaaactggagaaacaagcactctcatacattgctggtggaaattcaaacgtggtccaacctaactgagggcaatttggcaatatctaaccaaactacatacgcacttaccttttgcttctgcaattctactacagatacacctccagtaatagaaaaaggttatttttttcagcattgctaacaattacaagatgttggaaacaacccaaatacctatacatagaagagtgatggagtaaaagaagcaggaagacctttatgaactgataaggagtgatttctaaggcatactcttaactgaaaaaggcaaagcccaaaaaagtgcctacagtatgctacccttcatgttagaaagaagggtatatagtcatatagcacataataatgtttctgtcaacaacagactgcatatagtctgctgggcccataaaattataatgtcatatttttgctgtaccttttctatgtttacctgtgtttagatatacaaatacttcacattgttttacaattacctactgtattcagtacagtaacatgccacacagatttgtagcctaggagcaataggctctaccatatagcctaggtatgtagtaggctgtaccttctaggtttgtgtaaatacactctaagatgtttgcacaagaaaattgcctgaggacgtatttctcagaatgtatcccagtcataagtgatctataactatataagaaaatatacaagtagccacttatttgcataaaagaaagagtccattctgctgtgacacaacatatgcatccctaaaaatctccacactgtacaaaattgcacaataaaaaacaaagggcttatggagaaaatgggagttaggggcacaacattcaaaaatttcttccaatgacaacacacacagacacacacacacacaaataggaacctaataaaatacaatagcacagttatacacattgtgaatggttaaaaaatacacaaatactgcaataaattggcacttcacccagaaaaagtcctgggggtgcctagggattgggcaacagaagggccacagcttgtgagttactgggaaggactggaaggaaggttacctgaaaccggagggaaggtcataacaccaggtgtgggcaggtgtggctcctaatatgtggagtgaactgaggtggctggtagatatttgatatgtgtgtgtgttatgtactcttatgcagctcagttcagctgtgtgcagttgctgtgttcatctagagagtctcaggttatgctcaaatgtgaatacctaagatatcttaggtattcaagtgatacctaaggtatcaatcacattggaacaatcaatcacattggaacaaatttgaatcaatatcagtcacattgatatcgatcacagtggaacaaacttgaattttcaaaacatgcgttataatgaaattgactgtacaggaaggaaaaaccagaaataaatgagatggatttccctacgggggatgagtgggagtggggtagaaagaatgggaggatgggatggtggtggcaggttcaagggggatggcatttctctgagtatattttttgggttatagctcaggtaatgttttatatatccccccataaataaataattatcatcaaccaggatgtgaggagaaccccaaatggaaaacaaacagcaccaaataaacctaactacattacaaatgaataacaaccaccctgaaagaggtggggaagaaaatagctaacctttaataactttggaaagcagtatttttgtttcattttaaccacaaatatttattgatagattaatgagtataattttaaatggaacagtaaggcataactgtggattaaaacaccttgcttcatgcctgtaatcccagcactttaggaggccaaggcaggcggatcacttgaggtcaggagtttgttcgagaccagcctggccaacacggtgaaaccccatcgctatgaaaaatacaaaattagccaggtgtggtggcaggtgcccattaatcccagctacttaggaggctgaggcaggagaatcgctggaacctgggaagcagaggttgcagtgagccgagattgcaccactgcactccagcctaggtgacagagtgagactgtctcaaaacgaaaacaaaaacatcttgctatacaaccaaaaggggaaagtcatacacttaggaattttaaatatgcaagtcaaagagcctttgaggtaccccacagatgactatcagataattcttcccttttatacaattcctatattacatcacttgatcacaaagttaaaattttactttaaaaggaatccctcattcattcacacttgagtcatcccacctggccactcccctgcttcccaccccttccccatccctttaaggtggtattctttagccattcccttcctgaataattgtgtgggtcaggcacggtggctcatacctgtaatcccaacactttgagaggctgaggctggtggatcacttgagctcaggagtttgagaccagcctgggcaacattgtgagacctctgtctataagaaaaataaaaaaagaaagaaagaaaggaaagaaaagaaaaaatagtcaggcatagtggcgcacacctgtagtcccagctactcgggaggctgaggtggaaggatcacttgagcccaggaggcaaaggctgcagtgagctgagatcctgccactgcactccagcctgggtgatagagcaaaactgtgtctcaaaaacataataaaaagaagaattgtgtgtccgttttccttcttaagcaaggaagcaagcaaacaagtaagcaatgagtcagagaaagtccaccaagggcagatttatgaatgaagagacttacacagacagatgttaggatgacagcaacctgattacttgattcagtgaagtctaaactaagctgactctagcaaagaagctgcactggcttgctcagaggcctatcattccacctcagattggccacaaatgcgagactccatgtttctaagggattaacagtggtctacatgagaagccaggaagccaatataaccaggcagctgatgctacaatacatttgatgctttagatctccattaggagctgactatagcttccagcataatcatttgccacatgtaaaatccttcaagatactgaggacaatctttaaatctcagataggatcaattaggaatttccttaacagtaatctatttgaaaatgtgaagtggaaagcattccagtgcacataacattgaggcataaaccatgctgcagaggtgtgaatgcaggaggctcaatagagtgcccagcctccttgttcaaaaagccatgagaaagcccccaggcatattgtcagagcagccattgtggtggcaatggtgtccccaaactaagcaaatcagcaggcatatggctattttctgaagaaccaacactgcactaacaagagtagccatgtagatatgtgtgtggagaatcacaggccagagagagagaatgacctgggcaagccacctagaacacttggttgtacacctcgtgcctttcaagaagagcatctccactaggtgcagtggcacgtgcctgcagtcccagctacttgggaggctgatgcaggaggatcgcttgagcccaggagttggaggctgcagtgagccatgatggcaccattgcactccagcctgggtgacagagtgagactctatctctaaaaaaaatttaaaaattaaaaaaaaatttttttttgagatggagtctcactctgtcacccaggctggatggagtgcagtggtgcgatctcaacttactgcaagctctgcctcccgggttcatgccattctcctgcctcagcctcccgagtagctgggattacagttacgcgccaccacgcctggctaattttttgtatttttagtagatggggtttcaccattttaaccaggctggtctcaatctcctgacctcgtgatccacccgcctcagcctcccaaaatgctgggattacaggcgtgagccgccacgcccggccaaaattttttaaaagaaaagcatctccatcaagcagacctttgatgactgactgggcagaatggaggggactaagagatggtcacattcttctgagagaagtgttggttcctgaaaagctcccagagagacaacatcccagaggcccatttatgagtgaacgtaaataaaaacttccagaccacagaactttcttgccaagtcagaaatatattcaataggcacagcttggggtgccacgtggaacagagggaatttggggggttaataaaaatcagggaggctaaaagaccaagtgcagttgctgcattcacacccctgttgggtgacagaagcaggaagcaaaggacatatggacaagattgaaggagcatgcggaagcctacagtctagtccagtgaaagagcttggcctggttccccctctcactttctcagactggatggatatgtggcgtcagcagcagaagagtggagataacatttagaaatggagaaccagtgaattcaggctgaagagaaatagactgggtgtactattctgtaatgccctgtttgcatcaaaggcaggcttgtgttgaccgagcacatctggagtcgtcatgcatcaatagtagcattttgggagacggggcatgatggggtagaggtggggctgttggacaggaggactctcaagttccagttgttaaatactaaagagcatggaacagtttagtctcagttcttcagtcaagaaatcagatgttcattttctgttctatgtccaccttctccaaaaacttaaaacatcctgtgaaagatattgcatcatccccatcccagttagcctcctggatggttctgtctgtgatgatgcccagtcgctcatctgagttattccctctgaccattatgcatagctcctgtaacagctcactgcaggagatgttgtctaacatctatccaaatcatataattaaaaaccaaagtgaagtttgctgcttcagctgtcaagtggttctggtccattcacatctttgctcctttcgtaatcatcaatgggtcagaaatgagccaaggttcttatgaatccacagaagttcagctggtcctccccatcttaaccaagtgaccaaagttaatatcaccagtaagagaacacacctgtacatggacctcctgatgtgatgcattgagataacacttctgtgagagacccttgtcaaaaaatatgttgcctcaatctaatcatgagaaaacatctgacaaaccccaattgaaggacattctataaaataattgaccagtactctttgaaaatgttaaggtcatgaaaaacaaagactcacgcctgtaatcccaacactttgggaggctgaagtgggaagattggctgagctcaggaatttgagaccagcctgggcaacatagcaagacctcactctacaaaaaaaaatttttttaattagccaggtgtggtggtgcatgcctgcggtcccacctacttaggaggtggaggtgggaggattgcttcagactgggaggtcgaggctacagtgagccatgattgcaccactgcacttccgcctggatgacagggcaagactgtctcaaaaacaaaacaaaacaaacaaaacaaattgaaggggattgaggaaatttgacaactgaatgcaatgtgcaatcctggattggatcctggttgaggaaaaaggcatcaatgggaaaactgacaaaatttaaataaggtcaatagattagttaatagtatttatcaatgctaatgacctggtttcaacagatatactatggctatgtaagcttttccattaggaaaagatgggtaatgagtaatgggaacactgtgctatttttacaacttttctttaagtctaaattatttcaaaatagaaacacacacacacacacacacacacacacacacacagttggcgccatggacatttcacagtttctgggttggcacttacaccgctagtgcttctgatggatatatgacttcaggtgaaggtgagttcacgcaagaaatgcttagtgcagagcttctttagtttatataacaaaatctagaagatcacagagaatctgatataaggtgattaaaagctgtcacggtattgagcactttggctccacgcacactgtcatagcatagattcccatttcagactatggagtcagttagccatagcagttcaccctcacccgctgctgaatggaatgttcagctcattggttctcatcagtcatgtctctcagtccaggcctggatctgcaaatacttgggacatgcacttgctcttctctttcgcaagcctaaggcagacattcctattcaattacagcactgttttccactgagtccacacagccactactcaccagggttagcacttgagttgaaacatctcctttttctgctttcaccctgcagtagagtccatgaggacccttgaagcccaagtccttgcttagattctgatatctggacagataggcaaggaggtcacccttccttaaatgtagtgggatgccagcagtctcaacaagttttcctctccaagcctcatcagaatgatcgaggggtgggatatctgatggtctctatggcagtggatgaagatacttggtatgagacggagcccctatggcaaaagttgatttggttccagaggaacactaagacctaaatcctcatcatcaggatcaacagtgaattcatttcaacatattgcctttacagttgtattgtttgccagacttgataaaattagccaggagcaaaatatcagggattctttgtcatttcacagcctgataatccagggattttaaaataaaagactgatgtcaaaacaaacctttctttttaccaaggatgtgtctttgaagggcaggggacattccaactgccttattgggaaagaaatgaaggaagtcactcaaactaggacccagaccatcttagtcttagtcatagttcagagctataaacaatgaccatgtttactctcccattttctatcaggaagaaaaaaacgggtcttatgagaaagcagcttctgagaaaaatcaaagtaacttacagaggagctagccaggagagaagatcaaagactagagctggcaggaagggtgtttcaatagtacttgaccaagagtacaagagtactataaagaccttctcactgccttgttttctttcccatccccagccccgtcttctcttgttcatcctcttccatccttccctttctctgtgggttcatttaagattttcagttttccattggtttacaatagagttgggattgagaaacgctgatcaagcctcgcctttgctatacaagagttagacatatccagacttgtcctagacaagtctattttacctttataaattgtcttcatagttttacaagctctctcagacgtattctgttgttttattaacttctgtctaaaatagttctgtccatccaaattaagtctttcttgctttggcttaggtgttctctgtatctcagataatttgctcctttaaaccagttaaggaaaatactaaccttgctatgcgaatctctgacatacaaattattctgtgatcccaaaccttcagctcctccattctgcccaaagaaataagttcaaatccttagcccaactctccagactttctacaattgggtcctaacttacctttcgagatagatttcccacaaatcctttgcacggaccatagacctcagccaacccaaactacacatgcttctccagaaaacctcctgtactctcgaaacaatatctccacttgaaatgccctttctcccattgtcttctcattgactccttcattttgaaaaaaattaactgaatgcctactattaataagtactagaaggatacaaacacgaatgagacataatctgtttcatccagagtacatggagactagaggcaattctattgtattgacttgaaggtgtgaatacctaactggtgtatggtgttggaatggggtggggtggcaggattaaacttcatgggaaacatagtatttgagaaggccttggaggatggggtagaattttgatatgaacactgggaggaaaaggattatagactgaggaaactatgagaggcaggagatggagtgtatacacatgagttcaaatactttgctttggctggtaagaaaaggggtgtgtcaatagagggcactggctataatgcttcagtaggccagatattgaaggatcttgaatgccagactagaaagtttgaatttatgccataagcctagcaaattattgaagggttttgggcacaaaaataacagtgacctgaaggagctatgctttatgacaatatcagggtatgtgtgtataggattaatttcctcaatctctagagattgctttttggtttagtagagagaggagcgtttgatgttagtgtcaggtataagattgcagaagtggtgatgcctatatacctcccatttaactcacctgtttggtctttggagaagagagatggatcttggagactggctataaatagctggtgactttagttgtatctgctgttcacatgtggtatttttcttgaagtaaatcagcacaacacctggcctatggaatgatacagctattgaccacaataaattcttttcccctctatacccattttcaaggctcaccagaagcagtttgcttttgagatcatgtcagctctcctctctgccataacataagctgcagagatcattgtcatcttgacaccccacatcacgctggttcatattgtcctgattggactcagaacaggaagcagcaaggaccttagataccttagtcaagagcaagccagagggtaaaagcctggttccatgtgctttatcagtcaggctccagtcaggaaaacagaaaccaagccagctattttcacaaagggaatttaacataggtacattattattacaagactgacagggcaaatgggaaactgaggtgacactgagatagtaacagcagcaagaagctaacattcccagggctggaggaatggaaggaaggggttggagttattggagcagcctgcggtactagaactcagacctctggagagtaaccgtggcctggctggtgctggtgcctcaggagctctggagctcagaagcttctgaggaactgggacccagacctccgagtatggggtgctgcctgccaggtgctaatgcatcagaagctccaaagaaggaccacacacagctggaatctagaaaggggtactggacggctgggtctgactagcatctctgacaggggccataatgaggctggttctgggagtgaggaaacagatgagggctgaaaccaattgccatagctgggggcaaaggaccactgctgggacaatgctaacagaaacagtgagtgccaagaagtaagtcccttcttcctcttccagccttctaatctccctcttgcgctcccactggaagaacctaacagggaggagctggcaagaaagaaatgtttgcaaagtcccagcagggcacagaataggttcagaactgagaaacaatagcttaatagccagcacaatagctaatgaaaacattagccaatgagtctggttcatattaaatactgtgagaaatagagaaaactccttagttttggaattctttctttctcttttaaatattggcctggctgtggaactgtcaataaaagtacttgtgtatacacatcattacagaatattctcaggttgacattctgttgcatgcctgagacttttttcactgttcaaaatataggcagacaatggaacaccactcacaataaaaaggaatgaattattgataaacacaacaacttggatggattgcaaaggcattattctgggtgaaagaaaccagtctcaaatggttacctagtgtataattccattcatataacattttcaaaaagacaaaaccatagagatggagaacagattagtggctgacaggggtaggggttgggggaggttgtgactataacagaataccacaggggagttttgggggagtaatagaacagttctatgtcctgattgtggtcatggttacaagagtctatacatgtgctaacattaatagatctgtactcaaaacaaataaaaaggggaaaacagtaaaggcagaatgtgcatggtttgtgtgtgaggtcttacattttttgctttttaaaaatttgcagtgatgaggtcaattatggctctgctgagctttagccacagctggcctgagttagcagtgcaaaggttcccttggagtgggcctgagtgtgtgacatttctgcagttaccacacgcctctgacttccccagctgagggccatggaggagtgctgctgtcacttctgggctgttctgttgactcacatttccagcttctctgatatgggtgagggtatttgcactgtttgtagcagttcaaagattctttcttccctgcacttcaaagcctggcctgccttttccttactcatgtcttttatttggttctagcaacctttgagggttgatggaactgagtggcccttggcagtggctccactaattggcaaagctgaccacaggggatgaataagatactggcatcaacatcacagtgatcatggtccagtgggccctgttttgtgttcttgacagtacagagcaattcctgggaataaatgactgtgctgaccagccagcaggaagcattctccatcctgggctccctatagccctcttttccattcatgtggggactattttccacaaatgttccaaaacataattggttatgctttgcacatttaaaatgcttcattaataggatgtgattaaacaaagtgttcttgaactttaaaatatataaaattattttgcattccattaccctaagaatttttgttccattccagctgagatcaaaaggagagagagagatgctttgcagtcacacattctctttcagaaagcctctttttgggtgaaaactgcaccattgtcatcgccattcaagctttgctcactagggacagttgtcacaccccaaacatctaccaacaggataggatttaaaagtgaatgagcatgtactcttttggtgtcttggctgcttatgctacatatacttttttgagattgatgttattgtgtagttttccattgtatgaatataagattgcacaatctgtttatccattctgctgttgggagatagtcaggttgtttctagttgtggggtattgtttgtttgttgacttttatgaataaagctgctataaactttataagtattttataagtatttttgtgcaagttttttgtggacatattcatttttcttaagtctatatacctgagatggaattaaagggtatacatatgtttaagattagatactgccaaatagtctccaaagctacaccattttacactcccaccagcatttatgagcattccagtcactctacatctttatcaacattaagtgttattaatctttttcatcttagcccctctagtccacagtgtggtttccttttgaattttcctgacgagtaatgatgtcaagcaccttaatatatgcttattggccttttgtgtgtgtgtatatatatatatatatatatatatatatatatatatacacacacacacacacacacatatatatatgtaaggtcttattcttgttttcaaatgtaacacatttgtatacacacacacacacacacacacacacacacacatatatatatatatatatattgcaaagtgcccctcaggagaatcaagaaagtggtgatagctatatctctcagggaaaggaagtaaaggtatgatttggaaaagcagacttatcaataagaggatattccccaggcctgaataacaatgcttttttgtgttttaaataaatattaatgtatatggtggttaaagaaataactcagtaggcacctgttcccaaatatccctctccacaaccattacccagaacttcgccacggtgattggaataaatcactgtggattgggtttttcatgatttgttgtcagcaccctaataagggtgcattttgggcttctttctaaccttgaagctggctgaaaggttagcgtgaagggtttaggcacttggggttaaggatggcatgccaggtgggagtgctgcattcaggtactttgggtaagcatgaaggctctgactgctgaggagagagtggtgacaaaggtcaaacccagaaagggaagaagccttaaaacagagaaagcataggatgtgccttaaacttctgcctacctcttcattgtgtttacccatgattgttcaccttgatgaatgtcggagttgaggagaggggaagagggaagcacagggtgaatgtagaatgatgttactaaacatgttgggaagacaagagcacaatgccaacctttgggagattttgagacagtctcaagggaataaaaaagtactacataattgtagcaacaagaatgacatgtgaagaaggcattgtcaggcttcttgaagcctttgagaaagatcaaaggagttcatatttatatatgatacatccacaaacactcctgcacaggaaaagctgaggccaataggacacagtatgtgcacaaatgcaaggatttggtttaaggacaaacgagccccatggtagagtgaaaataaaagcccatatcacctcactagaaacccagtgtggtttgcaatggacatctttgctgtaaggtcttattcttgttttcaaatgtaacacagcatccagcctccagtaaatatttttcatgtttaagacagcatgatagcaataaatcagctctgaaagtcaactgctataagtgccatgtggtatcagttagatcacaaaccaaagccaatttttcaaaacatttcctgctggaatacccacaacattttaacagatgtattttgggctgtttcgaaagaaaataagcccccatcagcatataaaatataactcaaaagaaagtaaaatatggagtggagggattattttttcttttggtagtaagagaaagattggggatcatcttgaaacccttggggaagtgcttgttcatagccacgaaaggggagaaattaacttttctcacacacatacctcaagaaagactggagtttgaaaaatcttccttcattatataccaaagacatttatttggctgcttttgagcataatgtttgttatttcttattctgaacactggtcataagtataattctggcttttgttgaagcaactcatgggaagctagggaaaggatttgaggatatgactgatgaggccagcagggacagagatgaagtgaaggcatcaaaagaatcatcttttgtcagggacaagatgggcatggctggtagttgctgattataaaatgctgcaagttggagtctgaagcttttcaaaatcagtggtagaagggccagaataggagtctggaaaaggaggaggaaattactcttttttttttttttgtatttttcttcaacagtatattatgaaaaatctcaaaggtacagagaagttgaaagacttgtacagtgaatatgcatatatatacccatgagggagaaattatttttaaactgacggtttgtttccactggggccaattttgatccacatcaaataaatgatcttgaatgaatgaatgaatgcctaacacacctcctaccacacttattctggggaaaccaaagttgttcactgccactcttgtactgagtgatgattccacaatcaggagtcccctgtggatctgcttccattatctgttgttttggatgcttcctgctcatgctgtcttatctcctcctgtgctttgctgtctttgaccttgtactggatgttgtactgaaaaattatatgtgggtggcaataatttgatgttatttctctagaagagaatttttgtttgcttatgccaggcacgtgagcatgttagctgtacaacacatatttattgagcgctattgaggcagtaaaaatagagttatgaacaagaaatggttagtctttctctgaataagcaacgagattcatttaaacagttgtggaagaataatttagttcatataagtttgatcagcatccagctttccctaaccttatccatcagcacccattaaggcgtggcaggctgagccatgcagagatgccctgaggtagcagttctcttgcagttgtatttcttagataatttagaaaaaatatatactgtgaactgattattgcattcattatataaaagtgtaatcagaaatactcagaacaatcttacttcttttgactaaacatccaggaaagaggatgctttattttatttttaaggtttttaaaaaaatatttcaatggtttttagatacaggtggtttttgattacatgagtgagttctttagtggtgaattctgaaattttagtgcacccattcacccaagcagtgtacactgttacccaatatatagtctttcatccctgaccttgctcccaaagtcccctgccccaagtccccaaactccattatatcactctgtatgtttttgcatcttcatagcttagctcccacttataaattagaacatatggtgtttggttttccattcctgagttacttcacttagaataatggcctccagttccatccaagttgctgcaaaggacattatttcattccgtttaatggctgagtagtattccatggtgtatatttaacacattttctttatccaatcgttggttgatgagcatttaggttggttccatatttttgcaattgcaaattgtgctgctataagcatgcatgtgcaagtgtctttttcatacatgacttcgtttcctttggatagatacctggtagtgggattgctagatcaaatgatagttctacttttagttgttttcaaattttatttaacttttattttaagttcagggttacatgtgcaggtttgttatatgggtaaacttgtgtcatgggggtttgttgtacagattattttgtcacccaggtatgaagtctagtacccattagttatttttcctaatcttctccctcttcccccctctaccctcccatagaacccagtgtgtgttgttcccctctatgcggagggccctctaaaatactagactaaggcagttactaattaatggcagaaatataactgtatatttatatacttatagctcattttaatattataaacttaaatactctgaatctgcagaccatctgcagggactctagagcttgtgtctaagtggaggaaccaaagaacacaatccctccacatccaagctccagagtacctagtttcaaccctcacaagctggaggttggagctactatcaatatagtggagagaccaattagctgaggaggaatctgctatggagtgtaacccaaggagaccttaactctccatcacaatgaccacaactgaaaagtctgtgctttctctgaacttgccatccttagtcattgtcaggtgtgacctcatgcttatttaatggggtgggtgggtttctcaaacagatgaaaaatgaagtccactcctcacccctcactactggaaaaaatattcaacaggagagctgacttaggagatttaagacaaactaccataatttatgtattaacattaatatcattctgcagtttctgacggtgtgattttttgaaaatactttcatgagacaccaaagcttttggtttctttgaagtaggttcctttcccatgtaggctttgctatcaggctaccttttttcctacttaacatgagttttctctctcatttacacaccctggtttcttacttgagacttccacatcattgtctgtggctgatttttaggagagaaccaggttagtgtctgaactcggaccacatatatcacatctgtcaaaatggtcactttcagcaagggagccatagaccctacaaaatcattagtcttaaataagatctagatcaaaattaactgggcccgaggaggagacatttgctttgcttaaacattaatgagcaactctttcagttaaaacttagaaaaatagaacagaattagacaccaagctttccccacaaaaacgcatgtctgccataggcttaagaataactaggcccagcatccatccttgcttccatcagaggaagcaaggatcactggcagtttcctctacttgtttccacctgtttgcatgaagatggtaagtcccttggattctgaggaatttacttcctcctgagatcttgagcattccccttactctttttttttttttttttccctccgagacagagtcttgctctgtcacccaggctggagtgcagtggtgcaatctcggctcactgcaacctctgcctcccaggttcaagcaattctcctgcctcagcctcccgagtagctgggattacaggcatgcgccaccacgcctggctaattttgtatttttagtagagataaggttccaccatattggccaggctagtctcgaactcctgacctcaagtgatccgcctgccttgggctcccaaagtgctggaattacaggcatgggccactgtgcctggctgccccttactttctttggggttcccatcactgctaaaacacacagagacaatatcattcaggtgcacaaatattttgatgagttcttacagtgatgcatcatggaagactgaaaggcaaatcaaatgtggcctctgacctccaggaatttgcaatctaacaaatgaaatagacacatccagggccaattcctgttccattaaagccatgctgtaggataagtgctataatagaggcccagctgaatctaaagctgatatggcttagagttttaaaagtttcagtggccttctcagtagatcctgaagaggggattctggttaccagattattctccagataggactggctatataatttctggggtccagtgaaaagtgaaaatgaagaatcctttattcaagaatttcaaaacagtgacagcacaacctgaaaccaagtatgggggccttctgagtgcagggccctatgggactgctacacagatcacacactcatgaaattggccctgtctccaaatgtggtctatgaataggagaaagaagtaaattttgagcagtctagagaaggaaattacacatagagaattttcttccaagtagttcacaaataaataaataaataaaatcactccaacgaaagcaaataattcaatcttctccaaattagcaagtggtgttggaatctaaaacataacaaagttacagtttgcaaagacattttcacagatatttcacagctacaaggtaagtacattaataataataattgttgtagtagtagctggcactaatgtacagcatttattaagtgccacgattcttctaagtctattacatatactttactcatttaatcctcaaaacagccctggagggaaaattctattatttctctatcttactacagatgaggaaactgaccttggggaggttgaggaattgcccctggccacacagaaaataagtggtggaggcaggatttgaattcagacagtctagcttcagagtctgtgctcttaaccactatttatgctacctctgaaaaaataaagataggaaggaaaggaaggagggagggagggtggtgggagggaggaaaggaagaaaggaagagagggaagaagaaggaaggaagggaaggaaaaaggaaggagagaaggaagaaaggaaggaaggagagaaggaagaaaggaaagaaggagagaaggaagaaaggaaggaagggagggaaggaaaaaggaagaagggaaggaagggagggaaggaaaaaaggaaggagggaaggaagaaaggaaggaaggagggaaagaagaaacggagggaggaaagaaagaaggaaggaagaaattaggaaggagggaaggaaaaaaggaaggaagaaggaaggaagggaagtaggaaaggaagaaggaaagcaaaaaggaagaaggaagggagggaggcaaggagggagagagggaaggaagaaggaaggaaagagggagggaagaaggaagaaaggaaagaaggaaggaaggagggaaagaaggaaggaagggggaaggagggaaggtaggaagggaaagaagaaaggaaggagggaaggaagaaaggaaggtaggaaagaaggaaggaggaagtaaggaaggaaagaaggaagaggaaaggaaggaagaaaggaaggaaagaggaaggaaggaagaaggagggaaggaaggagggaaggaagaaaggatggagggaaggaagaaggaatggaagaagaaaggaaggaagaaaaaaggaaagaaggagggagggaaggaaggaagggaaggaagaagggaggaaggaaggagggaagaaaaggaaagagggaaggaaggaaagaaggaagaaataaggagaagaaaggaaggaataataaggagaaggaaggaataatgagaaggaaggaggaagggaaagaaggaatgaaggaggaaggagggaaggaaggaaggaaggaagttatcccagtatattattttattaatatcatagatttggcctaaccagtatacactgtgttgtgtgcacgtttttaattttttctttttttgcatttcatgttcatagtttaacagcacccgttcgccctcccccactgaatgttgccacatgaccccgtggagtagaaaggtattggttctgagaacattccttcacggccctatcccactctgtccagacactcttccttttttccctcttttaactttatggaaaactttcttgtttctaactaacggtttttctttaaaatcaatttaaaaagtggtattttcctaacttgaattaaatagaatataacttagacagtcatgccatttgcctttttcccccattcactgccccccactctgcaaactgcatcacctaacactactcttggactttgtagtctggcagaggaaccttttcctatatttaatttatcagaactgtaaatgttcagcttctcaaatcaaaaaggagaacaagacaaaaggattctctggcagccaatcgtcctgtcaccattaaataaaaagtgcttttggctgctggtcagagcttgtagtcaggtcactatcctgtcgacactttgcagtccattgttattcaaggaaggaatcgcctacaaaatgaagcctctggtggtggggggtttctctttattgctcattctctctctttgtctccctctttctctctctctctctcaatcagtttctctctctctctctctctgtatgcaccaaactttttttctttttggaagttacctaggaaacaaagtcttttgttctcgaactttatttgagctattcgcttcgctgggaatctgcacaaaagctgaagagagaaagaaggttgcaatattttactaaaacgttcatgacgaacatatttttcccaaggggggagtcatatcctgttgggtgtgttggggggatttgcagaaacctctgacaaggtaagtaaatgctgggggtgagtttagacaagtggcattggaatcagctctttaaggggacttgagaacagttcatttgacaataggtgaaatcctctgagtcaacagggcatgatatttccaaatgtaaagatgggaaaattttttttgatgatcctaattttagggcagaatattattaaagtcttactgggataacagcaaaagatatttattttatacagatacccaccttcctccaaattgtgtaaaaaataaataaaactaggttgagtggtgaaaactgagtcttttaatcatctagtttagaaacccaaccctgaaatcaaaactgggatggagctttttaaataatctgggctaggagcccaaccctgaaataaaagttagacaatattgatatttatcaaaagtttggatggagaattttccaatgtcatgtagaaatcaaagcccctaactatacagctggaggaaaagtctcgcaccacaaagctgaaaagaaagtaaactaggactctttcacctttcctaatttgaaaaataaactcactggaatatttccccccagtaacagcatgtgtattttccgctatcgttggtagggggaaattcttcacttttgcttttccatgtgcatacaagtgttcatgaaactgaatttttaaaatgttattaaaaaatgccgtagtcctggagtgaaattaactcctcatgttttaatgtggcttctcagattaggttggcttgtccttcaggtgatgggttctggaatgtctcctgactccaggttttctgaaccttttcataggtgtctaactcatcttcttcctttgatcctagtcatctagagatctcaaaacttttgatagaaatttatggtgagatagcttgaaagtggatctgtctttcattggagtaaagactcaattttctttggtgtaaagtttggggatttctggctaccttgtctctcctgttaattccatttaacctgagaagcatgtttatttagcccatttctttccttttgtgttgcttgactattgaaataatacttgtaattagttgtgcttactaactatttctaggaattcttcctttgtcctaagggcctatttctgacctcattttttcttctctaaactaggaaattccttatatgtgtgcttatgtataaactatgatggctgaacctgattgtactttgtttgcagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggtatcgttctggttttttcttaggggcagtcgggtcagaatattctgtgtattaaatatgttcaaaatctgtgctgctaagaataccattttgtaaacaagtaatgcctttttgtcatcaaaatacaaacccagaggatgttcgatatgcttttgtcaggttttgaacatcaatttacatgttttccgcgggccacttgttatgtaaattatggacagtttctttttgaaaaaaatcaccaaatagctctttggccatagctgactgaaataatggagaaagcggcagtgattaatcatatgataatgatgtgtggcactgcaagaaagaaaacagcaaacccaggcttctcaaactgcaagtaatggtcctgtaggccaactagaaaatctgttttcatgcttccttggatgaaggtaggctttttaaaaaagactgttaagacttctgtattgatttgggggatttttgacctaaaaatatatggatacagagatgaaggctgaattctattttaaaaccagcaaggctgtcttcctttcactctctttttttctcctcctgtgtactgagagtgtgaatattagtctagatagaatggaagcatagccagacctttctgaaaaatttattggcagcagttataaattccacaattggatctagtaatcttagtcgtaagtaaaataatgttataaaatattctaactttcaaagacataaatggtctatccattgggctttcttacatctctaatagttacattttaacttatttgtatattgaaaatttcaaaacagccatgttatgactgattttcatattggtaccatgtgactaaagattgcatgtcacttgagatgcatgttgcacacagctatcattaaccccactcagatttctctcaaataaagtggggaagcaaatggaccagatatctgggacagatattatttttttcctgagaaaaaaggagtcctagttcatgggtctgtggtgagttgggagttaattttcctgatgacctattcaacttgtaagataaattattctaaagatgtgcccctatctgatctccacaatctaaatgggatgtattaggggagttcagctgccaaaatggatcattttggcaccctcttaagctaattttcatttctggaaacctctgattattagcagcacgtgcttttttcatggcactgtaagtaaaatctcattttcaaatttagtgctatgattatgggccattattttatgattgagggaaagggacactttttccttctgctttatttcaggaactctctgattaaaacttagatcagatgttgatttcaagagctttaatgagaacattgttaatgatgtccacataacacaaaatgtctgcgtctatatataatgcattctataattactaagatcagaatgaaggattttaattttgggttggaactaagaaaaattccattagtaagaattctccaataatattgtaattattcatcatatgatatctcatacagatttttcaaagtgagttctagaaactgttggcactgtgacgttaaacagaactcaactctttcattatacagctgaaccaagacttgacacaccacccagccccatgcttaacaatcaggataaatgatgaggtgaccaaattccaaagcacggcattgtgactttctgaggcaaagctcactttgaaaaatccatggtgcagacaagagtttgagttcctcacctcccctctcatcattctagttgtgatgggactgcatgtaatgttgataatgtgattatggagagagaaactaacaagcaccatggtttgccctctgtgtttacaaaaacaaacctatgggataaagactggcaattccagctttacagttggtatagaaggtggatccatttaagtgcagaactggggactgccttgtatgtttattttatattgaaaagacatctcatgctaaaccagaaagcattcagtttagtaaatagaagaaagtagacagagttgggtgatgatttaaaaaaacaaatccttagactgttgagtttcctcacagcaaaagaggtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaaggtatcagcttcagagagcccagaaatagatcagtaaatagtagtaactaaaggttataaatccttaaggagccatttctatgtgagagggattttttggatgtctttttctcttctctttcttttgatttttcttctttgcttgtttttgttggcagtgcaaactgttgtggagagctgcatttagaagtaaagcttaatgtactgcagcataatttaaataagagctgaataacagctcccttatatttgttcacaggcttaacccaaactctttccttacttcccgtcaaaaatatcactgtgttccaagtaaatgaaaatttgtttgccatttctaaagctaatgagacctatttgtgggttgcaggagttggctttgacagagaggctagtatacgctgctctctggttcattcacaatcggtactacagcggagacgaaaattgaggaggaggaaaaccatctcgggtatccccagaagagttcaacaagaaataggtgtgatatcaaaaaatgttaatggttaacattcctccgcctagtacagatgatagggagatgaaatagaaaaatgattaaacattttaacttgtagaggttttaaaatggtgtctatttgttttgtattcagcaagccaggtggtattactttttaactctttattcttgactgtgaagatttgaccttatagatttaggcatatacattcaggtcttacggctgaaatgtaatacttagctgatttttgaaagttttattaaggtagaaattgtgaataaaaagtagcaggagtcaatgaaagttttctttttggaaaattgtaacttaatttaagagagatatactttcatgtcattaattattttaaaaggtaaattccaggcatatgcaatgaaatattgaatattgataatatgatacctttggtgacaatgtttctgtttagtggatttaaaatatctctgcctatgatttttaaaaaattattagggtatcatctcttgcaaataagatttttatttctaataatgagacctatgatttttatttcatcatgtttatattacaaaataaaaatgaagagtagtggccaaaaagataaaatgtactttagtttttaaaagtagtcacttattgtggcaaattaacgtgatagtgaagagagggataattcacaaaagacataaaagcatatcttctcttggtatgtatatatacatatatgagggggacgtgtatatacaccctaaagcattttaactctcacctaattctatatattgattttttttctgttaaagaaaaaaaaaaacagctctaacctgccagcccacagatctacagacatagctcagaatgtctgttggtctgctgatatagaaaatatctcactgtgctttccatgtgccctagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaaggtcagtcactgataactttgtcataaaggaaatgtgtctcatggcacttcctggaattttttcttatgttcccaataatacggtacagccctgggtgttggtttccctccactatttctttgcacttattaaaacaattgagataaaagcttttgttactgggtgagtaagctttgacaggtatctctctcatttttaaaaaatggcagcaaggtaatttctgtttgtttgtttgtttgtttgtttgttccctgagtcagtgaagtacagtagcgtgctgggtaacttcctcttaaagattcttctgttcttattttaagaatcatcaccgagtgatgactccatcatttcaccacttagtgaagactcccaagctgaagcagagggtgtgttcgtgtctccaaacaaacctcgaacaactgaggatttatttgcagtcattcacaggtgaggcaacattaccaagtcccccaaaacaaaaggtacaacaaaggttttgccccttcaggtacttctcacaaatgcaaatacaggaaagctttttgtaattgtaatacattcagcaaaaacaaaagcaagcaaagaataatttttccaaatcaagttgatagactgatatgcaagttgggaaataggatctttatatagagtttgatagacctcgattgagagacttttgtaagagtggctttatttttccccaggaaaagacattctggaacaagtttttatgtgaaaacaatctgtggttaagtgacttggagtgaaagctcaaactctagtgtaatctctgacttttgaatactttcttgaacctaaaaaatatgatcaaagctgtagtcatacaccagcagagacaaacagaagttgattcaccatggatgcaccaaaatctcagaaatcaccactaaagaacttattcatgtaaccaaataccacctcttcccccaaaacttattgaaataaaaaataaaaaactcacattgtaccctataactatatacaattatttgtcagcttaaaataaaataaaacttagagaacacacacacacacaaagttgatcacaaaacagtctcaagtttgagaaaagacaatacgtgttcctgtccattttatagctcagaacaagtaataatttctctgtttttctttcttcttagaacttaaatttctttaatagtactggccttcatccccaaaattaatgcccatattccatgaatacaggtcttttgggttgcttttccaggacagtgttgtgtccatgctgcaaaggcatatttcctcatctgcccccatgagcccttgtgatccatggtccatatttgcaaaaattattccttatagctaatgaccaaagaacagaacaggaactagcccttggacacctaatctacatataactgagctagccaatcatgatttgccatgcctcctcctttcacaaacacaactgtcttcttagacctcgggaacctagatggaactcccaagagatacaacttggggattgtcttttctacctcataaagttatcatttttgaaacaaattcatcgtaagcagcttacaatctttttctcctggaattctactttttataggaatttctgttttctgttgatgtggttctctcataaagaaggagtactgctgttcaacaattgttttaaaaggagccaatcagaaacaccttctatgtataccttagcaggcatacttctctactcagagggtgaagaaccattagtttcttttccttcacccctgtgcctagtctaagctctgattatatttccctcacccccacagtttatcttcaatcccaggaaaaattactaaactgctatgtaagttaaaaagttactcccaaaggaccaaatgctagtgtatggaatagtggacaggacgtaaatagtggggtcagaaagacctggatttgaatcccaactctgccacttcctatgcagtcttgagtaagttaaaacctctggacctactcccttattgcacatgggaatgcctatagctcacgtatttgattttgatgataacattttttgtgtttagaatatggtaggtgctaaaagccattgttagtttgaaagccctaacttagtggagtgccagacactgccatatacaagatatcaaccacagaggtttctgtgaaccaaaatcaagcatatctacacttgtgaagttcacattttctctaccatatgaatctttaagttgatgaaagtgcatgctgcctatcaatgaactgagtcatactgaagatccaccaaatttatgcctgctgatttaccaaagaaaatcaataatatgatgatgggagtcaaggttcaatagatgtattgagtttggtaatcttagacttgcatttgtgcagggtttacttatttatctatttacttgtttatttacatcacagcaaaaagaattattttgttttcttgcgagcttacagtatacaaagctttaagagctccagagatggtctgggatttcaattccccacagagagctggcttactgcttaatatgctcttgatgctcttaggaagctataggaaatgatacttgcagcccaagatgaattgacttaaaacgtcatttaattatgtttttatatggagggattttaaaaggtagaatagtataatgtctgctgacatatccatcatccaggattatcaactgtcaaactagggccaatcctgtcccacccacacctccatccacttgctttctctggtattatttggaagccaatcccagacatcagatcatttcatctgtattgcagagacagagttaataagaaaaagttatagtctttcaccccctggaaccagaagtatagtttagttagcagtatagtttcttccttttttttttttttttttttttttttttgaggcagagtcttgctctgtcgcccaggctgctggagtgcaatggcgtgatctcagctcactgcaacctccgcctcccgggttcaagtgattctcctgcctcagcttcctgagtagctgggactacaggcatgctccatcatgcccggctaatttttgtatttttagtagagacggggtttcaccatgttggccaggatggtctcgaactcctgacctcaagtgatctgcctatctcggcctaccaaagtgctgggattacaggtgtgagccactgcgcctggctgttagcagtatagtttcttaaacttttacaaagtatcctctagaacctctagcctccacattagccattatctgaaatgatcatctctagaacctaatttgtgtcctggttatcagagaatttctctcagactgtgggtgctacaaggacaaggaacatatcttacttttcatctctatagccctaatgcttagtatcccatcatataggacaggctcaaaatgcactttagacagatgtgtgaatgcgactgaatacttcagtttcataaaaacgtgaactgagtgagatgtttgccccattttctccttttctcaaagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaatt

SEQ ID NO: 37614 - DNA, 5950 bp, Homo sapiens
ggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtggggacgcgggcgcggccgctccggggactaggggacgggaaccgagtggccgggtcgggcggggacgtgggcagcagagccttgcaggcgggcgccggaagtggaaggccgcgatcgctttgtccacgcgccgccggcttccgggggccgcgtcacgtgaccgctgctgcagggcgtggcgacgtccacgcgtgcgcactgggcccggcgggcggggggaaatgcggcacggattggagggcgcatgcgcgctgagcagggcccatggacggaccctgcggctggcgggccttgaccttgagctcaatcctgcgggtcccccggctgggaccaacccttccggtggatgcctggcaggtgtctgctcttgctccctccaccgtgaagggtaattctaaggccaatagggcaacgagcctgcccgcaggtgtcctggaataaccaggatatggttattggtggttcttacccccttcttagctcatttgtgcaattctgatccagagcaatgcattttttgtcttttgggagaggcttatagaaagtagcatgatgcctaggaacattgccgccaggacgtccttgctaacgttgtactccgagtgacagctcggtgatgggaatgaataggcttggctgcaaggacaggtcacgcccgcgatcccagcgcttttgagaggcccggggagtattgcttgaggccaggagtttgagagcagccggggccacacagcaagacctcacctcaaaaaaaattattttaacttaacgaagcaggacgtcccagtgcattgagaggcccggagaggatcgcgtgagctcaggagtttgagaccagcctgggcaacagagcaagaccgcatctctaagataattttttaaacctagtacagggtggcgtgtcccgggagtttgagaccagccaggacaacatagcaagaccccatctctaagaaaatttttaaaacttagcaggcggggtgtccccgcactttgagaggcccagggaggatcgcctgagctcaggagtttgagaccagccagggcaacatagcaagaccccgtctctaagaaaaagttttaaacttagcagggcggggtgtcccagcactcggagaggcccagggaggatcgtttgagcccaggagtttgagaccagccagggcaacgtagcaagaccccgtctctaagaaaattttttaaacttagcagggcggggtgtcccagcacttggagaggcccagggaggatcgtttgagaccagccagagtaacatagcaagaccccacatcttaaaaaaacctttttttttttttttgagatggagtctctccctgtcgcccaggctggagtgcagtggcacgatctcggctcactgtagcctccgcctcctgggttcacgccattctgcctcagcctccctagcaggcacctgccaccacaccttgctaatgttctgtatttttagtagagacagggtttcaccgtgttaggatgctcttgatctcctgacgtcgtgatccacccacctcagcctcccaaagtgctgagattacaggcatgagccactgtgcccggcttaaaaaatttttttaaacttagcagggcgggatgtcccagcgcttcaagaggcccagggaggatcacctgagctcaggagtttgagagcagcttggtcatcgtagcaagactccatctctaaaagtaatttttcaacttagtggagcttgatggttgtgcatctgtagacccgggtactcgggagactgaggcgggaggatggcttaatccaggagttggaggctgcagtgaggtgagatcgcaccactacactcaaacccgggtaacagcatgagaccttgtctttttaaaaaaagaaagagccgggtgcggtggctcacgaggtcagcagatcgagaccatcctgactaacatggtggaacgctcgtctctactaaataagcaaaaaaattagccgggcgtggtggtgggcgcctatagtcccagctactcgggaggctgagacaggagaatcacttgatcaccccattgcactccagcttgggcaacaagagtgacttgtgtcaaaaaaaggatgcaccctgtagctgggatgtttctgggtggttggccctgggtctggtctgaacaccctctgcgtcccccaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggtacgtgtggctgccatcgcgaagtcccagagacgggctcaacacacagacgttcccccagggtcctgtgggctgaaggtctgagataaggtgtgggcagggctggttcctcctgcggcctctctcctggacttggagacgccgtcttctccctgtgccctcacagcatcatccctctgtgtgtgtctgtgtcctcatcctctcttcttatgggatgtcttaatccatttcaggctgctatcacagaataccatagactgggtgactataaacaacagacattgattttcctacagtcctggaggctggaggtctgagatccaggtgtgggcagggctggttcctcctgcggcctctctcctaggcttgtagatgccgtcttctccctgtgccctcacggggtcgtccctctgtgtgtgtctgtgtcctcatctcctcttgttatgagatgtcttaatccatttcaggctgctatcacagaataccatagactgggtggattgtaaacagcagacattgattctcccacagtcctgcaggctgaaggtctgagaccaaggcatgggcagggctggttcctcctgaggcctctctcctgggcttggagatgctgtcttctcaggctttttcctgtgtgtgtgtctgtgtcctcatctcttgttatgagatgtcttagtccatttcaggctgccatcccagaacaccatagactgggtgacttagaaacaacagacattgattctcccacagtcctggaggctggaagtctgagatccaggtgtgggcagggctggttcctcctgaggcctctctcctgggcttggagactccgtcttccctgtgtcctcacagggtcgtccctctgtgtgtgtctgtgtcctcgtgtcctcttctgatgagatgtcttagtccatttgaggctgctatcacagaataccatagagtgggtggactgtaaacaacagacattgattcttccataatcctggagtctggaagtctgagatcaaggtgtggggcagggctggttcctcctgaggcctctctcctgggcttgtagacgccgtcttctccctgtgtcctcacagggtcatccctctgtgtgtgtctgtgtccttatctgctcttcttatgaggtgtcttagtccatttcaggctcctaaaacaatactatagactgggtggcttataaacagcagacattgattctcccggagtcctggaggctggaagtctgacatcaaggagtgggcagggctggttccttctgaggcctctctttttggcttgtagacaccgtcttctccctgtgtcctcacagggtcatccctccgtgtgtctgtgtcctcatctctttttagaaggacactggggtcgtaggatcagggcccaccctactggcctcctttagtcttacctctttcaagaccttatatccaagtacagttgcatcctgaggtcctggggtgggggtgggacttcagcatgtggattttgaggacagagtgtaactcccatagtaacggtgacccttcagaaggtcagggccctattcccttccccaaacaggcctaaccccggcctctgggactgtcttgctgggctccggtaggtggcaggcggccttttcccctctggccctgccccgacctctcgtgttgtaaacgtcagctggcactgagcagccacgtggagggggcactggtggtctcggaagagctcggcaccacctcagggggccgtgagcacaccctgggggccgaccctggtctcgggtggccgtgcaggcgctggagacggtgacgtgccgttcccgcgcaggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggaggtactcgggggggcgggggacccttgctgccgggaaggggaaccaagctccttgccctaggcccgtgggaggtcaggaaccatcaaaggaggcacttccagggcgtgtgagacaagcaagtgtgtccgaaagtaacctggctgtgtggaaggattttcctgaacgatgggcttctgatctttttggggtttcatggtccgggcggcagtttctaaatccccgcctcctagaacctctggttgcacccacaccctcgatcctgccttctctgcatggaccccggggtggagatgggggacacccagggcggggcctgaagtcctgtgtccagccctccctgagacagtggcttaggaggagggcttgagctgggggagcctcaggtatccctcctgtaatcagaactgtggctcaggcgtctggggtgttatttctgtgaaacgtctttgtgggtgcaggtggcgtccgtgtcttgaagagcttggcggcgaggccctcactgtctccctgtcgttgcagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtc

SEQ ID NO: 37615 - DNA, 5950 bp, Homo sapiens; identical to SEQ ID NO: 37614

SEQ ID NO: 37616 - DNA, 13101 bp, Homo sapiens
agacgcaagatggcggctgtggtgctggcggcgacgcggttgctgcggggctcgggttcttggggctgttcgcggctgaggtgagccaaaggcgaaccaggcttcggcctggggcgggggcggctcgagtctttctggacgctccgtcttcggtttctacaggtgacatggcgcccgtgggacgggctcgcacttcgggacactggtgtccccgaggcgacgggggccctgccttgctttgcgcctcgagcccggggacgcagtcccatctgtctctcctctccccggctgctgggtcctctccccccctcacttcccgggtcgacgggccttctccgaggccatgcctcatatttgcccccgcgcttcacctaccgcgtgctccttcaggaggctgagccggtgggggcccagctctgttagacccgcagggttctgacaccagggtccaggctctcggttgctgcggtctgtccgttgatctctgacgtttaagaaccctttccgtacccaccgctcctcccacccaagtgaccgggcctgcctttccccacgctggaactttgttccgacagcacaggcgtcgcccctccccacacaacgagcgccgtttcaggggtgcggaggtgctgcctccaggagatggatacaggctggagcgtaaacaaaatatcggcagtcgcgtaaatgctttggagtaaacaagcagcctttcatgatagaaaatagcaggaaagactagactggtgagggatagtcctccatcagggtgacatttaagggaagagctgaagaatgaaagaaggggtaggcatgggcaaagggcaagccctggaacggtgaagaagctttggggttgatgagtcaaatgtgttccaggaattgacaagaatcagtgtgaccaggacctatgggagtgtgggggttcaagagatgagtttggagagggagacagaggccaagtcacaccccgccttcggaccaggttaataagggatatggcttttatccaagacttcggtggtgctgttggagggcagagctgttaagtgctttatgtgtacaaactgcacttagagtgagttactgttaataagccctgtttttacagagatagcaactaagacccaaaggacggaaccagcttgctccaggtcccgtggctgagcctttgttgtcagcctctgctttgtcttccaaagtctgtagaaataagtcctgtagaaaggcagatgctcacttttaacccagacaaaacataactaaccgcacctaacaggtcatcacaggtttgttgtctcaagcctgttgtaactgggccgctttctctgttttaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaagtaagtactgttgtgttgtcgtgggtggtcccgcagttttaacatgcacatgctttagttgactgttagttgtaattagcatgccaattatgaattgtaccctgagtggaaacaaagtgtacgatttcataaatgttgagctacacatatacctgtgaaaccatcagcacaatcaccctcatgtaattaaatctgattatcatgtcatattgacatcttaaaatgtttctcttgattaaatcttattttgaatatctgatgtaacctgtcaattttctttttactactagttcttatcaattcaggatcgagatatgaagcgaaataccttagtggaattgctcactttttggaaaaattggcattttcggtcagtacccagttttgtaattttttagactatacttttgaaggatgtttgagatttttcttgtctataatggttattttaataaattatcaagttgctaagttaatgttaataaaagacttttaagttaaaagataatttttgtatgtgtgttaaaagcaaaagtagattttaaaaaaaaattgtgtttcagggatagcctggattgcttatttaggtttccttatttatttttactagtctactgctcgatttgacagcaaagatgaaattctgcttacgttggaaaagcatgggggtatctgtgactgccagacatcaaggtacaccagcttttgtgtacaaactgactttgggtccttgggaactgacgttcttgtcgttgctcagattccctctgagcccctcccagcgggaggtgtggagattcacggggagaaggagccctgtcctggatggagacttgggtggatggcgcttacacagagaagcacagcccccaggagctcagttgacccccgtcagttcctccaggctgttggctgcatgccagggatgtagagcaggccctgttcccagatagagcagagggccttgcatacgtaatggaccccgtagccaaaggcggtaggagccaggaggatgagtggctgacttggtctggagttgggaaaggaatcataggaaatgcagggttgggctggttccagaaggagtttgctagacacacggggcacaaggcattccagaccaggagacagcaggggcaaaaggcaccgagccagggaggtgccggctgcttggtggagggagggggcagtgttgcctcgagcacagtgcagtggtctttgcatgccaggtgtggagcttgttcagaaagcactgggcaatgtgagatgggtgaatatagatcacagatttttaaaattgttgatttaagtttgaatgctaaaaaaattacacataaaagacacattaaatgctaagaattaaagttagcttggaggtaacatattcatgttctaaaacaaggcctcttaataccccctgactcccagctgcccctgccaggttcctgcctggtgtgtttgattctccgactcttgcctcgaatctcactcatcccagatgaactcctttctctggccaggtggctggtgtcctgactcagacccagcccccctcgccctcagctcaggcttttgttcttgccattctccccatgtggagagccaaagtcactgagaatggctcctcttcagggtgaaggtccagccaagtcccctcttcagaggcactggtgactgcgtcctgcctcccaagctccctcttcttcgtggctgttgcgtctgctctgcatggtctcccttgatcacacttgatctcagagcaccccatgatttcgtgcctgtcccatgggccagctctgtgcacttctgactgtgcagtgcctcatgccgggaacagatgttacagtgagacaagctccatacgagccagccattgctgtcccccaagccagccaaggccgggcatgtttccacactcaccagtgggttcgttcagtcaacaggaggctgggatgaaacacttcaccttttgagagagagtatagttacaaaaatctgtatcagaagtggctccattttgactcaagctgtgtgtagctgtgagtcctgcctaccaagcattcacactgtaagacaggaaaagagaaaggggaaaagtgtctgctgttccccgatgaagggtaggaggtgtcccctggcacgcaaagcccaagcgtccctgaaatgtctgctgggccccaacaaaaggtaggtgcccctggcatgcaaagcccaagtgtcccctggctgttgagcagagtgtgagctcagggcctggcattgtccacctggcacgcaaagcccgagcgtcccctggctgttaagcagagtgtgagttcagggcctggcattatgggcttgtgttttcttccagagacaccaccatgtatgctgtgtctgctgatagcaaaggcttggacacggtggttgccttactggctgatgtggttctgcagccccggctaacaggtgtggatcccagccgctggcgtttgaggtgggcttggacatagggaagaccggaaaggtttgcagaagccctgtagccatgagggagagcaccatgtaattggagctttaggccaacacaaagtgacagcgagatctcataagaaatagcgctggggctgggcatggtggctcacacctggaatcccaggactttgggaggctcaggcaggcaaatcgcttgagcccaggagtttgagaccagcctgggcaacatggtgaaaccctgtctctacaaaaaagatacaagaattagctggctgtggttgcttacacttagagtcctagctactcgggaggctgaggtaggaagatcgtttgagcctgggaggttgaggctgcagtgagccatgattgtgccactgccctccagcctgggcaacagagtgaggctttgtctcaaaaaaagaaagaaaggaaaaagaaatagtgctagtagccaggcgtgctggctcacgcctgtaatcccggcatttagggatgtagagatgggaggatcacttcagcccaggagttcgagaccagtctgagcaacatagcaagactctgttctccacaaaaaggaaaaaaaacccactggtgattgtaaaagtccttagtgtttgagagaatgtgtatttgagacatctgtgccctcatccctgtgggatgtttttagcgaaattggttctttgatttcggaagggcacctcggaccgtctttaaacaagtggaatggtgtgtgccagaaatttccatttcactgtttccattaccctcctcagccttgcagatggcaggactttgagtccctgtcaggggtggaccaggagaggggaacgttggcttttccagataccctaagggtgcagtttcacagcagcttgcgcttggtgttcaaaggctacagtcccacgttaagatcttgtggtcacaactgatgaaaggcgcccttgacatctgtctgtgcctctgtttctttttggagatagagtctgtctctgtcacccaggctggaatgcagtggcgcgatctcggctcactgcaacctccacctcccaggttcaagtgattctcctgcctcagcctcctgagtagctgggattacaggcgcccgccaccgcgcccagttaatttttgtatttttagtagagatggggtttcacagtgctggccaggctggtcttgaactcctgacctcaggtgatccacccacctcggcctcccaaagtgctgggattacaggcgtgagccaccgcacccagcgtgtgcctctgtttctaagcaccttcatgtctggtctcgtgtcctcacagcagcacttgggacagacaggtccagtgtcttcggtgcctttcaccagcaaggaagccagggcttagcaggctcacgtggctgcttcatggctgaggcgggatgtgaggcccaggtcccctagctcctgctccctgtagcagtccccctcactcacacaagcacccagtctgcccctagatgaaggcagaggtgactgccaacagccaccaacaggcgacactcaggccagcacacaagctgtgggtcactgctgtgttcctcatctctgcctgtgcagactcagccctggcctttgggttctcttgcagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaaggtgaagtagcgggaacgtctcatggcctcgggtggggaacacgtcccctggcccgtggtgtgacctgtttttgtattgattctgagggtgataggtgttgactgcatgtgtagctttgccttaacacatgctgtagtcccacagcagggcatggactgtgtcccctgctgagaatgagtgctgctaggcctgagagcaacacaaaaggtggatgcggttctttctctaggggagtgggtctgccactgcgtgttgcattttttttttttttttttagagatggagcctcgctctgtcacccaggctggagtgcagtggtgcaatctcggcttactgcaacctccacctcccaggttcaagtgattcttctgcctcaacttcccgagtagctgggattaccaccacgcccggctaaattttgtatagagatggggtttcactatgttggccaggctggtctcgaactcctgacctcatgatctacctgcctcagcctcccaaaatgctgggattacaggcgtaagccaccacgcccagcttatatgtatatacatatgtttttttttttttgtctttttggtagaggtggagttttgccacattgcctaggctggtcttgaactcctggactcaagtgatctgcccaccttggcctcccaaagtgctgggattttaggcatgagccactgtgcctggctggcattggatttctgtgtaaccactctgaagatgatctcatctggggtttgcgagccctcattgtttttcacatggcgacacttgcttgttttcttggttacagctagaaagagacatgtccaatgtcagcctgggcccgacccccatccccgagctcacgcacatcatggttggactggagagctgctccttcctggtgagtcctggtgctgggtctgatggcgttcctgatgcagtgtggccggctcagccagccctgccctctgtccctggcatccgacagcgctcctgatggggcgtgggcggctcagccagctctgccctctgtccctggcatccagcaatgctcctgatgcagtgtgggcgactcagccagctctgccctctgtccctggcgtctgacggcgctcgtgacacagcgtgggtggctcagctagctctgccctttgtccctggcatccgacggcgctcctgacgcggcatgggtggctcagccagctctgccctccgtccctggcgtccagcggcgctcctgacgtggcttgggcgactcagccagctctgccctccgtccctggcgtctgacggtgctcctgacgtggcgtgggtggttcagccagctctgccctccgtccctgcaggaggaggacttcatcccctttgcagtgttgaacatgatgatgggcggaggtggctccttctcggctggtgggcccggcaagggcatgttctccaggctctacctcaacgtgctcaacaggtgggttgcactcttttctgtatcctcaggccaccaggccaggccaggtgtgtttttggaccatgaggccaccttccaggtgacttttctccagtttcccatggcctgatcctggcgagtccccttcactcccatgactctcgcttcctcccaggcaccactggatgtataacgcgacctcctaccaccacagctacgaggacactggcctcctttgcatccatgccagcgccgacccaagacaggtgagggccccgcctgccaccgtcctcagtgcggttgcctgtccagacctgggcgtccctgcctagacgggtcagtaggccggcaggcgcaggccacactgttatcgtcttgcccttcttcgcaggttcgagaaatggtagaaatcatcacaaaggagtttattttaatgggcggaaccgtggacacggtaagtgcagtgtggcgccatttccaggcgtacctgtggtgtctgacaggagacagccacgttgtaggagtggccacctgtgggcctggtccctgagcctcagggccaaggtcccggcagggcagggcagggcagggcggccaaggaggcacagcctggggctgagctgctccacctgggagcccgctgaggctgttcttccctggtccaaaccccgaaaacagaaaaacagaccaccgccctcccccagtgctcggtccactacttctttctctgagccactgggtgagtcgtgggactgaccatgtgactctctcagctttgctggcgaaacgctgcaggagtttttgtgtccttctcagccgcctctgtgaggtgactggggtgaagcagctcgcacaggtgggctgcagcgtggggtgtctcgagcctttccctggctccattctatgtttgaaactgtatttgtttaccaatttttttttgttctttttaagatggagtctcactgtctcacccaggctggagtgcagtagctcaaattcggctcactgcaacctccacctcccgggttcaagcgattctcctgcttcagcctcccaagtagctgggattacaggcatgcgccaccatgcctggctaatttttgtatttttagtagagacggggtttcgccatgttggccagggtggtcttaaactcctgacctcaagtgatccgttgccttggcctcccaaggtgctgggattacaattacaggtgtgagccaccatgcgtccctgtttactaattttttaagcttagtttttgatgctttacacatttgggaacctcgttacttcctggaccagaagtggtacaaataagcaagttttatacacacacttttttttttttttagacagagtcttgctcaggctggagtgcagtggcatgatctcagctcactgcatccttccacctcccgggttcaggtgattctcctaccttagcctcctgagtagctgggattacaggcatgtgtcaccaccctagctaatttttttgttttttgttttctgttttttttttttttttttgagacggagtcctgctctgttgcccaggctggagtgcggtggcatgatctcaactcattgcaacctccgcctcccgggttcaggtgattctcctacctcagcctcctgagtagctgggattacaggcacccaccaccacacctggctaattttttgtatttttagtagagatggggtttcaccatgttggccaggctggtcttgaactcctgacctcaagtcatctgcccatctcggcctcccaaagtgctgggattacaggtgtgagccattgcacgcagccccatggctaatttttgtatttttagtagagacagggtttcaccacgttggccagaccggtcttgaactgctgacctcaggtgatccacctgccttggcctcccaaagtgctgggattactttgggatcccggtgtgagccaccgtgcccggccaggaaaaaaagcattcaagaaataaagttgtggttaaattaatacgcttcagttccactagtgcactgctagaaaaacagtcctccactaacgtgaagtcaacttgaaataaatatgaagtatttaggtatttgcctaaagttgcaaaaagacctaagaattgttttacttaaaagaaatggtatagaggccaggtccggtggcttatgcctgttttcccagcactttgggagaccaaggtgggaggatcacttgagcccaggagttcaagactgacctgggcaacatagcaagaccctgtgtctatttaagaaaaaaaaaaaaaagtgtagcatctctgcggcccatcagtttttggtgtttgtttttcagtatgctggctcctagatctgcatgtccttctcacagcacccctgcctgtgccctgagacagtctgaaggcagcctaggacccgcactgcctccctcagaacctcccagggactttgctaaaaccagctgcctgggccctgcgccggaggcgtctggggaagccccagaacctgtgtttcatttgttttccccgattttgccgtgtggccactttggggccctggcatttgggagttaactattttaccttctcccgctgcatgtcacacagacaatgaagaactcaagggaggcacattgctcctgtatttcaagtgtggtagaagccgggtaacacgtagcacagcccttccctaaaaaacctgaaggggagaccagcagggttgcctgtgacttgggcctgggttcccgtttttttttttttttttttttttgagacagagtcttgctctgtcgcccaggctggagtgcagtggtgcgatctgggctcactgcaagctccgcctcccgggttcatgccattctcccgcctcagcttcctgagcagctgggactacaggcgcccgccaccacgcccagctaatttctttttgtatttttagtagagaaggggtttcactctgttagccaggatggtctcaatctcctgacctcgtgatccgcctgcctcagcctcccaaagagctgggattacaggcgggagccactgcgcccggctgcccttccctttcttatgttcagctttgggcacagagatggcgttttgccattgctcgagtggggggtggaaggtggcacggggcgggtgtgtgctcacctgactggaccctggccccaggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgtgagtaccgcaggggtagtgaggggctgccgcaggcctcggccaggctcagaggaggccgtctcgccctcccgcaggccgtggtgggcctgtggtatgtccatcacacccagaatctggggccttcaccagttgtcctcagcaggggcggccaagggcagggtcgtggggtcgcagacctggtctcacttcccggccccaccatgcacctgctgcctccttggcaggtgaccccaccctctgcacccctgggaggggctgtcactactgcccagagttgttaaagagcactcaagttagtaggcgagaagggctcagtagaggactgctacattgtacgtggagtagcagtggctcggaatgccgctgtaccgttgctggctctcgggcaggagtctcagccccaggtttccggggcccccatgagtgaccttaggaggtctgaatttcctgaaactgccaagttgtatgtgcatcggactcttctgggggacaggcttaaaacctggcaaggctgcctattacgttggggtggctcgggcttatggtgtcacctgtgggcatctcctttccaggcctggagtcccgggcacttgccctgtcccgtgtgggccctcgtccttccctcaggagcccccgcttaaatcctcaagcgagtgtccagcctctctcgggcctcgttttctgtagaaaacagacccacctggaccctatcactcctgtcctggggttcctgggtgcagccctttggccttctctcaccccacccttctgtccatgcggccctcgggggctgggggttttttctgcaggccgtcctaaagtgagttcatcagacacggagctcgctcttctgtaagtgtaactcttcttgggtggctttgtcctatatttttaagtcattgccatgtccccatttactgagaactcaacgtctgtcacttgtggactcacccttggctacacccagtggctgcctttgggcccaggtgcccccatcagcagcacagcgtgagtgagtggtacagaccagccgccccctccgtgtgtttactgatgcagcctcagcgtgggggccgtggcgcgctcgtgtgacacgcgtttgccctctgcactaggcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctt

SEQ ID NO: 37617 - DNA, 23295 bp, Homo sapiens
cactctggctgggagcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccagggtgagtggtggcttggggtgcaggctccagaccccccgctctttgctgccggccagggccagatgcgcggggtcccctcccacgcgtggaactgcagactgggggcctggagcccctgaaccccactccccgctcggggcggctgcagcgcccagctctgccccaccgggccttggccggggcccctagaggctcagcattcagcattctcagcggggccggaccgcaggcagctcgggaggggctccctggcgagggggagctggtgcggggctgtctcggcgccccgtgaatccgtttgacccctcacctggcagtgagtccagacgcacggcccccccgacccccgttctagaagaagtcgtgcgctgctggttctgaatccagcgagaaaccttcccgtgaggtctcacttgtccggtcccgtgccggggacgccctgcccttcgggggaggttgtgaaggtttctgactcccctcgaggcacaggagcggtttggggtctctcactccaccccctccccaccgtccccaccgagggacgtcctgctgccttttcccgggagagcctctccgggcccggggctctgtgctgcaggcgctgggctggccgggagggcaggcccagcagagactcggggaatggggcgagagcttgaaggcccctctcctccatcttcggccagactgccccgtggacctgttctttgtgctggacacctctgagagcgtggccctgaggctgaagccctacggggccctcgtggacaaagtcaagtccttcaccaagcgcttcatcgacaacctgagggacaggtaggagggacgccccgtgaccttcctcctgtgcttctgggcctcttggagggaggggtgggggcccaggggaacacgggtgcgacggcctcaacctcctaaggttgggcgagcgttgccctgaccggggcccctcccggcgccctccagagtgaggccggggccctttccggcgccctccagagtgagctggtctgagcctctcccagcgccttccagagtgagctggtttgagaccctgctcgcgggggtggcacctgttcagcagggccgaggtgacagtgaggctgagatgtagggaagagaggctcccgcaggctgaccgagagggctcagcgcactggcccagacacgcagtcctgcctggtgcgcgggagcccctcactaaccacctggaccctggtttgttccgtgggcagtgagagcctctacctgggtcctggatcccacgttctgaaggtccccgactcgggagccaggaggggtgtcgctctgcagccccagggcccccaggcttggttctgggcttgggacacggcaccctctgctccacgttcctccatctgtgcgtgtggctgaggacagaccggggggagaggggagtcggtcctgtgggtgcacagggccgctgaggggggggcatgtagaacggggctcccccactgagacgggtcctggcagtggggacacagcttagccggcgtaggaacccccgtcctccttgaccctgctgactggccgctgggccggagcctcccgccaccagaaggggcacagtcagaggctgccggtaacagcagggtggaccttccagcccacaccgtgcccagcaggagccattggtaccaggaaccctgagcttagtggacatggccaggcccgtgcggcagtgtttgggggggggtctggctgtggatggcaccggggaggggcggccgcgtggcccagcgtcccccgagtcgcccttgttgcctttactcagtctccccatgactcagtttcccacctgtgaaatggggcggagtcatccccatgtcgctgccactggattcctgcaggcgccgtggtcactctgctgaatggatgggagggtgggtggggcagaggtgggcccaccccaggctggggcagagcagacccctgagagcctcaggctcaggtgctcagagggcagcgagggggctgctcagatccccggggtgcctccttcccccactgtcatgctgccccactgcaggcccaaggaccccaccccagcagggccacacactcagggctcctggtctgagggcctgagggatcggggcgcaggtcgcttgctggccacacccgcctgcacagccttccaggagggccggcctcagggccacagggcaagtccagctgtgtgtcagccacggccagggtggggcagcctgtccatctgggtgacgtcgcgccctgggacgggtagcgatggcgccaggggccgcccgcctcacgcccgccgtgcctgttcctggcaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggtgagtggcccccagcctcctgcccacgccagttctcacgcgtggtacccagcctgggctggggttggcctggggtccctgtgcggcttcagctgcagcctccctgttctcttggaggctgcacggcctccctgacccactttgtgggcaggaaagagacggagacagacagagacagagagaaacagaaacagggagaaacagacacagagagagacagagacagagagagatagagacagagacagagagagacagagacaaagagtgacagagggaccaagacaggcagacagagacaaacagagacagagacagagacacagagagagacacagagagacagagacgggaacagagacaggcagacagagacagagagagacagagacagaaacagagacagagggacagagacaggcagagagagacagagagacagagacagagacagacaaacagagacagagagacagaaacagggacagagacagaaagagagagagacagagggaaacagagagagacagagacagatagaaaaagacagaggcagagagaagcagagacagagaaacaaagacagtcagagacagacagagacagagacagaaacagagacagagagacagagacagaggggcagagacaggcagacagagagacagagacagagacagcgaaacagagacagaaacatacagagacagagagacagagagaagcagagacagacagaggcagagagacagagagaagcagagacagggacagagacagagacagaaatagagagatagagacagagggacagagacagagagatagagacagagagggagacagagagatagaagcagagagagagagacaaagacagaggcagagagacagagagagaagcacagacagagacagacagagagacagggacagacagagacagagagaccggaaacagaggcagagagactgagagactgagagagacggggtggttttccccacagcatcaacaccaagcagggctaggatcactgaaacagactcatcagacccgaagcatgcgctttctcggggtttttctggactgaggggtttcctctcatcccagtgtccagctgtggggacgcaggggccgcaagccccggagtgtccagaggggaacgtggcctccccacacccagcccttcacgaggcctcaggatcccagtgggggtacccgaggctgccctgtccagccaggcggtgcggggggtttggggagagcctctccccgaggtcggtctcagagggccacatggccggtgtgggccggacattccctttccaatggttgtgcccacttccctccagagttggtgccaagctgggacctgggggacttggagtctcaggaagtcgtccgctgtctgcagggggtgcatgggggatgtggccacacacgtcagagtgcggccccctgtggaagccacagacagacacgactcccctaaatgagctcgcccttctggccgagatgctcagcgtccccagcaggctgcccgactgccctgcgatactgccctccttcctgctgctcccactttccctttcggggggttggatttggggcattcagggatcgccctgttgtttgctcatcacacccatttcctgcaagagccacggtgaccgagcagccttgagttgaggcagcttgtgggtagacgcggcgggcatctcggaggggcacgctccctgccaccctcagcctccactcactggtcaggggctttgcgccccagggcaccccaggaaccgagcctcctttggggtcatgggtgcctctcctgggagggcgtggattttccaaagcagtttagagaaatgagacccacaggcgttatttcccatggtgaggttcttttcagtaacccccaccgtatagccaggatcagcaaagagaggcggctcctcccggtgagacagggaccagcacctcccggacaggcttgggtctccctccagttcccccacctagtctcgaggtctcacgctgccctctcctgtccaggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggtaggcaccggccccccccggcagatgcccccaaccacagggagtggcggctgcaaggcccccggcagctgggaccgtcttttggtcctcgggagggtgtgggttctccagccggccacccttgcccctgagaggccagcccctcctgctgaggagcctggagcgccccagcccagcctcccctctggccctgtgggaagcggccccggccgtcaggggtcccagccctgctcagcccaccctgaacactgcccccaggagccgcgtctgagcatcatcgccacggaccacacgtaccggcgcaacttcacggcggctgactggggccagagccgcgacgcagaggaggccatcagccagaccatcgacaccatcgtggacatgatcgtgaggcccctgcccaggagacggggaggcccgcggcggccgcaggtggaaagtaattctgcgtttccatttctctttccagaaaaataacgtggagcaagtggtaagagccctccccaccacccccagccgtgagtctgcacacgtccacccacacgtccacctgtgtgttcaggacgcatgtccctatgcatatccgcccatgtgcccgggacacatgtcccctgcgtgtctgcccgtgtgcccgggatgtgtgtccccctgcgtgtccacctgtgtgtctgcccatgtgcctgggacatgtgtccgcctgtgcgtccatccgtgtgtccgtctgcccatgtgcctgggtcgcatgtcaccctgtgtcccagccgtatgtccgtggctttcccactgactcgtctccatgctttccccccacagtgctgctccttcgaatgccaggtgagtgtgccccccgacccctgaccccgcgccctgcaccctgggaacctgagtctggggtcctggctgaccgtcccctctgccttgcagcctgcaagaggacctccggggctccggggcgaccccggctttgaggtgagtggtgactcctgctcctcccatgtgttgtggggcctgggagtgggggtggcaggaccaaagcctcctgggcacccaagtccaccatgaggatccagaggggacggcgggggtccagatggaggggacggcgggggtccagatggaggggacggcgggagtccagatggaggggatggcggggtccagatggaggggacggcggggtccagatggaggggacggcggggtccagatggaggggatggcggggtccagatggaggggacggcggggtccagatggaggggacggcggggtccagatggaggggacgtcggggctccagatggaggggacggcgggagtccagatggaggggacggcggggtccagatggaggggacggcggggtccagatggaggggacggcggggtccagatggaggggacgtcggggctccagatggaggggacggcgggagtccagatggaggggacggcgtggtccagatggaggggacggcggggtccagatggaggggacgtcggggctccagatggaggggacggcgggggtccagatggaggggacggcggggtccagatggaggggacggcggggtccagatggaggggacggcggggtccagatggaggggacggcggggtccagatggaggggacggcggggtccagatggaggggacggcgggagtccagatggaggggacggcgtggtccagatggaggggacggcggggtccagatggaggggacgtcggggctccagatggaggggacggcggggtccagatggaggggatgtcggggtccagatggaagggacggcggggtccagcaggcaggctccggccgtgcagggtgtggactgtcccgggggcgctgggggcttctgagggtgtctctgtccgccctgccctcagccgcactctgttcagaaggacctttctggaggtaggagggtgagaatgtgggtcccctgcttctgtgtggctcacataggatgaccttaaacgttagaattagctgctgataattaaaacttgccatgaggctgctcatggacctcagatttctggcttctcctaaaaaccatcaaacccagcagctgtgggcccgagtcccatggccatttcctgggggtcgagctgtgaccctggggggcttctgtgctgcacgtccctcccacctgtgcctgggggtcagcaaagccgagcagacaggaacgaaggcagggagtggggggagctggcgtgcgggttggagctcccagacccaggctgaccagatgtgatggggaaggtgctttaaagcccttgatccctgaaggctggatgaagcgtctttttaaaaacctgtttcgtgagccagctttttagaaagaaacggggctgccccaaccttgacctgttttgtgttccagggagaacgaggcaagccggggctcccaggagagaagggagaagccggagatcctgtgagtgcctgactgtggggtgggggccctaagaagctggaggcggggaacgactaggcctcggaaacttccggaagagtggctgggttctgagtgccaaagtcacactgcctgttccttgtgggtgggagcagacctggaggggccacagcccagccatccttccacacagccccccaggcagcccgtaagcccccctgccagggaggggctgggtggggaggtggcccagggtgctcaggccggcaccgtccggggcccctgccgtggctccttggcccaaatcctatccatagacttccctcccccagctccaccttggagggcctcggcaccatgggccccgtgcagcagggcccctctctcggcctgaccaggcctgggctggagggaggggtgtggggctgggtgggactggcccctgcccctgctcctccgggggtgtctcaccatctcctcctgtgttccagggaagacccggggacctcggacctgttgggtaccagggaatgaaggtacgtgccccccctttcctggcccgagcccggtggtgccctcagccttgcacagcactaacaagccttcctcttcctcttcttccgctgggtgtgtagggagaaaaagggagccgtggggagaaggtgagtgaggctcgacctcggagctggtctctccaggcgcagatgtgccatcctggacgagggtgtccccggggatgaggacagtgtccctgacaggagaccacgtgtcctgcagacccgctccaccgcccctcgccgtcccctccatctggaaggacaaggacagccacccaggcacccagcaaaggcgcctgtgtcactttcaccccaccccagagcaggggtcccccgggcggttaccctctgcggagccgggggtcccccgggcggttaccctctgcggagccgggggtcccccgggcggttaccctctgcagagcggcccctccccatcactgtcagtccccatgattctcagcagtgatgttgtcccctcgggttgggggcacccaagcccctgcctcgcgtgggcctaagccaggcttgccctgccctccccaccccaaataccccctcacacccgcttcctgtctccgcagggctccaggggacccaagggctacaaggtgagcgtgggctgctgggaggggggagttctgcccccacggcagcatgtctgacctgcatctgactcctgccttcgttttcccgcctcacagggagagaagggcaagcgtggcatcgacggggtggacggcgtgaaggtgactggggggagataggatggacggggagggacgaggaggaatggggcgagatggggagggacggagtggacggcgtgaaggtgacccggggagggatggggtggacagtgtgaaggtgaccaggggaaggacggggagggacggggagggatggggtgaggtgatcccggcaggagggacagggaggagtggggtggacggtgtgaaggtgaccccaggggggtgtctgctaggcagggctttccagggagggtgtggagggcatggagggcaccaagtctgacagttgattggcctcagtttacccacttggccgtcagattttctagttttcttcctctttccagggggagatggggtacccaggcctgccaggctgcaagggctcgcccgggtttgacgtaagtcacttcctctcactgatactttaaaactagcgctgtcagcagcacctcgtgtggaccgttttgacttctgtctgggcggtctggggctgctgccagaggccgcggtggcctctgccggtggtgtcatgctgccctcttttctccagggcattcaaggaccccctggccccaagggagaccccggtgcctttggactgaaaggagaaaaggtgagtgacttgcggcccctggaggaccagggccttcacggttggccaagcgctgaattggaaacctctcctggaagcaagtcctggtccgagcatgtcggccacccgtgcggcctcagaggggaggagctggtggaggctggaggcaggcagaggagcagcggggacagtgcccaccgtggggacagtggccgtggcgctcccgcccagagccttccctgcagcccgagggccttcaggcctccgccattctgtcccccgcacctgccgctcgctcggcacagatgggaccccaccgcgtcactcctagcctgcgagccgcagcccagaatggctctcagaactgagaatgggctgggtggcactgagggtggcgagtgggcgggagggtggtgagcgggggcgggaggagggtggtgagcgggtgggagggcgagtgggcagcgggagggcgggagcacgaggcgggagaaggagctttttcgtctgacagctgagtctgccgttgctggtgttttctctggagtttctttgttgaagctgaagtgttggggaagacaaaggcgaatgctgaccccaccccaaacattcccagacgagctcctagaacccagcagacggtttccaaatctcatcttcaagttcccagattaccctccaggccctagatttgagtttgccaatttgccagcctggcaaagctgtgccttctctaatgggaaccaaatcctgccccttagacaagatggcccttggctgggcctcacagggaacaaggttggagcattccaggaggtctttgtgcagggttgtggatggctgagggtgctggggggtctgggctcagacagtgttggtcagagggagtggcctgaagtatgggtgagaggccctggatgtggcctctgatggctgcacccctggtgcacacccctgccagcgtgtgtgactcccccggtcttccccagggcgagcctggagctgacggggaggcggggagaccagggagctcgggaccatctggagacgaggtgaggagcttcacagcccccacacatgccaggtatgggcccagggagggtcaaggagatggagcgaccattcaacccttgttccccacagggccagccgggagagcctgggccccccggagagaaaggagaggcgggcgacgaggtgagtgagggctcctgacaccttcctggggaagtgcatggcctcagcttctgatcctctttgctcggggtctactccacgtccctgagaccaaatgcagtgtgtccaccagactaacgccggcgtctgtttctcttcatcccaggggaacccaggacctgacggtgcccccggggagcgggtgagtggggcaggggcagcctgcgctgttggcctcaccatgtagctgtggacgtggcctctgcggcccagtctggccctcccagcactgagagccatggcctcctgcccaagacaaatgggtttcttcacccacacgtccaggatgcctcttcccacagtctcagagcgggtgggacctggggaaccaggagattccggcctctgcaaccgtggggcatgcggtggaggggtggcccctcccaggggtcctgctgggggagtcagtccaggccaggcctcaagccccaccccagctgggtgtgagttccagcagctgaggcttctcccctccatgtctctccactcagggtggccctggagagagaggaccacgggggaccccaggcacgcggggaccaagaggagaccctgtgagtcacagttcctggagctgggaaccaccccaggaaggggcaggcggaggctggggctgggtcaggcctccagagccacaggacacatcatgaagcccctgtggcccctcaacgtggccagcccatccccacgccgtcagggagggcagcccctgaagccggcgcccagccatgtgcctgatgctgggacctgtttcatgtgaaggcgttgcccgtggacccggtgcccactttcccaccaggcggcttccacgtttctgcatccgagcttgggttcttctttggaataattttccttagttaaaattcccagcgtgaggaagttgggtcagtaccccagacgggaagctaggcctgcagggcgcctgcctgggaaggcttgacatggaaaactcaccccagagccgagatgccggcggcctcagaggccaccccccaccttcagctccgtggaccgtgggcctcgctaggccaccccacagcccagcctcagggtgcagaagcacagggcccttctctgtccctgtgacttgctgggaaatctgtgctggatgtggggcggggcagctggcagactccgggcgtctcagtcccatccggctcagggagagccagggcctggcgggcagagtgaaggggagagaatgccctagtgtgcccagccgagctgccaggcctcagaggcagcgcccccgggtgcccccttgtccgagaatcaagacatgcgactgtcgtgtgctgtgacagacaggcggggctccagcagggccagagagctgagccggggccagagtcgccgccaccgagggatttggctccccagtggggggtgggggatttctgacctcctccctgggagctccccagaagcgcacagcccccgtggaggggtcggggggacgtcaaagcagggatcgtgtgacttagtgactcagactgccttctaggcccactcctctgagatcaggatatgagactgacagccaggcagagcccagaggaagggccagccacgcagctccagcttcccggcgggccacaagtccatggctacaaacacttgccgggtccacggagcttgctggagaagcagggatgcacgcagggacgcctctggggccccaggaggagctgccggcctcctgaatgaagatagccatagccagccacgccgatggccacgcacgtgggccgaggaaacgcttggcgaggccaggaaggggctgtgcggggagggaaggccggaacagcccagtgaccacctggacagcatgctgtggctcccagcgtgcccgggcagccatcctccccaaggatggcccagctccacactcacggctcgtttctcttcagggtgaagctggcccgcagggtgatcagggaagagaaggccccgttggtgtccctggagacccggtaggaagcgctgtggggttggggggcgttggccaatttgggttttgggggtagaagtgctccagcagctcacgcactgggggtctgttcatttccgtttgagggcctctgtgtttccgtagatctcgggggtgtccctgcgtgggagccggctgcagggggtgaggcgcggcctgggccgggctggtgtggattgttgagagcaggcccagcgcccgggggcctgacgctgagacgctcagcccaggtggagaagcgctgtctgggggcccatccggggcaagggtgcctcacagtgaggaagaggtgttggagcccctgggagacactgggagcttggtcagcatctgtttttctgggtcaggagccaggcatgactgtggctggaggtcaactggggagtgtgaggctatggaggtttccagaatcccagggtgtcaggatgaaaatgcactttcatctcattctaaattcccttctccgagcctctggaatcgctgtgcacgccgcacggctttctgtctcttcccccattctgatgactgccatgatggtggctccagtgtggtgttgcccgcaggctgggctgggccgttgcatcctcccggagctcacctgccccacggggacaggaaggcctccacacggtcacgcccggagacagcaagtctgtgctcccgagcttgtctgcttctgtggacaaatcgaccttacggctccatgtgcgcagctgcccacacaccgagcacaaggccagaccctgggcacggcagctgtctcagacgtccagcaagatggggcctcagacccagggagatgggagaggccgtcccagtgcaagtcacatttgtatttctgtgcacgaggtgaaatcgtgcttttgtggtgccaacgggtgttacacagctgttaaaaatacctgtgtcatagatgaggaccagggcagggcttggcaggcggggtctgggccgttcgtccacctggtcctgcgtgccgctcacggcaggggcagaaagggctcccgacaccttcctggggaagtgcacggcctcagtctctgatcctctttgctctttgagctcccggggctccagccctgaggatgatctgacctcccatgtggtcacccaggacagggccaggtgcagggcacagtgcgtggaagaggccatgcagccagtggcagattgtggggaggggacggcccagggccacgttccaggcttgggaggctgctccagaccttggtagctgaaagtctcagtgggaatgagcgttcagaggccaggacttgctcggagaattctaaccacaccctgcctgttttatatgttcagttttcaaagtaatcaatagccactataagaaaaaaacaaagccactttcaaagggttgtggtaagaggcagtcctgtgagcaggccggctgcagggcctccagggctgtggggcaggctgcacaggggctggtgggtcccatgcctgggggtctgggaatagtctctaggctgctgtcctggaggaggtttcccccaacgcctgagaccagggcaccatgtgacccatgactcacagttgcctggctgaggcaggcacttgttcacctggagcctccctggggcctttcggggcccgggggtgtggataggtggctttggagccacatttgtccatcgggacgttgggctcccagctggccttccgggctttccctgctcccagaacctccctgctcagcccttgccagccttacccctcccctccaccctgcccagcatggggctctccctgtgtggatgccagaagcagttgggccctcagggctggtcccaggaggtgcccccagtgaggtgctctgcagaaactgcccagtctggcctcctgctgtctgtggcacagtctgactgtgtgtggtgaggtccaggccttctgcctcccacttacctggcccagggcacagagacctcctttccatccttcctcctggcccccttttcgtgttcccaaggcaggatctcagggtaccagactaacccctgttgaaccccaagtttggtgagcttctggacctccttgaggcccgtgtgcaaagtccccagtcaagtgtgcagtcctgactgctggggcgttgaccacgaagggtgcaggagcttcacagccaggcctgggtgcttgcacagtcggggtagagagagcaatacactagatgcctcctgtctgcctggtggaggccacggggtcaggatggtgaatgggccaagtctggtagtggggaagttgtaaacatttgaaccaccggacaggcctcatcgggaagcatcagcctaaccacaggccagggacaggcgtctgagcaggcacaggccagggacaggcgtccgaccaggctcatggctggggccaggtgggccaggtgggccaggtgggccgggcgatgtgtacacggctcccttcttggctcagctgggcgcgctgggaagtgcttggggtgcctgggctagactccgaagggcagggactcgccgctggagttgtccacggagcaggccctcaaaggtgggagctggggccagctctggaaatagacccccacagggtcctcatgagatgtgggggacccaaggaagtccagcaggcagcctcaggtgcaggtgggggcagggtggtgtccaggctcagcccacagagggtcctgcggttgggggtgggctaaggggaccaggccaggcccaaaggggaccatgagggagggcagtctggggccactctgataggagaaggggcaggtggtctgcggcctggggacctgtagcctcacccctccgtggggacctgaggcaccagccgggcactcaccgaagtcatctgggacaggcttcacccttccgtgggggcctgaggcaccagccgggcgcccaccaaagtcatctgggagaggcttcacccctccgtgggggcctgaggcaccagctgggcgcccaccgaagggcttcaacacttgtgcccaggcccttcgtgcaggcccttcgtcagacccaagagtgggcctggctctccccctgcactgatgggactggggccagagcctgggggccctgatgcctcttggtctgagaccctcagcttagggtcagggagggctcaggctgggtgaggcctgtggtccaacgtgccatatccatctctctacagggcgaggctggccctatcggacctaaaggctaccgaggcgatgagggtcccccagggtccgaggtgagtcccactccccacccacacccgcccacccaggggggcctgaggatccagaacccactgtctgcccagtgctggccccgtgccctctgaggactctatggccctgggtgtcctggctcccgatgggacctctcccggccccaggagggccctgcttccctccaaggtcaccatgctaagcctgctcccctcacgcctcctcttcctcctcagggtgccagaggagccccaggacctgccggaccccctggagacccggggctgatgggtgaaagggtgagtgtccaacagctcgggccctagggcggaggcctggccgccagaggccctgggaagccccagccccgcactgtggagctgcctggggtccctgaccgggccgggagtgcccgcagcatcactggctcctggccacagtcggcacctgagccagaggccgcctcggcagggcccctcctgccccgagatccgggtcccagggtccacggggaccagcagggtggccccaggggagggagccggcttctgggctgacggaggggccctgcgggtgaggtgctcccgggcctgtgccagccagtgggtatcccaggccaggccgattcgcacggtgacggctactctgctcccccagggagaagacggccccgctggaaatggcaccgagggcttccccggcttccccgtaagtgtccggaggctgagcccacaggaacatgcccaagctgcctgcggcgccctctttagtggactgggcactcttgggtgggcgggctggccccaggaccgccggctggcccaggaattccatggccgggattctgtcagctcaggcccttccgctgtgcgcccctcacagcctcccctctcaaatcagaacccggtatcactgccctgcttttccatgacaggggtatccgggcaacaggggcgctcccgggataaacgtgagtacgccccctcctccatctggctgtgggcacacaaacattcacagtcacagggacacgcacgtgtgaacacacatgtgcacacaggctcccgagcaaacacacggggtacacaggcacccacggctgccccactgtctgtggccacagccccagttggcatcggctcctgcaggccctgcgaggctcccactgtggtgtggcctgtgggtctcctcacggccctgactgcccggtgaccgatctcccctcggtgcgcagggcaggcccagccccagaggccgccccacggctctctaggccactccgggacccagtttctccagcccaggaaatgtgtgtggtgggggaagggaagagaagagtgcctctcttatctttatttttttccttttaaaatttccacttcctaaaaacaaaataaaacccttgttaaccaagtgctctcccgtcactgcagggcacgaagggctaccccggcctcaagggggacgagggagaagccggggaccccggagacgatgtaagtgtggatgggaggcagggccagccccaagtccacctgagccagagggctgggcccttgaagggcagtggaccaggacccgcttggggaggcctcatgggccccggctgctggatgctctgtggacggggccagcgcgcagatgcccgggtggtgcacggtctgttgacacaacgctgttcccttctagaacaacgacattgcaccccgaggagtcaaaggagcaaaggggtaccggggtcccgagggcccccaggtgggtggatgtggctgggtgaggccacggtgggctgtgcctgggacgccggatgctggggctggggaatgctggaagaggctgggagagtgggaggcggcgggagggaattttggggagcacgtcatctgggaggccctgggggtgggaggtgccggtcaccagggccaggtggtggccagggcagcagagccgagcccagggacacagcgggtcctcagggtggggcccacctgggatggccgcctggaccaccagtgtgcgaagccccagctgccctcacagcaccgtcactggaggacgaggggctgggtagggagggaccgggcaggggtgggcttgatgaggggcagggccctgggggtgggggctgtctcagctcaggaagcacagtgggctcctcaccctcagagctcctctactccgtttctcggacagggacccccaggacaccaaggaccgcctgggccggacgtaagtggggctctgtgaacattgctgggggcgaccactgtagcttccatcccttggggtgtgggtcctgtccatgggtgctcctgtagacgctgctcacgggggggtgggttgtggacaaagagctggtgccaggccctagggacccgtgacggccatgggaggacccgtgaggatcatagggggatgtgtgaggaccatagaggggacatgtgaggatcatgggggacatgtgaggatcatgggggggacgtgtgaggatcatgggaggacgtgaggatcatggagggggacatgtgaggatcatgggggacccgtgaggatcatgggggacccgtgtgaggatcatggggggggacgtgtgaggatcatggggggacctgtacccatgaggaccatgaggggacccgtgacggccacggggagacccatgactgcgctgtttctatgaccacgtcaggggtccagcccagtagcaggggtgtagtgggcagagccgggcacacctgcaaagaacctcctgcccaaaccccgccctgtgggggccccagggagggtgacctggagatccagcagcccacagtccccgctgggaggggctgtctatggccccagtaccctcgtctctccctccccaggaatgcgagattttggacatcatcatgaaaatgtgctgtgagtatctctgagaagccgtcctcgttagggagagcagggccgccagcctggcctgttccactcctagaagggtgtctccactgttgggggcctgggtctctgggtacatccttgaggaggctcctcagccagcccctaccggcctccaaagccctcccaggcccccgggtccccgcacaggctgagagtccccggtgcggtgcagagctgccacgtggggagggcggccggggaggcggggaggcggggcaggaggccggggaaggggggaggccggggaaggagggcggccggggaggcggggaggctgccccaagagtaaaagcctttctgacgtgcgcaggacgcggccctgactggtctaactgactctttctcttctcctcagcttgctgtggtgagacccaggctctagctcctgagagaatggatcccgggggtcggggagcgaggcctgggtcccacacatgtcacaggacagcacatggcactctggtccccgcccgcagctccctgcacctgcccgccccctctggggcctgctccaagccagcagggttcccgggtgttgggctgggccccgccctctttcacccataactgaaataaccaggagcaggcttgggggggtccctgctccatcattctggcccacaggccccaccctagcctggctgagcaacgccagccctgaccagccgccggacagagcagcctttacggggccatgggagggggtgggcttttctggggctgagacggggggaccccaacgtgtcaggtgaggatgtggcagccaaggaggggccagggcggtggaggggaggggccagggcactggaggggaggggcgtgctctgctgacaccgcccccgcctgcagaatgcaagtgcggccccatcgacctcctgttcgtgctggacagctcagagagcattggcctgcagaacttcgagattgccaaggacttcgtcgtcaaggtcatcgaccggctgagccgggacgagctggtcaaggtgaggcctcgccccgcccggctttctcaagcccaggtgcaccccgaccctgccggccgcccctgcccgcgccagacctcagcctcccgaggccaccgctgcatccctgtgacttccctactcatgacaaggatgccaggcacgcgccagcccgtccaggcctccagctccacctggcgaggctggcccattgtacacaggcgccccagatgagggagggtctccccctctccttgaagggcggtagtctggggtcctgagtgctgggtgtgggcttgtccctcgtggacagaacccaggagggcttcatccaccaaggaagattgctttgcagggtacccaggtcccgggggctgtgccaccctctgggcacccggagccaatcgcagggtacccaggtcccgggggctgtgccaccctctgtgcacccagagccaatcgcaggggacccaggtcctgaggtcctgggggccatgccaccctctgggcacccgcagccaatagagtcacccttgggaagcttatgcggacctggggcagcactcgcgtcctgaccccggtgccggtcccacagttcgagccagggcagtcgtacgcgggtgtggtgcagtacagccacagccagatgcaggagcacgtgagcctgcgcagccccagcatccggaacgtgcaggagctcaaggagtgagtgccccacgcggccaggaccctcccacccctcgccccgaccgctgttcccacggcaggtcggccctgacccctgatcccaggtgggctcggccccgcggcaggcctggccccaaccggcccttcctgccctttgctatgcagagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggggtggccacccccaggctgcacctgccccgcctagggcgccccgccagccagggtggccttgtccccagaaagacgagggcagagcaggctgcgccacaccgatactgtctgtccccacaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcataggtgcgcatggggccacccgggcagtcccagatctgcgtaggtgcgcgcggggccgcccgggcagtcccagatctgcgtaggtgcacgcggggccgcccgggcagtcccagatctgcgtaggtgcacgcggggccgcccagggccgtcccagatctgtgtaggtgcgcgcaggcgcccagggctgtcccagaggcctcctcccagctcactgttacctccaggggcacggccaccctgtaggtgcgcacggggccgcctggggctgtcccacaggcatcctcctcccggctcgctgtgacttccgggggcacggccacccctgtgctcggccgggaggtcctgtgacatctccttgcggggttataggtggagcagtgggctcacactgcacggcttttctcttttacagacaagaagtgtccagattacacctgccccagtgagtacctcggcggccgggacacgtggggaggagggcaccgtggttggggcgagggctctgagaggacggggctctgggaggagggcctggcggtcacgagagtaggtgcatggctcactccggtggctgagcaccaccgtgccgtgccctctctggggagcttagacgctctctggccggcccactgcggctgcatcaccagggcctcatgctaacggctgcccaccccgccccgcagtcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 37618 - DNA, 36392 bp, Homo sapiens; identical to SEQ ID NO: 36327

SEQ ID NO: 37619 - DNA, 284903 bp, Homo sapiens
agtcggggccgaggcccagggggaggtggcctgtcgcgggtcgcccggctcccggaggcgaggggggcgcgggcggatggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcaggtgaccgcgcgggacggggcgcccagttattgcgggggtgggcgtgagggtcgacaccgggctccccggcttggagagagggagggcctccgggagtcctgggttggaggtgggatggggggccattcggggcctggttggaaggtggggcgagctcgggctaggaacgaaggttgcaggactgaacctggtgtgcccgagagggtcctgattcctgaggggccaggaggcacgacgagtggataggttttggggggaaatcgaacaaggttgagatggattccattttttcaaatccttccttagtgccttggggtggagtggaagccgggaaatcctggcttctctggactgagtcgaggaaaaggagatctggtgggaaacctcccgagaagagggagtaccttttggcagccctgggcacacgctgggatggggaagagaagtggcatttcaatgagaggagtgaaaagaaaactcctcgagagagccccgaggggatgtggctgagattgtgggttaaatcacacagagtgtgagaagtacaaggagtttggtaatgttatggggacacggtggtgctcagtctcatttactttgtggagcatactaatgagtctgaagggagacactagacatgtccctcctgttctttgccaattgcattctacatcaccaggacacaaaatagctctttaatgtcccgggctataaaaaaaatttttttatagggctattagaagactggattctcaattctggattgaaagataaacgtggttaatttgggtagggaatgggaaaggtattgatgtcagctgacttcatagttttgaagaagaccttgaaacctttggaggttttacgatttggtctttgcccagaaaatactgctatgacatgatgagtctcacctaccaacagttgtgcagacttgtgcctaattctctcggagtcataggatgttagagggatgctaggaggactagacatcatcttttccaggggttcttaacctgggaagacttggaagattcttactcatagtaggtgatgtgcactttttggtggaggagagtcaatagttttcatctttgttttttttggaggagattcaagtcccagcttgttttaaccaccttattttatagatggggaatcagaagtccagagaagatggtgacttgggtaaggccacccagttagctaatagtaaaactagaactagaagcctggtcttctaattcctattcctgtgctgtctccattacaccactcttggaaatctctgcagtgctaaaagacttcctgtgctctgctccctgcttttcaagcctctgcctgacttcctgtgttagggacagagctgtacttaagcctagcatgtttgttgtatgcttcttggtctcctttgcagagtttaccctgttacttctgttgatttaggtaaagtgaccctcttggtgtttatttttgaattcttttgttttgtttgcctgcttttattttccattagaactctgtcaggcagagggattgtgagaagtaaaagctcagggccatggcaaaaaagacaggaatgtgggagacttcaggtgaggtgagctaatattggatgataaggagggaagactggatgtaggtgctggtgagcaggttctacttggtgtgtgtgtgtgtgtgtgtgtgtgtgtgtgtatgtattcatttatcatttctgtcaatcctagttaatagtgagacccccgtccctttccctcatttactcctggggcctattatctgttggttgccttcaaactggctaaagatagtgatatttggaaatggagcagtgtgtagggacttcgcaggggtgtgcagaggaaagagtggttaggtccttgggggtacaaattggcagctgagagttatccctccgagaatccttttttcacttcttgtattttattttctttctatacattctcttttttttttttttgcccaggctggagtgcaatggcacgatctcggctcactgcaacctccacctccacctccacctctgggttcaagggattctcctgcctcagcttcctgagtagatgggattacaggcgtctgccaccatgcccagctaatttttcttatttttagtagagagggggtttcaccaggttggccaggctggtctcgaactcctgacctcaggtgattcacccacctcagcctcccaaaatgttgggattacaggtgtgagccaccacacccggccttctatacattcccattgttgtaggtccattcccctatgtcatacaggtattcaaatcattgatttaggccctgccttcaactagctgaatggttctgcagaaatctttcattttggggcctctgttttccttagttgtaaaataaagtatgtgtacaagatgatttcccttgtaatccacccacctcggcctcccaaagtgctgggattacaggtgtgaggcaccgcacccggccaagttctaagttaccttctaaaagttataagtccagttcactgtccttaaggtgcatgcaatctatgtggggagacaaatgggcgaaaagttttttttaaagaagcgtgcatttttaaagaagtgtgagagtattacatgaatatacttaatgtttattcattgaactaacatttattaagcagctgctacatcccaggcactgttttaaccctaagagatataatagtgaacaacaacaacaaaaaacccttgctgtcatggaactaatattgaatggaaagagacatctaataaatcaacaactataattgtgtggtgataagggctaaaaagaaaaagcagggaaagggagagatggaaagggagagaatgaagatggttacggaagggctttaagatagatggcctatgagtgaagtgaggtaatgggccattcagatgctttcggaaagagggttcaggtagaggaggtgagggtgcacaggcattgagaaagactgcttggtttgtttggaaacaggagaccaatgtattaatagctggagcagagagagcaagggcaggtagtcttaggagatggtatcagtggtttagaaatatctataggccctatgtaaatacacactttaaaaatcttagccgggcgcagtggctcacgcctgtaatcccagcactttgggagactgaggcgggtggatcgcctgagatcaggagttcgagaccagcctggccaacatagtgaaacccgtctctactaaaaatacaaaaaattagccaggcgtggtggcaggcgcctgtaatcccagctactagggaggctgaggcaggagaatcacttgaactcgggaggcggaggttgcagttagctgaggttgcgccattgcactccaggctgggcaacaagagcgaaaatctgtctcaaaaaaataaaaaaaatcttatcgtagccagtgttttgggtatgtgggtttgtcttaaagtacacgtcttttttttctttttttttgagatggagtctcactgttgcccaggctggagtgcagtggcttgatctcagctcactgcaacctctgcctcctgggttcaagcaattcttatgcctcagcctcctgagtagctgggattacaggcatgtgccaccacaccccgctaatttttgtatttatagtagagatgaggtttcaccatgttggccaggctggtctcgaactcctgacctcaggtgatcgcctgcgttggcctcccaaagtgctgagattacaggcatgagccactgcacctggcctgttttcttaacacgttttctaactccttttgtgaagccttccctgacagcttagttcacaccattccgatcctactcttgcctcttggtatattgatgcttaattgtgtgtcatcttttattgtcccttaattgttttattattcttgtttcactgctaagattgtaagcttctaaaagataggaactatatttcctttgtatttatccttcgtaatacctaacagttttgggtacttggtaagtgctcaatgcctgttaaattgaaattgaaatttaccttttacagatagttaaggattaagaaaaattgtgaaattccagagtgagggtatcatcacagaattttccaggcactttgaatgtcaaaggattaaccgctttttatagaataagttcatttactggggtcattcccaaggctgcttactaaatggagctgtagtgctaagcgttagattccaaagttgaatcttgttaagttgtaccactaagcttttggagtaaatcatcacttaccaaaatggagtttaggaaacgccagagagtctgtgatgcttttgttataatccttaggctcagaaggaaccctaggagaaagagaggaagggtcggtgctttcaaaggcagtatacagaaacttgatgtaggtggaagaggagtcagtgcagccctggaaagagtacagaaatagagaaacgtgaaccagagagtaggagggaagtgacaaactcaactggaaagctgatgtacagtttgagaaatgtagttaaagagagtacttggaaatactgtactcaaagtttgtgggaagttaaatgagttaaatatagggctattagaggttcatttcactttaagtttaatatgtatgaaatttacgctctatacaatgtagtggggaatgaattcttttggtcagcttttctagtgaacaatttgattcataaaaattttatttttgtgcagttttctaagagtttagctgctgtataaggtaagatgtaccttattacttatagctttcagcagaattctttgtgtcagtgaaatgttgatatggtataattattatatggccaagtaaccgcttctcaccatagagtcataaatccagtttagccaagtgggttcagcagttattcctattagcagctgattctagtagtaagatgactttctttcaggtttcagggaaggggttccagatagcctgaagttgctttgtagatgctgtgtttattgaagtagtttatcttcccatttgcttatttatgggcttatttcctcataggtggatgtctctttgtgccctcatttggtatttggtgctgaaactaagcatggtgctaccattcaagaagagttataaaaatattgtgttttttttttcttgcaagtaatttcatgaacaatatttcactgaaattactgaatttttcatctctccctgtcccagtgtccttgggctgccacagcaaaataccatagactgggtggcttaaacaacagacatttatttctcacagttttggaggctgggaagtccaagatgaaggtgccagcagatttcatgtctggtgagggcccaccttctggcttgtggatagctgtcttcttgctgtgtgttcacatggcctttcctttgtctgtgccctgggggagagagagtcagtggtctcttcctcttcttataagggcactcatttatcatgtagttcccaccctcatgacccaatctgaagctaattctagaggtcctacctccaaataccattacactggggttagggcttcaacatacgaaatttagagggacacagacattaagcctgtaacactaccagagtggtaaatattgtagatggagaaactgaggaacagtcatgtaaaacttgttgcttttttccccatgtcttacaaggaagtctgcagatgtaaaactggaaatgtatttgagaaggagaaagtcagatctgatttcaaagtagaattattcttcagggtgactcaagagattagcttgagttgagtttgtctcccaactccctcccattttctagctactctgtcatttttttttcactatcacgctgacatgtgaacacaacagaagctaactagaaatttaactttcattttgctgtaaagcagactggtgcagacaggcctcaagtttacaggactgctgagaaagaaattgagttatgctactttgtataaacaagaatgttgctagtgaatctctagtttaacatctctcaggccttcagtttgatgtcaggctttaataatttgtagaaaaagacagtcattttagtaagcagatttctttgaatttttgttgatatacatttgtaaagcatagtaaacatctttattctggggcaaatgtgcacttccttcaaaggcaggagggaagaaccacagacatgattggaaggaaatggcagtaattggagcatgagcagacagatggagtgagggatggtgagtacatttggtgttttaggtggcccctaggagtattgagtttcttcttattctcctctacaaccccaatacaagcaggcagcttacatggctaaggtttcattatctaatccatcacagatcagcttgaataaacccattggctgatgctgatctagttaggaaagtagcaaagctgcttgagccaggattgggacaaatcggatcagaactgccatgtgaatcctggacgcatttctgtaatttgggtgggcaaagtagtttgggaagtcatttactcaagagaatgagcagtcagccatgagttttttcaaacattgtcttagggactctgaggggaaagtgtgtggaggatttgagatatttctctggaggatagccagattgctttgattatttgagtctgaacattttttggtcactaatgctcagaagtgacctttttttttttagtagcatttggagattccagttgtgatcgtttgtcacttttgtgagtgatcccttaatctgagaccgtaggatatatgtcccttctctgtttttattttatttttattttttatttttattatacttcaagttctagggtacgtgtgcacaacgtgcgggtttgttatgtatgtatacatgtgccatgttggtgtggctgcacccattaactcgtcatttacatcaggtgtatttcctaatgttatccctcccccctccccccaccccaggacaggccccattgtgtgatgttccccaccctgtgtccaagtgttctcattgtttaattctcacctatgagtgagaacatgcagtgtttggttttctgtccttgtgatagtttgctcagaatgatggtttccagcttcatccatgttcctacaaaggacgtgaactcatccttttttagggctgcatggtattccatggtgtatatgtgccacattttcttaatccaatttatcattgatgggcatttgggttggttccaagtctttgctattgtgaatagtgctgcagtaaacatacgtgtgcatgtgtctttatagcagcatgatttataatcctttggatatatacccagtaatgggatggctgcgtcaaatggtatttctaattctagatccttgaggaatcgccacactgtcttccacaatggttgaactagtttacagtcccaccaacagtgtaaaagtgttcctatttctccacatcctctccagcacctgttgtttcctgactttttaatgatcgccattctaactgttgtgagatggtatctcattgtggttttgatttgcatttctctgatgaccagtgatgatgagcattttttcatgtgtctgttggctgcgtaaatttcttttgagaagtgtctgttcatatcctttgcccactttttggtgggattgtttgattttttcttgtaaatttgtttgagttcattgtagattctggatattagccctttgtcagataggtagattgtaaaaattttctcccattctgtaggttgcctgttcactctgatggtggtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatgcttttaggtctaacatttaaatctttaatccgtcttgaattaatttttgtataaggtgtaaggaagggatccagtttcagctttctgcatatggctagccagttttcccagcaccgtttattagatagggaatcctttccccatttcttgttttttgtcaggtttgtcaaagatcaggtggttgtagatgtgtggtattatttctgagggctctgttctgttccattggtctatatctctgtcttggtaccagtaccatgctgttttggttactatagccttgtagtataatttgaagtcaggtagcgtgatgcccccagctttgttcttttggcttaggattgtcttggcaatgtgggctcttttttggttctatatgaacttcaaagtagttttttccaattctgtgaagaaagtcattggtagcttgatggggatggcattgaatctatagtttaccttgggcagtatggccattttcatgatattgattcttcctatccatgagtcccttctctgtttttaaaggggagatatttttattactaaccttaatatgtaatcatatttgttatccatatatacttgaaatatggtgtagtaaataaacaccatttagagcttctcattttgggatttgaatcctggcttctccatttaccaaatgaatgagctattcaacatctctgagctcctgctcacacatctgtgaactgggagaattaatgtatactcttataaaccactgtaatgagaactgagattctttaaggtgcctatcaaggaacccagcactacatgtttatttcttgctttccttatatcctgctatacagcactcactaacttcctgcttactgtttaatctgcatggagtggttaatgtgcttctgattgattaagtgccagagttgggaactactagagatgagcagtgtgttaaaggggaaacctcatttgctcattatccagggtggaggagtggaatgaactgggtcattgtggtctctcttgtcagaggaaggggagacaattctttgctaaggagtgaaaggactgctgcagtatcacagtgtctgcaggggggatgtggatttcttagaacccgtgggatctctgttgggagggtgggtgacagattcactggctgttttagtggtacatggaaggcaggaacagtaaaaatgtcgtgtttcaaattttataagttttgttacgtatgttggttcaaaagtggcactttttgttctcattttgtctatggaaattgagctgggatgcctttgtgttgtctcttgtggtcccttttcagtctcttcaaacccgctctccagactgctaacacagtgatctatctaaaagagccaatctggccaggtgcggtggctcatgcctgtaatcccagcactttgggaggctgaggcgggcagatgacttgaggtcagaagttcgagaccagcctggccaacatgatgaaaccctgtttctactaaaaatacaaaaattagctgggcgtggtggcgcatgcctgtaatcccagctacttgggaggctgaggcaggagaattgtttgaacccaggaggtggaggttgcaatgaggagagatcgagccactgcacttcagcctggatgacagagtgagactctgtctcaaaaataaaacaaaagagtcaatttgttactccacgcttaaaatcttttgagagcttgtgttttttctcaggattgtctgttctcttgtttggcctgacttctgcgtaactttcaagctccgtctctttccacattccacctccaagtccatgtccagtggcttatagttttcttagcatgtggtgccacccagctaatgaatacctctgtgcttttgttcctttcccttctacccaaagttcctgcttcatctcttctacccccacatttgtaaggctcaatctttaataatgagtttggatattgattcctcctggatgccttttgtgactattcccatgtctcccacactcctgctgtcttccaagacatcatgtctatagctctgttaaaggactttttagattaatacttgattgaatgtctgccccaccacgcttacccagactgtgagatccttaggaatctgtaggattaagcaccatgcctgggcccaagtagtcaagaaactgtccatttttgttaaattgaactttgtcttcctgcttctcagttggggcctgcagatggctttaattgtttatccagattttccctggggggtctggcccttggtctgctttctatcccctgtgaagactgcatgttgtgtgatatgtgaatgttaacctgatcttttcattgatatcagggttaaaggtgagagaggggtctctgaaaacagaagctggggtagaatttaactgcagaatgtgttgggtaggcatagcaacctgatatttagtttcctgtgttcagatattaattgagtgcacgtgtgtatatgtaaaaagctcctttgtgatagtgtggttaaggagaaaagaggaaccacacaagtgagagaggcaattagagccaacctgttccagttcgctggagcaggctgttgatttacctttttacagtgctgctgcaggattctggagtgtagcagttcgcatgtattaccaccatttggggtgagaactatttgatcagctagggaccttaacctttctcttctcaaccagtgaatttcatcggatactatagctttattttttattttttattttttttgagaccgagtttttgctcttcttgcccaggctggagtgccatggcatgatctcggctcactgcaacctccgcctcccgggttcaaacaattctcctacctcagcctcccgagtagctgggatttacaggcacccaccaccaagcctagctaatttttgtatttttagtagagacagggtttcaccatgttggccaggctggtctcgaactcctgacatcatgatccacccgcctcggcttgcaaagtgctgggattacaggcatgagccacgtgcccggcactgtaacatgtttttatggatctggggaaaataccaagcggagacacttcacaatacatggtatttttcacatcactcatattggatatgtttgaaaataaggaagtctgatagtgttcctttaaatctcagccttggcgatagattcatagaagtattttataagaattctctctggctgttgttctcccctccgacttcactttcagcttctggtttggggtcctgtataatccttgcctgttccagccagtttagtagggacctctttagctgcaaatgattgtacttcatagtgcctctggccttttctattctaaatgaataaagagaattctgagaagggaatgagagagagcagcctgtaatatatcacttccttctgacatgtcctgcacttacgtggcatctagaaatttctgccaaaaattcaaggcacaggacacatgataaataccacttatgaagtagatgacattcttgaattgtcaaatgatggtgatggaataactgcttaaaaacctgttttcccaagggtggaaaacagcctttgaggtttagacttccacatgggtgtgttcagccataagacgtgggttttcttagggacttaggtccccaggtaacaccttggtgtgtgggatttttcccatgtataggctggttccttggtttctccgttgttgaagaagagagattttgcactgggtattggatattttattccaggcatgtggtttttgaggaggcatattgttgatgtattttttttttctggctgcattgatttttgtcagattctaactggaaataccacaagcaaagcatgatttatcatgagggatgggtggtgtggccgtgggactctcctagctctggggattggggtggaggcagaagctatgtgagtaaaactagaggaactacagacagggcctggggagactgggggtgtctgaatgtggcctgcagcagttgcttgagttggaatacttttgggcagaggctcatagaaatttctttcaattgcttttttttttcttttaagaagctttttcccatacaaattggaattgtttgaaggagtgggccttaattgttgccagccagagtgattttcaaagcagatctatatggatttcacttaggggttactttcagggggtatgtggcttgttctgagacaggaggacgttggttccattttcctggaagttgttgggactcctggatggccctgctctatttgtcttgggccattaggcaagtggaaaagcagctacatagttagccctgttgcatggagtttagtttcataattcatcctctcagggatttttatacagtcacacttacagcctaaagtttgttttctccctttttctttcttttccttcttcagttcagtggtccacaaaaattcttgggagggtaagtaataatttcgggtaaaaggcaggaattgtagatctttttttagccccctgccccgattaaatttctccatattcagcttctccttcatctgcaaaagcatctgcaaatgaggtcgctatcccctaatcagactggcttgtcccctaattagtctgaatatgtggctttgacagctttcacctgctgtttcttagtttctaggggataagataggattgtgtgatttcaaagtgaaaactggcaaaattgaaagatgttttgtggtggctcccaacatccacaaagcttaactcattggtttgcttctcatatacaagcttccaggaacatggttactgttagtggctggcacagtgggtttgaagactttgttggaacttcaggaagtttcccctttggcaaagcttacagggagttggtagtacttgtcctgaaagtctgaccctggtcttatgctatgcacaccttgtttaaaagaatgcagagtactgctattcagctattgcttaagcagtccgtttcatatatgtctgcattagttacatacttacataagattttactatgttttgtgttatatttgaactagaagtcatagtttcatacatgactcttattaagctgataataaattggcaaattttgatatcatccaagactttgaggtaatgctggtcatactcaaaaggtctgtatttgggtttagaaactaatttttctgttagctagcgcctctccattcccaggtgctgttcattactcattatagacatcttctgtccctctgctttgttaaaagtctttagctgcttgtcatgatactgaatagatctttttgcagcagcattttagctctgagctggctgtgttttacagtgttggagatcagttggttaactttggcatttcctaccttcatacgtaagcattaaagtgtgttaagtgcatgtagtagcccttcagagaggcgcttatcagggacttctagtgatttttgtcagctgtataaaaatgctatgattaatagataacctgtatctgtgtgtgcatgcgcaattttcttttatgcttactctgcgtttctttctctaggagtggtgtgaaataagtgttactctgtaggctttgctttttttcaataatgagaagcttattttaagaatcccttatttgactttcttgagtttggtgtaggtatcatttaccccttttggattttagctttactatgggttattttttgcagtgttagaagcaagtagtaaatactttggtatccccgagcttaaagaaacctaaaaattttgactcattcagcattctgttttaagttaggaaattatttaattctagtatcccaagctgtattgtattgattgctctttaagaaatgataacaggtggccgggcgcggtggctcacgcttgtaatcccagcactttgggaggctgaggcgggcggatcacgaggtcaggagatcgagaccacggtgaaaccccgtctctactaaaaatacaaaaaattagctgggcgtggtggcgggtgcctgtagtcccagctactcggagaggctgaggcaggagaatggcgtgaacccaggaggcggagcttgcagtgagccgcgattgcgccactgcactccagcctgggcgacagagtgagactctgtctcaataaaaaaaaaaaaaagaaatgataataggtatcatcctgcccatgccccagccccccaccaaaaaaagttaaataactttggacattagaattaaacacattaaaaaaaaaacctatcacactacacttttcataagcagacgttgtgatgctgaactattgtgtagcgttttccaaaccaggatttacgcccagattccctaccggtaagttaattcctaactctaaattcataaatacatatgtaatgaaatgtctccttttcatttctgcttcctatgtgtccctatcccctttaccaaacaagtaaccactgttactaatttgtctgttatcccccctcctttctttttgacacaaatattagcatactctctgtattttttgctccttgcttttctccatttcctatatcagaggctactttttcaaatgtaaaaaggtctattaaagttttcattagtggtctctctctctctctctctctctgtgtgtgtgtgtgtgtgtgtgtttgtgtgatgcttagtgaaggttttaccactctgagattataaaaaaatagaatggccttgcagacagacaaaccttaggtggtgtaccagcatttccacttcacagctgtgggatcttggttaagtgacttaacttatctaagcctcagctttctttgtaaaatgtgttataggattagtgtaagaattaaaaagcgatactgtatgtaatgtgcttagttcagggcctgacacgtagtaggtattctattatgtaatagccatttttattattattactcagtcctattttcttattcttgtccccaagtgctttttgaattctttcttaaaggcaggaacaatctttttcttttagagggtctcactctgtcacccaggctggagtgcagtggcgaaatcatagctcactgcaaccttgaactcctgggctcaagcagtcctctgcttcagcctcccaagtaggtgagaccataggcatgtgccaccatgcccagctaaggaaaaatctgttaacttttgtagccttgtgcccaggatataatataataagaactgagtagtccgggctcagtggctcacacctgtaatcccagcattttgggaagccgaggcgggcgaatcacgaggtcaggagtttgagatcagcctggccaacaggttgaaaccccatctctactaaaaataaaaaaaatttgctgggcgtagtggcagacacctgtaatcccagctacttgggtggttgaggtaggagaatcgcttgaatttgggaggcggaggttgcagtgagccgagatcatgccactgcactccagcccgggtgacagagtgagactctgtctcaaaaaaacaaacaaaaaaaagaactgataaatgtttgttgaaaaagatatattagcccttatacaatctatttttttaaatcttaataatttgtgttgctttttctatagtcaccctccagatttgaagcatggtgactaaaattgctcgtaatactcaacaattacatttatgttattattatttttaagagatattcttagtcactcaggctggagtgcatcactcaggctggagtgcagtggtgggatcatagctcactgcagccttgaactcctcaagcgattctgccacctcagccttccaagcagctgcacccagcttccgtgttatgttttacagtttataaaatgctttcgtgcaggcccttatttattctcttcaacaaccctgaaagataggtgatgattcttcccatgtttcagctgaaaatatacctctctaagcctcatgactaggaagtggcaaagctgatgcttttacccagatcttgtggctctttatccagtgccttttcatggcccttaagactgaaagggtatgactgatgaggaatggagcaaaaggaatttcattggtttggcatgccgtatatttaatattgaaaacattttacctgttacctgacagctgattcatgtagaactgggatgacagttgtggtatgcatgatagtttgtcgttgttttttggctttttttcatctcaaagttattccatctctaatttagatcaacaacagatcaatcagtggattgataatggtgggtagtataaaatcatcagagctgaaggcatctagaaattatctgtaccagccctctgctttagtcatggaaaatagtcagtatactcatttttatagacagtgtatctcaggctcagagagagaatgtgacaacaaacaataaactcagactttgtctttaaggctcagtagaatctttcatttcttagtctttttatttcttggtgtgatttttttctgacagtttcttgtatggagtattttcttcttccttttacattttcttaatgcatatatattcacatggttaatgattcaaaatatgcaaaatgtagaagagtcaaaaatctctccctctcctagctgcctattttatctttttggaagtaactagtattgttagttatctgggtgtccttctagagacagtgcctacgtaatatttcttttaaaaactccattgacagtatgcgtactattctgcactttgctttgcttttctatttggaaattatttcgtatcagtttatatatgtatatatatttttttctatttattagctttctggacttaagattctggtctactgagagaaccatgtccaaatgtcccttgtaaagatgactgattagtacaggacctcaaataatatgattctgtgttttaatggaatcatgaaatcccaggattggagacctaatctacatctcttgttttttcacgtgaataccctgcagatacctgatgttgctaccttttagagatgtctgagtgaaagataggtatcctcgtctctccatgtgccccagtcagctgcccctggtcttttttgcactggtggggcacattgtgggtcagctatcgtatatgtcattgagttagtaattatactcaggatctgccatgagtcattgcacatggaatctaactgcagtgtgagttttattcatgatgacatcttgtataccagatgtttcccagatgcctaggtttatcctgattgagtgtcactgctgtcaggatgctgttcagtgaactaagttttgtgttgaattgtgagaaaggaaggtttagtttctaataggtgttccatctcagcagccataattgccactggctacccttaacccctctgtctgtggaaagccccaggattgagtgaatgctcttcttccctagggtatggcctctccgtaactgagacttgatgggaagtaagtagatttggctcaacaaatagagaatataaacacacgtgtgtgtgtgtgtgtgtgtgtgtgtgtgtgtgtgtgtgtgtgtgtactgaacagtaattggattctgattcagatgtggagttaatgatatcaaacttaggcttgactctagcacagttaatctttatagacttccacatttaaagatatgaaataaaatgtgcctttcggagttggcttttgcaatagccctttttctccgtgagaatattatagaagaggtagtattctagctgtttagagaatgagaatgaggccagtggggttgtgtctcactctctaggtgaatgtcgacctctactcagttctaatctcaccgtgcagtctttgtggtcccaaggctctgcagtaggtgaattaggcccgcgcagtctctgtggcccgagtcacagaggaaggtgttcctttcccaagtagtgaatggaagccggcagggcaccagatgctgtgttgtttcccctgttgctttttccttcacacccggtgtaaagtttccaggcatttgtgcaacctgatagcagaaagcgcctgtcctagcagtcgagagatgggttggcaggggctcaggttactccatgtccctgataagagccatcgatctgggctggtggctgctgataggtgggaactatactgcctgcattctacccagcaggaatgatgtgggtctcagtagtgtttcaggactccgagaaggtacccaggcaatttagaggtctggccagcatctctagggcagcagcacacactaagatgtagattttaccttagaagagatgggttttaggaaatggtggcacacaggagcggaagaagtaccagcataggaaaggtgaagtgccaacccgaggagtggaaatggtattttcttattccacctggtaacctaaaactcagttgcgcagtgacttaaatttgcagaggatatgtacatagataattttaatacactgcttggatggaaatagtcacagaatatatgtgaaagtgtagtggcaggtggctctgtggtaatagatactctgtgaatacctctgtctgagcagttatcacactgtattaaaatatttggttaagagggccctttctgtctgggcacagtggctcatgcctgtaatcccagcactttgggaggccaaggcgggtgggtcacttgagcccaggaatttgagactagcctgggcaacatggtgaaaccccgcctttacaaaaaaacaaaaaacaaaaaaaacgaaacttagatgggcatggtggtgtgtgcctgtagtcccagctactcggtaggctgaggtgggaggacctcttgagcccaggaggcagatgctgcagtgagccatgattgcaccactgtactccaggctgggcaacagagcgaaaccctgtctcaaaaaaaaggaaggccctttctggtaccagaaattctgtctctaatcttacttagctgtgtgtcctttaggcaagttacttagcccctctgtgcttcagttttttatttgtaaaatggagataataaatgaggcttgtactaaatgagtcattacagttttttgtgttatctgttgttatggtggttgttatagcacaaagcacgggcgccagagaccatggcaaacacatgatgactggagggctgcagagttcagtatttattgtgttcactgaaagacttctagtattaactatgctgggtaccatacagaagcaaatgcatgagatattaactgtgtgactgtaaaatatatgacgagagtcagttttttttgaagctgtgtagaaagaatattgatgtgagaagtttcagtatcctatggcagtttcagagaaggaatcttccttctttcctttgggaggcccttcagctttcttggtgttttgaagatagattgtatattttactttaaggtaggacaatacttaactatttcagacaggtatgaatctttcctttttttttcttttttctttgagacagtgtctcattctgtggcccaggctggagtgcagtggtgcaatctcactgcaacctccccctcccaggttcaagtgattcttatgcctcagcctcccgagtagctgggattgcagttgtgtgccaccacgcccagttaattttttctgtttttagtagaggtggggtttcactgtgttggccaggctggtcttaaactcctggcctcaagtgatccacctacttcgggctcccaaagtgctgggattacaagcatgagccactgctcttggcccctattttttgttaaacctctaggagaaaccattttagatcagaatcaatccattcatccatcctttcttcctaatctctcttcctttttctctaaaagggaaaaagtgctaacattttaaacactttggttatttatatttaatgtaatcctctcttattgtgtaacagccctcccccttcttttgcttggagacaaaatttgattgaacaaaatttgaatgtttaccacatgttaaacattgctagatgctggggttagttacagagttaatggaatgttcttataaaacttgagttttggggaaggtttatggaacaactataaaattagaataaaaatttgataacacaatggtttgataagggtgtgagtaaagaaataggaactcatattgctgtggtggtgaaaagtcacataacttccatgaagaagtatttatcaatgtctattaaaatgtaaaatgcacgtattctttgactcaacagttccacttccaggaatttatcctacagatgctcttgcatctgcgtataagaatatacattatagcattatttgaagtagcagaaggttgaagaaacaaaaatgctcgttgacaggaaatctgctaaataaaataaggtacattcttgatgagaaaaaaaaaggtacattcatacagtggaatatcatgtagccattaattaggcagctctgtatgaacatagaacactctttaaatatatcaattgtgaaaatcaaagtacagaagagtgtatagtttgctgttatttgtataaagtaaaaaagtatccgtgtgtgcatagactctgccaggaaacacaagactccccagcggttgcctcctcggaggagcattgagagacagaggaataagggtataggtaaagacttaatttttattgtatataaaaaaatcataccaacaaaatttgttaattgtataccttttgttccttttgaattttgtattacatgcatgtattacttgttttaaaaataaaataatgtattaaaattacacagggataggtactgtgtaaacatagggtttatggtccttaaacttgctaattttcatagaaatgagtcaagttgtgtgttggagaaaaagtatgccaattctgcttaccacaaataaaaaatagtacttgtgtggtggcgcatggtcattttgtcattttgattttgtgtatgacattgtttattctatgtaggatattccagtacttatatttacttattatgtatttatattatatatatttatatgtttgtatattagctatgttttcttacattttttatttactgaaagtgctgatatggaggggtagataagagatgattaaaaatggaaagtacattagaaatggtgaatgtgtatacaagatgaatcattcaacaatacaattataaagggtcaagtgcaaatcataaagtggattgagaagaagcaaaatgagtgagaatcactaccataagcctctcccttgttcttaagaaatgtcccctagctagacatgcacccatgggttacttggatttttttcaccttggaattttatgaacaaatggacttaggagcagcctttcattacagaacctaacttggtggtggatagaggagtgtctgtaccaagccaggatgagtagtgcttctatgggagcataatggaggaattgagggattcttatctggctggggtgggatgggcatttggagaacattctgcagaagctgttgctgcgtattgagtggataagcagggcaggtcattctagacaaaagaaacagtatgtacaagggcaaggtatgagaggaactgcaagtgagtcagtgaggttggggtggagggcatgcgagcaagggatttgcccaaagtgtcgttggtagttagttcatccgcacactgctgttctcttgcaatcatgtaggaccattgttcaccaagctggctgggcactggtgattagattctcctaccacttcagaaacatatccttataagggtagatggaggaatatagtctttgttcattaaggaaaaaaagagaaagcaaaaaagaacaaagaaaatctgtatttggttatgttgtacatatgtagttgtactgacttccagcagactatcttattttctttttctcatctgtctgcatccttcaagaaactttccctctatttggaaccacaggttgagtgccgcatggacacaacttgaatcttatgttctgtttgattatatttgaatttacatgaagcactttctaccatgcaggcatgcattttgctcttcatagcatggaatgctgtaacaatgttgttttgtccattagaggctttcaaaaatttttatcaacatttaagtgcttaatttctacagtataccagggctggcagtaggtaggcaggtgatattttattcacataccctatatatttgcacattttgattgctcgttctgttaattaaggagagaatttctcttttgtagctgaaatgttttatgctttgaatccactcaaagacaaattattctggaaagcttgaactaaacctggtcagatgcttctgagttatgagagagggattgaaataaactttttcagctaaaaataattttgctcacaagttaccaaaaatggctgactagaaatgcttttaagatacttgtctaagctaccataagctaaaggtcaagaaaaaagtttagaacacgttatgagaaacgattggctctactttgctaaagcttttgccaaacctcttattctgtaatgaccacatgagacaaaagctggtgaaagtggtatgccttagattcagtggggacctagagattttttcagtggaacacatgtgctgcctatctcttctgacgacgaactagtacctgtggaaggcactagggttaggtgaaaatgggacacttcattctgaagctgttatacaattgcctatgccaattaattatttaaagcttttatcttctgttgcagagcaatttttgccctcagaatatttgtcagtcctcacaaagtgccaagtgatgggtatttagcatgtggcattgccgtcagtgttctgtcattttgtttagacacttctttgcatctcactgaattgcagaattaagaatcgttcacatttatgggcagcacgtttttgcagtatggtcatttatcattggagtttatattttatgcttccttctagactcttagtgtgctttcacgattatccagaggattcctttgcagcagcagtgtatgccactgattggtggtggtagccttgagaaactagggaggcatgttgactttccttaaggttgcttagtattgtagaataaaatcttgaattagagtaaaattcagagagagctgtttttccccgtaaacatcattcttttgaatacagccagtattaagccaggatgcgttttcttcctaaatttaacacgtatttattgagcatctaatgtgtatgaggttatgagaagggaagttgaatgagcttatgttagaggaactcaacctttcctcagagaatgggagtctgcaggcagaggtggtggtgttgacacttcgaggagagtgagaagttttagaagtagctgctgttcctatgtaataaggattcatcaagaagtgggatgaaagggttgctcagtctcagtaagtgccagctgggattgagttggtcctgatggtttaacttttttttttttgagacagagtttcactcttgtcgcccaggctggagtacaatggtgtgatcttggctcactgcaacctccaccacctgggttcaaatgattctcctgcctcagcctcccaagtagctgggattacaggcacttgccaccatgcctggccaatttttatgtttttagtagagatggggtttcactgtgttggccaggctgatctcaaactcctgacctcaggtgatctacccacctcggcctcccaaagtgctggggttataggcgtgaaccacctcgcccagctgtttcttaactatcagacagtacttggaagcccatgagtgtagctgagtgcacgttacctagtgccaagtgtcaataaactgagatgaatgggttcaggtagaataagggcgtgggagaaaacaaaggacagcaggagcttttcctacgagtttgagatcttgacgttagaagagttttgggtagcaatgatgtgtaaggatccaatggatgagtttggtgtaggtagtgccccctggaaataagtaggttgaagaacttggagtctcagttttgaaagtgttgtcaacttgaatgttgaaacgatctaggcctaagcattgaaactctgggcaaattgggagaaagtcatggaggttggggaagtggaaagaatgatgtataagtgggttaactcagtgactctcaactgggggtgattttgtcccctcagttgacattggcaacgtctggagacatttttgagttttataattgtggaggtcttactggcatctaggggttggaagccagagatgttactttaacatcctaaagtgcacaagagagtctcccacaatgaagaattatctggcccaaaatgtcagtaatgctgaggttgagaaccctgcattaactttaaaagaacagttgttgagtaaaggcaacagttgttgaatgtgactgtttctctccccttctactctgctttgtagaactctgcacatccatttattcttccacttagtgaccatttatggagctccatttatgtgccaaggcaccatgctagatagtcattaggagtatcaaattaattagatgtcacctctttcttaaagtttatttttgttttttcccccttagttatccttgttctgattaaagtttatttttaactgtgaattaattaatatgcaagtatattcttaccaaaaagccaaaaactcaaacgtataaggccagtgaccactttgaccaccacctccaatatctgttcttttcctagaggtacccagtactgtcagcttggtatgtgtagctggacatttgaaggttgcttccctacatctaattttttcccccttttttatgccacgctaagaagtttaattttgaaaatttgtcctaggctgcaagtttcttaagatagggaccaggtgtttggtttttctttttgaattattacaatacatggtacacagttgtcactcaataaatgtttgctgaataatgaatgaaatgaatcaataaaagaatgaatgaggagcaaaaagaatgccaacgcctagtaatggccttcaggctttggaaggctgcaaagtatgtttatgggaagaatgagttaatatcaggatgtgaaagaagaaaagggtgaaggaaaattccaacttgtaggaacagagaaggggttaccagcaggcccagttgataagctggtcagaagacaaagttgaagtttgagaaggaacagagatcttcattgtataggggataagagttcaaggagtgtcttttgaagaaaggaaggtcttttgaagaaagtaattgcaagttagcgattggaaaaacttactaaggtaggagctgcttagaactggaagagtccgggctgggcgtggtggctcatgcctataatcccagcactttgggaggccaaggtggggggatcatctgaggtcagaagtttgagaccagcctggcccacatggcgaaacccccatctgtacaaacatacaaaaaaattagctgggtgtagtggcacatgcctgtagtcccagctactcaggaagctgaagcagggggatcacttgaacctgggaggcagaggttgctgtgagctgagatcgtgccattgcacttgagcttgggtgacagagtgagactccgtctcaagaactagaagagtcctgaagttctttctggagtattggtgtgatagaagcattagtagtttcttttatgttctggagaacttctgtgcacataaatgtttatagatatataccccgtttgtataccaaaggaatcttcattatttttcactgaacaaaacaccttagagaacatttcgtttgttttgccaatcaatctaattcttttaaatgaccacatagtatcccacggtaagtttttttgtttgttttttttaaaatcatgatttgtttaaacatgtcctattgctcgacatttaggtcgtttccagtcttttgctatttgaaacaatgctgcttgtatgtatgttgctgtgtgcataagataagcacaagaagacggattctgagaagtggaattgtgtttctaagggtctgcacattttaacttttcataggtattgctgagtatcagagggacatttttctattatgttaccgtactttcatttttcacaagccgaagtgaaaaatggtatcttggctttttaatttgtttgttgttgttgttgttgttttcttttttcttctgtttttgaggcagagtctcactcttgtcatccaggctggagtgcagtggcacaatctcggctcactgcagcctccgcctcccaggttcaagcaattctcctgcctcagcctcccaagtagctgggattataggcgcctgccaccacgcctggctaatttttgtatttttagtagagacggggtttcaccatgttggccaggctggtctcgaactcttgacctcaagtgatccgcccgccttggcctctcaaagtgctgggattacaggcgtgagccaccacgtctggcccggcctgtttttcttttcttaagacaggatcttgccctgtcgtccaggctggaatgcagtggtatggtaataacttactgtaaccttgaattcctggactcaagccatcctcctgcatggacctcctgagtagctaggactaaggcatgcactactatgcctggctaatttttaaattattttttgtagaaacagggtcttgctatgttgcccaggctggtctcaagctcctggccttaagtgatcccccacctcaacttctcaaagtactaggattacaggcatgagcccctgtgcctggcctaatttgtatatttttagtttaagggaatcttttaaaaaaacatttctacaaatcatttatatttcttttgtcataaactcaggttcaaaagaattgtttttttcttattgatatgtaggaactttttataaattaatgaaagtagtgtttgtcattcatgttgcagtttcccattcagcttgtcacttgtcttttggatttgtttgtggtgtatacatgtatgtgtacatgtatatacatatagtgtgtgtgtgtgtgtgtgtgtgtgtgtgtgtgtgtgtgtgtgtgtgtgtatgttttggggccagagaaaaacatttgaatgtaattaaatatataaagtgtttattttaaaactcttggatcttctttctgagaaggaccttctttactctgtttaaaaatagctttctgtgctttcctttagtactttaatgggaaaaccttgggtttagttttgatgctatcatttattagttttgtgactttgtgcaaatcatataatctgtcagaacctcagtttcctaaactgaaagggttagatcaagatgatctgtaacagtgtaaagaactttcatttctaaaatttcttctttgcttttgagtaggatttaacttttgtgttatgtggagatagggagttggagacaggttaagggaaagatgtcaagaggcaggcaaaagcagaaagaatcaggactgtgaacaaatgaacaaacaaaaaagagccccgagaggatagaggaaaaacgaaggaaaacagatgggaggtagatactgagaactccggtggaatgcttttttcctatcacaggagataaaaaaacattcccgggtaccttgttcattcaccttcccacccttcgtctctctttttttttctttcttcattccatccctccctgatttccttccatttttttctttttcttagaataaagtcaagtgtaatacaaaggctgttaattagcaccaatcatgaagtgcaaaagttaaagcttcaaagtcttattcatgttgcacatatgtagtatttaaagccaagtgccttgaactccttggatacagtgtgtgttggaattgctattgatctattgtctagcaatccctctgagctctgaaactttatgtttaaacatagtgtgttttagcattgttataagaaatacaacttttgggccaggcacggtggctcatgcttgtaattccagcactttaggaggccgaggttggtggatcacctgagatcaggagtttgagaccagcctggccaacatggcgaaaccctgtctctactgaaaatacaaaaattagccaggtgtagtggcgggtgtccgtaatcctagctattcgggaggctgaggcaggagaatcacttgaacctgggaggcggaggtaacagtgagctgagatcgtgccactgtactccagccagggcaacaagagtgagactccatctcaaaaaaaaaaaatatatatatatatatatatataacttttatatttcttgatttggatgttaaatatgtaaagctaatgatgcattcctgtatgttttatatttcatgtctaagacaaaagttccccctgtaaattatgccttcaagaaatctagtttctgtctttggatacatgtcgtctgtgaaacctcgagctaggatttgtaacttcttccctgtctgcctctgtctgctaagcatggacagtagtacctatgcaacagtgtgtgtgcttaaccaaaatcctcttttttcccccatgaacatgggctatctttctgtttatgttttcaatttctttgatcaacgttttgtagcttttagtctacatatctttcatctcctaaccaaaattcttatatgagaagtccctctaaagtataatggtcaattattttcatcacttatttttatgtttttttagagacagagtcttgctctgttgccaggctgtattgcagtggtgttatcacagttcattttaacctccaactcttgggccccagcgatcctcccacttcagcctcctgagtagctatgacaacaggtatgccactatgcctggctagttctaaatttttttttttttttttttttgtagagacagggacttgccatgttacccaggctggtcttgaactctcggcctcaagcagtcctcctgccttggcctcccaaagtgctgggattacaggtcatcacttattttttaagattcattttgtacgttgccattagaccataattattattaattttttcttgttgtcttggttggagaaaaaaaagtaaaaaaatcccatggttactaccatgagcacatttgagttgaatacattctgaccttttagctcatgttcatctcctttcacagacccctttttaccctttcaacctcatggatactccagagctggcctgggacattctcatctgttggcttcctcatgttgcccttgaaaacagacgcctagacttattaaaatcattgttgattatcatggcagtggctgccactgtggctaattggaaaggaagttattgtggtcatcagaaatactgaaggagaaggggatgaaagtacaagtggctgtggcgacttagctatgttactgatagacttggctgttgtgacgaggtgcagaggctccagatgtcatctcataagatttgatcaaatgctttttttcttcctgtcttctggagggtggctcaccttgattgctttctcactttgtgcattttagattgaatcactccatctcactcttgcactcattttatatgaaatataacctaattggccaggcgcggtggctcatgcttgtaatctcagcactttgggaggctaaggcgggtggatcacctgaggtcaggagttcgagaccagtctggtcaacgtggtgaaaccccgtctctaccaaaaatacaaaaattagctggacgtggtggtgcatgcctgtaatcccagctactcgggaggctgaggcaggagaattgcttgaacacgggaggcagaggttgcggtgagctgagatcgcaccattgcatcccaccttgggcgacaagagcgaaactccgtctcaaaaaaaaaacctaattaagaagtatcattggatgttctctatgtgaggtagtgtgtgcaggaaatgtaagatctaggagatggtctgtaagggcttttgattgagttggttagatgatatacaaactcagccaaaattaaataaggtaagttgatggtgtaaaatatggtatagggtcataccttgctattgtattggtgggaaagataaaactatatataatataaaattgtatcagaatttagtataaaattctagatttgctgtacacttggaaaggagaagcataaaggagaaaaagagggagatgcaaaatgttagctaaggcaactgaaaaactttttctgacttttacatctttttaacaaagatgtcattattttatttttttgagacagggtcgcactctgtcacccagtctggagtgtggtggttcggtcacggctcactgcagccttgacttctcaggctcaagcagtcctcccacctaagcctcctaagtggctgggactacaggtgtgccaccatgtctgggtaattttttatttattttttgtagccatgaggcactatagcctaggcactgtgttgcccaggctgattcaaactcctgggctctagcgatcttcctgcctcaacctcccaaagtgctaggattataggtgtgagccactgcatccgacagttattttaatgttaagcctgggaggccaagggaagtgttcctttggccttgggagctgactcagactttcctctatactccctccgcatctcagttccttccactatttacaggatctcctgtggctctctttggcaattagttgcaagaggtcttatatatattgaaatgagatggaatgtaaatacagtatttaaaaatatttgtggaagaaataattgaagttctgtagtgacagggccacactagggagcagagaatgcatagagggattttgaacctttgtaccttactttaggaacagtgttattgatggcaggtgggcagctgagagagttagaggagattttgttggcttttaaatatatctctagacttctgaaggcagcagttcttctattctcatgtatggtttggctggtaaattttaaggtatgaccgcttctattgtgtgaatgtctgaaagaactgtagaatccaagactgaccactgaggaatatgtgttgatcaaaaccatttgagctgtaagcccagggattttgaagggtggatgtctgggtgtgttaagaccaggtagaggagaatgcttattagtttcctaagtctcatattatcagagcccattaaatcaatattagtttgtatcaaatgccagtaaatccctattcttcccttacctatcaaactctgagaagttctttcttaggaaaggtacctgctcttcattttaccacagtatctggacttgtggtgtcagtcaccattttcttcaggacctcaggattgatgtgtggagatctacatctttttggctgataggaaaggggattagacatcctaaggctggttgccctctagctgtgcaaataaacactcttctgacatttcttccttaatcaacaaagcatttataatattatcgtgtaaggaaccatagagcaacctctctttccttggggctatttctctgctagatctcagcagcctcatatttcctggtgacttttttttctctttttaagagctttattcaagtcaaaggtgtcttgcctttacagttgcctttacagcttttttttttcttttttttttttttgagacagagtcttgctcttgctctgttgcctaggctggagtgtagtggcacaatctcagctcactgcaacctccacctaccaggctcaggtgattctcatgcctcagcctcctgagtagctgggattacaggcacttgccaccatgcctggctgattttaatagagatggggtttcgccatgttggccaggctggtcttgaactcctggcttcaagtgacccaaccaccttggcctctcaaagtgctgggattacagatataagccaccgtgcccagccttacagatattttttttaagataattctttcctcacctgttggattcttgtttatcctgtaccgtgggagacatatgggtgaggggaatggtatcccccatagtagattggataatgatctcaggaggtttttattggtgaatcaattattattttctttgttagaagaagaatctttagtaagaagggagaagaaacttttcatttgggagagaaaataaaaacaagctttgctgaggccagaatgggatcatgtgtaataaactatgaattcatcctctttttcctccttccctcctagttgcagttgatctcacaacagctgtttccagctgtcctctggattttgcccaggccccttgggatggctgcagtgactcacacagctgggcttttttccataatcgtctgaatctagctcctcaagaagcaggaggaggaggaggaaaagggtgacttggttgcactggaagagattttcttgttggtgtattagtccgttctcacactgctgtaaagaactacctgagactgggtaatttatgaagaaaagagatttaattgactcacagttccaaagccttaacaggaggcatgactgggaggcctcaggaaacttacaatcatggcagaaggggaagcaagcacatcttaaccatggtggagcaggagagagagagagtgtgaagggggaggtgccacatgcttttaaacgatcactcgagaactcactcatcctgagaacatcaagggggatgtctgtccccatgattcagttacctcccaccaggcccctcctctgacacgtggggattacaatttgagatgagattttgtgggggacacagagccaaaccgtatcagttggatcactgtctcccggcaggctctgggtttggtttattcttgaaagctatgatcctaggagataacattgccggcggagaggaggcaaatgtgttaaatggggaaggtttttgtgtttggagaaaggcaaatgttctttcactcagtgtttttccccatttatttccttccaaaccttcttattcggaacaaactgcatctttccatttcaaatggatgtagcctgtgtatgagatgaatgggtgactgaatgctgaggggaatatcacgtaaaaaggtagatgatgttctctatactctgatgattggttttgatgttttgtaggaagtattagtttcttttcagttcttcaaagtagttgttcctctttctaacagtaagcactgtcctttccctctttcttttctttcatgaaggctgtcctttcccagcttgggacctgctcaaatgagatatctcagtaaagacaataaaaaggatcctttagttatctaaaacattctttacttttgcctccctgggctctacactcatgtttctgaaggggtaacaggctgtagaagaaatcctctagacttgctgtgtaatatggtaatacggtagccacatgtggctatagagctgcactctcaggccgggtgcagtggctcatgcctgtaatcccagcactttgagaggctgaggtgggaggatcgcttgggcaacaaagtgagacccgcatctctgttcttatatgaaattataataaaaaataaaaaagctaggcatggtacctcacgcttgtaattccagcactttgggaggccgaagtgggaggatcacttgaacccaagagtttgagaccagcttgggcaacatagagagaccccatttctacaaaaaattaaaaaattaactgggtatggtgacacaggcttgtggtcccagctacttgggaagctgaggtgggaggatcatttgagcctggaaagtcaaggctacagtgagcgatgatcgtgctgctgtactctggcctgagtgacacagtgagaccctatctcaaaaaataaataaataaataaataaataaataaataaaatgaataaataaaaggatgcactcaatgtaaaatactatacactagatttagaagaattagtacaaaaaagaatgtaagatactatgttgagatttttaaaatattgagtatgttttaaaatcaacatgttgaaatgctaatattttaactgtgttggattcaataaaatatattcttaaaattagtttcacctttttttttttaccatttttaatatggctactacaaaattttaaattacataatggcatatatttctggctctcattatattcctattagcttgctcaaactagaaggggaagttactacaatactggtgtgcttctttctggtagtccttgttttcagaactttggagggacctttaatgatttttttgtttgtttttttgtttttcgagacagtctcgttctgtctcccaggctggagtgcagtggcgcaatcttggctccctgcaacctttgcctcctgggttcaggtgattctcctgcctcagcctcctgagtaactgggattacgggtgcctgccacagcacctggctaaattttgtatttttagtagagaaggggttttaccatgttggccaggctggtcttaaactcctgaccttaagtgatctatctgcctcgacctcccataatggcagtttgggattcataacacagtgcactacaacataccctccctattagttatttctcgctgtgtaacaaattagccctacacttactggcttcaaacaacaaacacttattatctcatagtttctgtaggtcagaaatttgagacaacttagctgtgtagttctgtcccaggatctctcatgaggtttcagtcaagcttttgactgggctgcatttatctgaaggcttgactgaggcaggaggatctacttaaatttttgctttatgctgttagaagcaagtctagctcctcttaaggggaggaaaagcaggacctaccttttgaatggagtagtatcaaatactttgtgagcatattttaaaaccattacatccacctttattttctgctattttcccctgttaacatacctgtgttttaataactgcctctgatgatggtcagagtccagtggctaaagttcattttaccctcagctgctatttcagtattacttggaacaattcgattcattttgatgatgcaaactctgacctgtaatcaaaatggtccttttgaggcgcaaaggtgaatttagctttgcttgggcttttaacacttgtatatgcatctgtttatgtcctttctgtcttatgtgttccttagttgattcttagtagtggaataaagctgtttggacattacatggtaaatatgttaaaaccagtattgtattatgtttttgtatgttatgttttgcttgagattcagagcacttaataaccattctgtatctcatcctacctctgagaagtttgaaagtaaagcaaggtatcctgttttctgcctccaagtagggaaagggaggggagttcatttacatacgaggctgagtggaagatgtgagggaattcagagttgtaaggcagagacatagatgtttccaggagtgggttcatccttactaaccttcatcttgtagctgttttgtttttggcttagcttcgaacttctgaagtttatactgaagcaagaggcaagacgtattggataaatgacccaggagacataatcagtaaaggtaaatttccatctgctttgggtcaaaatggagcttttttataaggaaactaggtatcataatgggaagtggttgggttatgagagggttcaagaatcaagagaataagtattcagttaaaaccatttgatttcattttttttctggtgttttagtaagctttaatcaggtatttcctaaggaatttaaaattatctcttaagtttgagaagtctgccgggctagatgaatggattgttagtttgttgccttggacagagacttaaagaactcttgaatctacattctgttatcttctgtatccttgtcatctttgtcattagttgaatacttaaacatagtttcgaattgttacttgtgtgtgtgtgtatgtgtatgtgtgtgtgtggttatctgttgtctctctaagcagagttaattttcttgaggaccatgccttttatttctttgcgttccctctgctagtaatgatactttgagttgtatatttcagaggatatatcttaagcatattggcaacatccgctggtgtggcaaggtaagagtcaagtggagctcagtggttaagagtttggggtttagagtcctattgactttgctgtttaatagatttattaccttaggcaagtttctcaatttctctgaggctcagttccttcatctgtaaaatgttaataatagtttctacctcacagagttgtgagaactaatgagatattgcaagtaaagcacttagccacaggagtggttacatatattaggtgtgtaaaaaagtaattgtttgatttgttaatttttatttttgattagaggtatccaagttcttgaatcttgaggcctcatttttattagttcatcagtcattatcggaggtgccagaaacctgaatctggtgcccgttcttgtcagcctgagtcggtccacatcataagtaacttcattcagagagttttcttgtttgctttggcaaaatagatattttaggccgtggtttcttccttgcagaatctcagggttcttcctctctccagtgaccagagctgccattgttttcaatgtttggtaggtgacatggtatttggattaccctgttctcctctgctcttctgactgtgactcctaaaagctcacttaaacctggctgatgctgactcctgtccaaaggcccaagtcctcctgcctccctccaattttctgttaaggaattctttggactaattttttttatcttttaaagaaaccttgcaatacccaaacagaccattctttcaactctgcactccttggtcagcatccagaatgtaaatacttgtggccatctgtatattcctctgttgtcaggcctaactgactttatactttttctcttccattccgatcttccggtggctcctcatagactgtcccattttttcctgttgcacagtgagcaaacttccttcatcttcagcctcttaactgcatgttatttttactcctttctcttaactaaatttgttttctttctcaggactttacatcctctatctcccttctagtgggtgggttttttgttttttgtttttgtaatttttaaaatttagagatggggtctctctgtgttgcccaggctggtctcaaactcccaagctcaagtgatccccctgcctcagcctcccaagcagctgggactacaggtgtgcaacaccatgcttggcttagtgggtgtttcggtgttccttgttctcctgtattacagagattagtattctgttgttctctctctcccctctccaatgcttacataaaatcctatacccttgggtgaaattccctgttccttaaaagctcgtgtaatctggctagtctaaccttttcccttatgcagtactgtcatttattgttttgtccctccctcatttaaaaaatgaacaaaaacttgtagctcttggattgtgggctttcttcttaccttaagtattgctattgtcttaagagactccagtgtctgtgtggaagactgatccagcaccttagctagtcttatgtctggttctctaattaatctgtttcattgcctttcttctctttcaccaactattctaaggccacattttggggttagtcaatttagaactgcttaatttctgaaaatttaaagacaagcgtctcattttctcattaagactcttcagttctctcatttaattacccccactgcctcttttctccaatgtcattgagaaagccagtgcattggccctctctgtattctctccctttttgttaactcccctgtctttgctcccttccctgtcttgtttcgactttgtcgtccttctcttaaacagctctttggccaatatcctctctttattttcatttttcattgtatttttcctacctggcaaaactcagtacagctctctgccttcctaatatccaacctttcctagacccttgactcctgcctggtagtatttctgtgtgtgttttttgtttttgtttttgtttttagacagagtctcactctgtcaccaggctggagtgcagtggcacgatctctgctcactgcaacctctgcctcctgagttgaagcgattcttctgcctcagcctcctgagtagctggaattacaggtgtgtgctaccatgcccagctgattttttgtatttttagtagagttggggtttcaccatgttggccaggctggtctcgaactcctgacctccagtgatccatccaccttggcctcccaaactgctgggattgtaggtgtgagccaccgcacatggccagtatttctgtttttaagtgacctcttggggatttgccacagtggctgtttaaacatccctcattgtcctacatttcctttccttttgcttcccttcacttaatcttgcctcttaatttatagaaaccctcagattggagctcctttaccttcgtgccaccaaatttgagtgccacttttcgtcctttctgtagtgagttctacttggatttttcccaagattttaaatctgcccttctatatctttttttcatcaactttaaacaaaataaataaataaaatctagcacatttagttatctttaccctccatctgcttttcactctcctcccttctacaagccaccttcttaaaatagttgtctgtgccctttgagcccattgcagttctggttttctctttaaccacaacattgaaactcttttctccaaaatcaccattaacccccttgcgactacatccaatgaatattcctttgtgtcatctttgtccttggaatgccgctcttcccctggcttctcttgtaccatgctttttagaatttctccctctgtctgccagtgcatttttgttatcccttcctcagcccaccacttaaaaattggtgcttgaaatgattctattctaggtctttttctttttaattcttttaagttatatatatttctccttgggcaagctcatctattgctaaggctttatttatcatctatatgctgacaacttccaaattgctgtctgtagcctagatctctttcctgcacttaggatgtctgtatccacctgctcagtgtgcatctgtgcttggataccccatagttaactgcaaacacaacatctaaaactgattcctccttatctgctctttttaagaagagatggagttttgccatgttggcaaggctggtcttgaactcataacgtcaggtgatctgcccgcctcggtctcccaagatgctgggattacaggcatgagccactatgcccagcccttatctggaatttctgcaaaattctgtccttgtgtaactcagcaaccagtgccaccatttacccagctgctgaagctactgttatagcctcttaaatggtccttctgtctttaatttcgtccctcccatcccacatcattgcgttgcagtaatttttttcagagtgatccttctgaaacaactctgatcatctcactgtcctttagtcccactaaaagactttggtgatctggctcctacctcatctcccaccccttgacccgctcatgcatataccatgcagcttcacttcattccctctataacatgtctccttctaccctttatggcactaacccttacctttgagatctcggtttattggtcttaataaacctttgggaatcttttactgaatttctaagatagggttaggaactctcttgactgctttcatagcaccttgtacttttccctatttaggatttatttcactgtattataagagcctatttcctttgagctcctgccaaactgtaagctcttcgagggtagggactctgttttaatctttattttttctttttaaattcccagtatgtagcacagtacgtgatttatagtaagcttagtatttattgccatttaatggttgtatggattataggattttagaactgaaagaaccttatctgtatggaatatagatcctagatttgcagggtgaatgatcgctgtgcggttcttttgctagagataatcatttcaaacaaagtcatgttcaaaggccaaggtggcccccctttagggttttacctctggctttcactggttaagtagctctagttagtttgtttcaaggcttaattagaccagtgtttcttaatcttggctgcctgttagcatcctctggggagctttaagaaaaatactgttgccccaacctcaccaaataatttacagaataagttttattcttcttccgggaagtttgtcatccattttccaacttgctaaagttgatcaacagtggctttattgttctttgacaaaagaaaaggcatatcagactttgtattatctcatttttagatgcaccagtcagtaagcatttggcagttgggggcccccatctgtgaccattgggagcttgccttatgaacccttagatcctgatctgtgacatagaatgtgagcagaaagttccatctggtgtgattgctgcctcctctcatgggttctctggtttgagtcactgctgttgtatcacacgcttctttatgacaggctgacagattaattccctagaggctgacctgatgtaaataggaaaatttgcttattatcagtagaaggagcaggttatttaattactattcaattttagtgctatttattttttgcttttaggactgaaacatctcctgttcagccatttgaattttgaaaagttgttagttgcttttgataactttgaggaatcagattaatttttaaaatggtttttaaatgtatgagctcatgctaagtgcatttgtttgtggtagtaattgctttctgaaatctgttttctgcaactcagaatagtataatatttagaacttggtcactgtttttagaaggaattctgaaggaattgtaaagaacagcctaaatttgttcttatcccttggtttttctacaaacacaattttagtattgtggcattcagaagttaatgcattcttggtatgttgtttacaagtaatattttacaaatgtaagactgaaatatttgcatcagcgagtattgtggctttgagagatttaaatgctgtatgattacaaatattttattcttgtcactaaaaaacaaaaatggaagataaaacaccaaacctatcataaagatacatgaaaacagtttggactgtttacctttctttttcttccctaggtcatttatgtaacagtcttaaaaaaaaaaaaaagagatctttatacaaaactctattttccagtgaagtaagagtttatggtgactgagtaatgcttggtatagatctggatctgttttcagaattggctggtgtctaaaaatcatgaggaacttaggtgaagcagttgatgaatagtccataagtccacagtcatcattgctagcttgaagatagttaatgttgataactttcttaaacactggggtgaaagggtaaggattgggaatacgtctatacatttagctattctggctgatacttctttcttttgccttttccattatctcatttactttgggcttgttaatccagtggaggccttcttaaagggggtgggcataaataaaatatgcatgttctttttcctttgctaaggacagtatgaaaacattgtctgctttcaagtttggtcttttatgatgaactggctctcagaaaaataacttgacttctttttgaggtgcacgtttttcatttcttccttctcccacctccacagcaggcacagtgagctttccattcagacagtgagcttgtgttgccttttagcccagggagctcagcccacaaaccatgggtctcagtttgtgcttgacaggactttgttaagtgaatcagggagtctgaattattcattctccttcctcatcctgctgttcatatcaaattcctgctgtgtctttggggcatcttgccagtcttcagcataattgatttccttgctttgtgctatgtggggtgtctgtgtctgtgtgtgcacatgggttgtgcctctatttaagcatacctgattgcctataatagtggtatttattaagctcgtgtgggcagaagcacaacagttcagcccaagattactaaaaatatagcggactggctgcttttataatctgagggagaggttagaattggtcttttcattatccaggctgcattttgcattttctttctgagcaacaagggtttgctgcctgaggaattatgaggaagactctatctatctatctatctatctatctatctatctatctatctatctatctatccatctatctatctatctatctagagatggagtctttcctgctttgttgcccaggctggccttgaacttctgggctccagtgatcctcccaccttctgtgatctgattggaacacttgtgaaggagactgtccttttctctttctattctttgaccccgttgtctcctctttaactgtttttctttgagaagatatttcatttagagccatagactgttagaattagggaggacttaaagattatctagtcaagaggttgcaaactataggcctttggtgtggctcccacacatgggattttgtttggataacacagtattttaaaggcctttggatttaacatttaaacattgggaaagctcacatgaaacccagatttgtggcttcacttggcagcacggggcccacattcctacatctgacaatctgcaggagctaaatagtggctgttctcttttggaatgacccgtttgcttcagtattgcacagtctctacctgtgcacttcactctttacctctggtgagtgttacaatcccggtctaatccagtctacccattttacagaagagaggaagagatttgctgaaaacctagtaggtagttggaacaacttagggtttgtgtctcttgacttttagttgattacgattatttctactagtattttacttttgcctttcttactctttttttgttgttcattcaaaatattcattgtgtctgtagcaagagtcaattctgagagtgtgaaaaggaatgtgataaagtctcctttcttgatttggtcttgagggaccaaatgagtctactttggaacagccaccatccaccattactgtgtcacattatgttgtcatcttttcttcgcatcatctggaattttaaaaatttgtctccttgtttactggctgtcttcccaagtacttgagtgtaagcactgtgaagccagtgactgtgtctcatttaatgttgtatctccattgcctgtcacttagtgaattctcggtatttgttgaatgaatgactaaaggaggcatttgaactcagctttgaaagatgaataggaattttctatgcagactgggtaagggtgttccagacatagatactggggtgagcagagtcatggagacatgaaaatacatagtatattcttgtgcttctttcgggctgggtttgttcatgtgccacaaaaagctatttttgatacagaaagaccatctggatttgaaggactctagatctttggttaaaaaaaaattgagaaactaaatgtgtttctgagccaacttcagtatagctttttcccctctgtaagtcttttagccagatgctgggcattcattatcattaatgatttatagacctttaccaacatatttaccacagttttattatataacagatgtgaaacaagggtatggttccaatgtgccttcagtctagcaacacactctgccttgtgcaaagcagtctaatattttgcaagtccagaacaactggcagtatgtagttatttttagagtatataatggactaagtggtgagtttctgagggcatagggcagaggttctcaatattagccaactgtgcgttagaatcacctgggaagcttttaaacatttcagtgcttaggccataccctacccagaccaattaaatcaggaactctgggggcaggacccaggaatcaggtttgtttttttaaacatcttcagatgatgctagtatgcagtaaggttgagaaccattggcctagggggacacaaacaagggaaggagacagatttttgaagcttgttgtaagttgttgaggtataaggagggatccccaagaggtcagtcattaagaagattaggtaattgaagagaattattaaaaaaattatctgagtggaagaggagagctattttagggaatcagtttagaaatgtatgatttttagagcagttgaacatacagagattggaaatcttacagatggtgtcagagataaacagagtgtgcctggtcgttgaggaggaagagagcttggattccaaattattcatcgactctagctttctagtcacatgtaatgagaaaacattgtacttgaagtaaaatggtcatgggtcatagttctagattcccactaattagttgtgttcatttagttcagttaaccaaccatttatcaagtgccgaacactgttggacactggagacaaattagatacaggtcttgccatccaggatttgatgatctaggaaatttttttgtgtagccgtagttaagcagttattaacatctctgggtcattctccatttgcaaaatgtggtgatatgatgttatttctgagattgcttttagctctaacatcttaccacagtgattcaaagtaaaatctaataagaatcagcatctcctaaaagtaattattatagttttcttcaatagaaaaaaaaatccaggtaaaaaaatggccaaggggtctaaactgagacaatcttagaaacttactatatccctttcctgtcttacttttctatcaggttctgtttgattttgacaactatagttaataaggaaggttcaagagcagatgcccctggtagggggcgggtagtagctggtggattagagctaaagtagagctggtaaaagcctcctggttgcagagctgagggcagattgggcaggtgcactactaaggtatggttttgagatctactatttccagcaccttgttgaaaagttgatagctacattcatcacccaggtgaagtctaccataatgaggaaaaaattgcttatcttgccagcagccctcaggataaacttaggagaactggggagatttgtttttctgatgattcttggattttgtagtgcagtcattgtttgctttgctgccttgtaggggaggaagggaagaggctaaggggagagggtgggtgaaacagctgtcaaagaaagaggagtcctgaaaagctatttgtgtttgggagctggagctcaatggtagggctgtggtagttttgtaggccacactctcttgttgctgttttgcttttgggacataacactaataaataggattagtggttttttttttttttaaacgatacccttagcttgttagagttaaaacagcttttgttctaaaacactctatcagagactattaaagaatgatttttcttatataactgttgcactcaacatgttccattgtagggactgtagcatggtttctattcagatatcctggaccctcagacctcaaattaccgtccaaccatttccttttctcctacccacttccctgttcattctgcagttcttgtaatcaccccagcaaatgtttatttagcgcccgtatgccctgtaccatgctggctgttgaggatgtggagggaggcagagagagagagacagtccatgacctcaggggctcccagtgtagtagggagactggtaccaacaagacctataatgtggtaagtgcattaagagaattgagtaaatggggagatggggggaggagggtctaaactagctgggaccggtggaagtcagggaaagggacctgggggatgtaacaggagctatccttctgtgttttaaacagtagaaagaatagagaaatactggtttaatgggtagaacacagggtgggggaattaggactcttccttttcggtcttttgtgttcaaaagtatagcagctttctttgcttcttgctcctagcatcagattatctattcccctggaattatgtgggttggagaagaatggaaaggaatttgcccacctgcatggagagagagggaggcagtagggatgtgggtgtttaaaagcccttggcatgattggctgtaagtacagatggctatttgtgttaccattattgtagctgttatgcctacattccctttggtgtgcctctctacagggataattgtggggtcctgacttataagtcttcctgctgctggataaaatagatgctgatgtgttgtgcgttacagggtatacagtgaattctgtgtgggctgtcttcttactgctgccttgatcttttggggcctcaaacataaggggaaaatgactaattttgtgtgtgcaaattcacattggtgaaaaccagtaaaaccataaaaatggttatattcaattttcctaagggattgacctccaaatgaagctaaaattaactttggtgaatgcttatatttttaaatttttaattctaattttttttttttttttgaaatggagtcttgctctgtcacccaggctgaagtgcagtggcatgatcttggcttactgcaatctcagactcctaggttcaagggattcttatgcctcagcctcctgagtagctgtgaccacaggcgggcaccaccacacctggctaatttttgtatttttagtagagataaggatttaccatgttggccaggctggtctcgaactcctggcctcaagtgatctgcccacctttcctcccaaagtgctgggattactggtgtgagccaccacgcctggctgaatgtttggatttttgaaagcattaaataccaagggctgagtatctagggaaaaggtgatttgtctgtgaaatccaaggaactggctacattctgtgtataactctgagggaaatagaacagaaagaggatgggctttacagttgctctgcatattttttgttgtgggaccttgctcaatctacctaacttttctcaagcctcagttttttcattagtaaaatgaagataataattactaccataacgttgttttggtgattaaaaatttattattccactactaaaagcctttcaaaggcttctttcttagtatttatgtcccaacagaatggaatcacttgctatctttttctcctctgtgcttttttaccatttttcttgtatctctttttacctctctactcagaaaattctccataaagtaaaacacataacataaatacataagcgtgcaaagtcaggttgctccttagatctcagccaaatggtattttgttttcaaggaagcctttcctgagcccgatcccattccagtctggaagatgtcctttcttttaatttgtctgtcccacctgctaaactgtaagttctctgagggcagagattgtcatatttactattgggtcttcctcttttttgtcttgtaaatggtgtatggtctgtatgcaagctgcttgcaaaactcagggcaataccaagagacatagcaccccccacccccgccccaattgatttataaccagaagaaaaccgcttaattttcacctaattgatggtaaagcctggttactttggggataaatttggctttgaaagtaaacctgatgctttgtgctttggtagatatttaacttctgttctctttcatacacaagagttactcctttgctttgagtagaaaaccattagaaaaccagggtagaacttttggcaattatccagtttagtaattgggccaaatagttctaatctcaccacaaccactacttcttagaaaatgatctctttaaacaaaacatggaacatctctgaggatgaaaacctaagggaaggaatagttggagatccccaaatatactcatatagattccccccattctttttcctatttatgggtgttcaagccttggagagatgtgtgtgtgttgatcacataggatcttttacctacatgacctaagtatattccgttgtggcctttggtctattttttttatacatctcaaatgttatcttttaataggtcataatgaatttgtggtggagtaaaggcccaacattccctgtacaagtaaaggcaaaccatagcgccagtaaccctttactagtttataagtaaaggctatctctgttagcctgaattccttgagggcagggatggtctgattgattttccatcctcaatgataagtaaagatattggcacatacttcgttacgtgatggttacctatttgtcgaatgaggtagcatggtgtagtagattaaaggctccagagtttgacagactgagttagtatggcactgacacttgttgaaccacgttttaacctttctgagctttaggatcagctttcgttgtgagaatcaaagacattgtactcttaaattcctgttagtggctattattttttctccattgattctttattttgaaataatttcacattacagaaaagttaccagagcagctaacaacccacaaaacaccccaaactcctggattttcttcactcggattccccagttgttaatatttcactgcatctgcttcattgctcactctgtgtgtttgtgtgtggggtttgtgtacatacataccctttttcattgtgccttttctgagctttttttgagagcaagctgcagatgtgatattccttcactcccaaacacttcaatgtgtattccccgaaataggactttcctatataactggcagagatctccaaatcaggaaatcaatattagtacaacgcgaccatccatccacagacttcgttaacattttgccagctgtcccagcaatgtctttttcctttttggtccggtatcttgtctaggaatatgcgttgcatttagttgcatgtcgcctcagacctcttcagcctggaacagtttctcagtctttacctttctttcatgtccttgacattttgaagagtctagatctgggtccatctgtttcttcatgacagcagtaatatcattttcggcaggaataccactgcaatgatgctatgctcttctcattgcatcatatctggaggcaaatgctgtcccccgcatcccactgtcagtaatattgttaaccttgaacagctggttaagctgatgtctgccaggtttctccacatcagattcatcatttttccttttgtaattgattattgtcttgtggaaaggtattctgaaattatactactatcctgttcctcaacagatatatacctaacctccttagcgctattgactactctttcctgaaccaaccagttttattctgtcaaatgctagtcctctatttctgtgtctgcctgtatttgttagatgtcattctgttacaaagactttccctttttcatttgtttatttctatcaaatggactcatggattactattttattcagtgggctgtagtccatttctataattatactcctcaagcttgagggagcttgaaagtttagccagtgggacctgctttatgctggtttctttgtccttttgacctgtccccatcattcatgggacatttccttattttctgccacaagaaggttttccaagtttattttgtacttttcctaccaaagccttggaatcagccatttccaagaagctctggttcttttaaatggaggatagtaattagaaaccaacatctgggtggtgggtatgcatattgctactagagtgtccttgcctctaggctgtctcagcaaacagctagaaattgtgtgtatgtgtacatacatatgtacataaacacatatataccacatatacatctatatttccatatctctttgtgctatatacgtatatatacatgcatgatgtttgtgtgtgtgttacatattttaaattataaaacaatgcattttatattataaaatcatgaattcacactgataactccattaaatgcagccaacctctttccatatttgtaaatatattctccagtagggaaaaacttggctccccttatccccaatatgtttacttatttgctcagtgtagccagttttccaaccgcgatggctgactccaccacctctgtaccctactcctcatgttctggaatcctcagtcaatgggctcctttggcccattcttccttgtggcttcctaatctccctagagtttcccagctttacctgtagtcttccagtgccccctgacccccaaccactcttatctttggcctctgggcctgctgtcctgtgcatccttgattcctcagctgctcacctacctgtgtccttggctgctgtgctaactcctctgtgacggaagggggacagggctttttttttttttgagggggattttatacgtatacacatatgtatatgtgtgtgtgtgcatgtatatatatatatatatatatatatatatatatatatatagttcattcaggtataatttacatgcagtaaaattcattcttttaaggctacatttctatgaattttgacaaatgtaatatagacatgtaaccactaccacaatcaagatataaaatgcgtccattaccgtagaaagtttcttcaggctctttcacagttagttctctcttcgcatccgcagccactggcatcactgatcagatttctgttcctatgattttgccatttctaaaatgttatataaatggaatcatgtattatgtagctttttgagtatggcttctttcacttagtgtaattcttttgagattcgtctgtactgttttaggtattagtaatgcattccttttttgctgttgagtagcttcatttctcttgggtaaatacctaaggttgggaatgctgcagggtcatataagtgtatatgaagtgtttaagtgtatgagaaactgccaaactgtttcccaaagtggctgtaccactttggattcctgtcagcaatgaatatatctacattctttccactatttggtattgtccgttgtttttttaaaaaatgagagtccttctgataggtatataatggatatctcttcgtggcttcaatttgtattttcctaaatattaatgatgtttagcatctttcatttgcatatttgtcagtcatatctctttgatgatgggtctgtttaaatgttttgcacatttttttaaaatgagtggttcatttgcttttctttttcttttttttttttttttgagacggagtctcggtctgtcgcccaggctggagtgcagtgacgcgatcttggctccctgcaacctccgcctcctgggttcaagagattctcctgcctcagcctcccaagtagctgggattacaggcacacgccactgtggccagctaattttttgtatttttagtagaggcgaggtttcgccatgttggccaggctggccttgaactcctgacctcaggtgttccacccgccttggcctcccaaagtgctgggattatagatgtgagccactgttcctggccgggtggttcgttttcttactgagttcattttgaaattctttatatatgtagcaaatcctttttccgatacacatttgtaaatattttcattcattctgttattacttttatattataaatgtggcttgtttcatatataaaaatgttggattgaattcttgggggctttcctttttagcccttgtgctgtgaatacacaagggaaatatttgtgaaaggatggatctagatgttgagggaggtggagatcttggaggatcaagtgtaattatctctcctcagtgactggaggtacttgttgagaacaggaaggaaggactgagggaagaattaagaggggggggtggtggtggtggtggtcagagtttttggttggaggatttggtatagcaaattcaggggtgggataatggctactagaattgtgtaaaatagaaagataaggagtcagggggatttaacatgaaaagtgttgaacctagctgaaatcaaacagggagctgaaaacaacgttagtaaccatgttgttcagccttttcatttgataggtaggagatagccttaagagaggggatgcgatttattgaagattatatgcgtcatgaagtggcagagttaggacttaaattcagatctttaaggacagtagtgaaggaggggctcagcccatgtaggaaaatacatttgggggtgggagcaggaggtggaggaaaaactagaattctaatggcatatgtttttgttattctttatatccttcacataatttataaatattcttcttgtatctcctcagtattaagtaaaataacagtaacaagtctggaatgacagcagaattagtgattgagctggtaatagtttgaccagaaatcaaattggaatatatgttgggtcaaacagaaaacactagtgatcaagtgggaactcatttttggcacaacatgaaaatttgattttttttttttctgttcctgacatcaaaagggaaaagatactaaagacaataaaagatcatagatctgaattttgcttgttacaattagctttgaaaatactgactcccaaggttaggatttactgggattagaattgcctttgaattgaaagagaatgataaaaggaaatacctagaaaacctgatagtaatagttatttcattggattcctaatctaaatcaggcactgtgttaggcttcttggcattacattttcttaatctttccttaactttgcagaatatttttggtgacattatgttcctattttatcaatgcagaaattaggattcagaaaaattaaatgatatgcttaaggtcatatgactagtaagtgagctgtgttaatccctaggattgtgtggtgaacaaagctttttctcctttccttttaccagtgctaattaaagtgtcatttgtagactgatactagtttgctgtttattaccaattcatacaagataggtgcagaaattgattgtatgcacttagaacttctatagcaatttgacagaatacttttatgagtgttaagtctaacaataaaaaactggggcttgtattttatatttcttgttttttaaaatttcgtttttctaataattcattttactacactttacaaaagtatgattccctgatggattggaaagttaacagaaaaggttgctcctcacagtttgagaagccccgtctactacgttgcctctgtgctttcgagagactgatcaggatgaaatttactttagtatttctgctgagttttgaatggctggggagagaaggtcagagaaaagggaagaggcagtagggaaaagatgaggctgcaggggaggaatctttgggaggactttgcccttaagtggtagcagtaagatgagggcaataagatgaggggggatgccctgcctcctttggttgaaagtagtgttaggattgtggcgtctttctgtagagctctagcctgtttttgttgttgttgttgtttttgtttttgatacggagtctcgctctgtcacccaggttggagtgcagtggtgcgatctcggctcaccacaacctctgcctcctgggttcaagtgattctcccgcctcagcctcctgagtagctgggattacagatgtgtgccaccacacctggctaatttttgtatttttagtagagacaggatttcaccacattggtcaggctggtattcaactcctgacctcgtgatctgcccgcctcggcctcccaaacaaagtgctgggataacaggcgtgagccactgtgcctggcctagcctgttttttaattacacccagtggcaattctggtgttaatagacgagaacgaatgtaggaaaaagaatttacagaaataaagcaactggatgtaggagttcagaaaatctaaaaactccttttctctccttagaaatacagacacactccccttgaagtgttttccctttaaggaaaaggcggcaattctttggcagggccaagagttttgattggctccttctactgctgtttgccacgaagaatcctgaccagtccagttttgtttagagctggtttgggagtcagccgagctgccaagttctctgtgcctaatttgaagtgtattaatgtttcaggagtgggccagatctcttataggcacctcctacagttcagctttccacgttccaggaggaaatgtgaccctgctgtttcgggaaccccacctcatgtagtcttaatttctctccgaatgtgtttgaagtcttgccagcgtagagaggggaagtttaacacactaagagaatacatttttagggagcctgcccacaaggtggtcggtcccctatgccgtggccaaggaaaaggaacccactcatccttcaggttacttaatatatgagattaaggcctcagcccatataggagtaattttctcttcttctggatgtgaaatggtaaaacaggccctttaagaactagaccatttttagttgagaggaaaacattgatcacattggctccagataagagcagatactgtgtgtacttcctggcaaaaactttgtatgtggttcacagcaattcctgccattctggttgtgtctgaggggctgacaacagacagttctaatctaatctcaaaccttttacttgctggactggttcttaatcccagaaaccagcctgaggtcaagaattggttcctaattgccataggtataaaggtggcgctcctattgagggagttttcagtgttcctgctctggttgtcaccagtgtggcttgggagatggtttatgttggtctgtcccccctctatggatataaactaattgttaaacagttactgactcctgtaagtttagacagtttatagcgccagcctttaaatttcattgtgaaatataatcttcagatttattagaacagtttaacggaagaaaataagagaaagagctctaaaaaggtgtagactgtcaaagaaggctcatggaggaagcatcagttagaggactctcacagtactttataattacctcatcattatcaagtattggactaacattgtctttgaacatctctctctgttgcctgtagattataaacttcttgaggatagggcagtttctgttctttttttgtatttgactctggccttcttgatcgatttggtaaatatttattgagatcaattaaaataagatgctttaaaactgagcacaaaggacaagttacatttcagtagcttagtagtgaatttaattctgcaggtcttggtgctgtacttctttggtgagtttgctgggcccagatggctaggcttgtactttccttagacattttaatggcctgtcttggttgtgatgtctctaagcactaggaggacagggaatatggctcatagaagagggtgccaactgagagcctctgtccattctctccacccccacacaactcctttctgtacagtctttggtaggtaataacatttctttaaagtgatgattcctaggtgaaaccggaggccagttttgtgtgtactcttatgttttattaggtgtgtgggatttgaggaagttgtggtgctggaaagaatctgccttgccccatattactggtgaaaaaatagagacctaggaaggataaataatttattccaagccatatggctacttagtggccatcaagactattgtccaggtctccttagtgctagacatttaccacagtaccgggtaagtcccattttttttttttttgaggaagcattagtaaaaatcaattttacagaaacgaatataagcggtttgacttaggattgtgaatggaaacatatttttccttttgaatgctaggagaactatgccagagtttctttttttcctactttttgcatgatttagaagatagaacacatgaaaacagttccctaaaggaggtgcttcatttaaatgcttaaaaaaagcaggccacttcaaatttctaaaaatagcatttaaaaaaccccaaaatgatctaaaaagggattttagttgcatgaagactatactgtttggggggtttctgggctctagggaggatgctagctctctgaatgctttatgttcttatatgactcatcttgttagtggtgaccccagaagggcagtgggagaaatatgttccgaagggtgatttggaaggaagggatgatctggaaggaagggatgagaaggttgcaggcaggaaaactgagctaagtggttttagagagtgttttttttttttttttttttttttttagggagaaaaagaaaaaaggaaaggctgctaggagcttggtcctaactgattccagatgggcctgctacagtacaaaggttttcagtgtgtttgggatggggctgaccaagaaggccccctcagcacttcctgtgcagctctgcaattgtatgcacctaatcagaaacagcccttactgctggagctcaagagcaaccgtctcatgttgtctttgtgcctcattctgtgaactgctccctttgcctgccctgtttacctccctctcctagtctcttttcctttctaatcttttctatatttgttttcagggaatgttaaaaggaggggagatatgtatatataaacataaacatatgtatatgtttcttgtgggttgggagcagagaagagagggaggaaggaatggccaaattaaacgcagatggtgaatatttaggaaaggaatttttttctggacctgggaggcatttgctagaaatggggattgggaacatgagaatgtgaatgagacttggaaaaacaagccactctttatttttcatttttttgaatcctgcacacttgtctgaatggttcaaaatataacattgcatggggatggtttatttacattgtaaactgagtatcactggccctgtgtagctgtgtgccaaagggtgagtgtgacagtgactttaaacttaaaggaagtaggaaggtgttttgcacccacatcccatgtagtattgttgccaggggagcatacctggtgtgctctgacgtgggcttgaatttggccgttttcccacctactgcagtatatcaggcactctgcacagcttaaaagaggatttttttggtgacactcagctgcaggcactatgaattgttcttttgtgccctcctgattccaccagggatatattttatatatatacttgattttctattttgcttctattttggttgcctggttagactgagggtatgcctggtattgactgttagttttttgggtctagctgatgattacagaaactctgccatcccaggggtccatttaggtctttgcaattttattctaatccactcagctgttgtactgatgttgttgcgtaaatgtgagcttattaggatagactatgtaaaaatatactgtgttggcataaaggccttagcagcattgctttgttttgacctcttcatactttgtgtcccttttgtcctctcgtaagcaccatgatcacatttcttcttcttgtttttttagatagggtctcactctgttgtgttgcccaggctggagtacagtggtgcaatcatggctcactgcagtcccgagctcctgggctcaagcaatcctcctacctcagtctccaaagtagctgggactacaggtacatgccagcatgcctggttaattgaagagtgtgtgtgttttttttttttttgagatgggtctcactgtattgcccaggctggtcttgagctcctgaccttgagcagtcctcctgcctcagcctcccaaagtgctgagatttcaggcataagtcactatgcccagccacattttttcttgagctaaatgtacaatatatcctctgatgaaaaattttagtgctgtttctaggtagcgaggatgtctgggagatagagtttggatgctgaaatatttgatttttttgggatatttttgatgctataggaataatgtgtcagggtatttggaattgggatagcataagacaagttacatggtcacccttcttgagtgagtcttagcaatatagcattgcaaccgacggagaattatgttctcaattcaccagtaggatctttctcactgtgattttttaaaatcccccatttgactaggtgtaaagaagagaaggtagctaagatgttgtttgtttttcgagtggctcttatttgccaggtaccagactcatgttatctcctacaatttatcagaactctaggataaatggcctcaagtccatttgcgggtgagaaaactgcacatgcacagtgtcacacagctagctttgtttcagagacagcctcaacccattgtgttctgggcctaaaggtgatacatattcttccacattctgagttatatataaattccaaacccttctcagaaagaaactcctttctaagggtaatgtggtagttaaaaagatttttaaaaaatcactttaaacttatttttattgtcatccttgtcccattttaagcatactaacttcctgcctctgatatataaagagccgatgctggagagaggaaggaggcaaaccattttgtcatgtttatggagagacctcaaggctctaaaagctgcttttatttttttgagacaaagtttccctctgttgcccaggctggagtgcagtggtgcgatctcggctcactgcaacctcgacctcctgagttcaagtgattcttgtgcctcagcctcccaagtagttgagactacagaggcgcaagtcaccatgcctgacgaatttttgtgtttttagtagagacagggttttaccatgttgccaggctggtctcaaactcctgacctcaagtgatccacctgccttggcctcccaaagtgctgggattacaggcgtgagccactgtgcccggccataaaagctgcttttttttttaattaatggaaatttttattgggggtaattgtagattcttatgcagttgtacaaaagctacttttgaaatggcagaaaggcagaagttctgatctagaggcaggcaggtacctctttttatcttctagggcagtgtgcaaggagagtgtatgaggggctcttgagaccccacttcactttactgctctctgctgtctttgggatgtgcacttgtcaagtactcttaagtgctgtgtgcaagaggcacccatttgcagtactgaattcaggccgtaccttgaaatcttgttgatttgcttgagcagagacagtgttcagaatgtagggatagattgccggtggagacagtagtagaccttggaggaaaatcgtaggaattgatggggtgaagcaacaagatatcttcagttgggatcactgtgaagactccctacaatgtctttatttatttacttgttataatgtctttttctccaattcgactgagcttcatgagaggaaggactatgtctgttttccacacctgtattcatggtgcctagcactatgggaccatagtaggtgtacattttatgaaagtttgttgaatgaatgaatgccatgggaaattatggttcctgttgaagaatttaatcctcaggtcaaacctttgtctgttgttttgcatcagaggagtgactttgaacattttcctgataaaagagttttaattccataagcttcttttcttcttgtttactaccttagctcaagatcttctcttaagcttactgacagagtcttgctttatttcagaaaatgtgcttaagacctggaagcccagtctgtgaagcatctggtttaccttgacctgtaaaattatcagactgcttcttttccctcccgttctgtgtgtttaagagaggcgcataattctattttgaggcttatgatagaataggagaataaagcaaactcgatgactctgtttactttaaaaacttgttgctcatctaaattggttgaatgactatcccttcccttaactaaccctttcaacttttcatcctggattgaccttccctaaatttatctttcataaaaagaggccatagatatatttgatctctaacccactgggactcttttttaagtttggcttttggctttttttttggtaacctttttctctaagatcaggaagaaagggataagaaattgtggacaagaaaattggaaaacacttaagaaaaagtttcgggttgtgtgggtgtgtgaaagcatatgtgtatacatatacatgtttttcctttcctgccccactgttctctagctagaatgacctagattttttttattctgggaaaaattgtattatttctggattctgctgtttcttttaagtagttggactggaagatgctggacttataacttacatttttaagttctttcttgtactcttaagaaaagtggtaaatggtacggattttagatgtgtgtactggaaacagtagcactaataaggaaatgcctttgtcctcctgttctttgttgaaatcagcttggatagctgaggatggtggagggttatttattatttttgggctccaatgtcaaaattctcagttttatttaaacactcaacacaattgatatttgagtgtcatgcaattattagctaaggttagtattcacttaggttaggaaacatctcttaccattttcatctcttgtagcacctaacacagccctgggtgcatacgaggcacttgataaaagcttgatgagtttaatttaatgtaatcttgcttaattcatagattgagttgtttgacctattaggtggaagaaaacatcattgtccttttttttttttggtagggtattttttttttttaattttttattttgagacaaggtctcgctctgttgcccaggctagagtgcggtggcacagcctcctgaagtgctaggattataggaaaattcacattttaaatgctactttatgaaagtttctaaaagaaaacaaagaagaatgttttcatgatattctttacttgaactggatataaatgctgactataaaggaaaaaatgatgatttgactacatcaaacttaggaattatctgttcattaaaagacgccattaagaaagtaaagctagatgtggtggtgcacacctgtattcttagctacttgggagggaggctgaggcaggaggattgctttagaccaggagttaaagatcagcctgggcaacaacatagtaagacctcatctctacaattttttttttttttaaagttgactgcgcataatgccatgtgcctattgttccaactactccagagtctgaggaaggaggattgcttgagcttaggagttcaaggctgcagtgagctatgattgcaccactacactccagcctgggcaacagagcaagaccctgtcttttggagggggaaaaattatatgtatataaaagaaagtaaaaaggcaaactacaaagtaggagaaagtatttgtagtatagggatctggctagtctctagaatatctaaataacaactacaaacccatatataaaagaagttcttttaatgaatcttttgaacaacccagtagcaaaatgggcaaaatatttgagtagttacttcacaaaagatgatctccaaatgttccaaaaaatggtcaggatcgttaatcatcaggctaaagcaaataaccacgatgagatattatcacactacctccagaatgactaaaatgaaaaaggcagacattaccaagcattagtgaggacgttcagcatctggaaccctcatgtactggtggtaggaatgtaaattggtacaactttggaaaactggcagttggtagtatctaccaaagctcaacgtaagtgtaccctataaccagtcattccactcctaggcatacccaaccgaaatgtatacatgtgtgcactgaaagacatgtgcaaggatttttaggaatagcctcaagctggaaatggcacagaggcctttcaacattactgaaatatttttcagtaaattatgatatatttataagatggaatacactcaacagatggatcagttttacagatataatgtggagtgaaagaagccaacacaaaagaatgcataatgtgcaattccattaatacaaacttcaaaacaggcagagtgaatttatggtgttaaataaagtcattgtgggctggtgggagtgactttgcaaaggcacaggatgggcttctgtagtgctggtaatgtcctatttcttggcctaggtgttagttacatggcagggggcggggggatggtcactttgtgaaaattcattgagttatgcacttaggttttttgcctatttctgtatatgtaatcgctttggtagaaagtttactttcttctacttgcgttctgtgattgctacagctgatagatagctttcccttcatacacatactgatccttttcctgtcgagcttgtaggatgtgagtgtgcacatacatttttgtgtttatgtgttggggtgttatgtggggatgaaggtgctttttaaagttaatgtaaatttgcttgtcagatattcaacatgctgtttcaaacagccacaggaaagtagaattgatgaataagcttcattgaccactttttaaactaattctccaagaataagaaggacattttcattctacctaataaggcagcagatttggattttgctctgcagacaaaagaacctcttcattgagggtctcagccactaacagcttcattttcagaaggatgtacctcattttggccattattcttatcatggagactatgaggagaacaaatctccataatattaatttttttccccccttttactctgtggaaatctaactcaaagtaaggcattttaggaaaacctaatttgggttaggtagaaaatctaaaagatgttgccttgccttctcttagctggtcatatctctcaattctgaacctggccttagtaaaattcttcaaagttcaagtttgttatgttgtcttatgaccatccctttgtaaatctttgttctccctccatggaatgctcttaccttcctcatttacttaaatgaactcctgctcattctccatggcatcttctaaaagtagcctttccttctgtgtgctgtcaccatacctatatacaccttggctatattgaataccacgcatagctctatttatttgttctttggggccagccttttgagattatcgactggtgtgtggtaagtattcagtaagtattggaagaaagaatggatgattgaaaatattatttgaaagacaataactattttctaaagaataaaatctgattataatatttgacatcagtagatacattttttttccagaaaaggtgattgtttgccttaatttccgagtaaaaaaggatatatgtttacaacagggtgtatgttgtggctgtaggagagaatgatgctaactggttcacatgggtagcagacacgtgaccttggcctctttagcatggtcctctaatcagctgatttaattttagtggaatccctgaagaaatgctctggttctatatgtggaatgtagaaatcataaatctaatgtatagatcctgactgcattagggtttgtggattaaaaccaacaaatagactgtgtaggtattatgacattataactgggccagtgtaggcattatgacagtgataatttttttcatctcaaatattatgaaattaattccagaatgttatctgaagttttgtcatttcatttcagcatgtaatttctcaagccaattttaatttaaaaagatctgagtagaatcattgccgtttgtccagaagtttagaataataggattagaataataaattaataagtattgagtgcctacttagagtttaatactgttagtaatacataaaaagtatgactttgaccttgatgtcaagtgtcctatattttatcgatggcataagagaacacagatgtaaaatgatttctagatgtttttttccaaccctcactatctgaaaataggaagctaagtggaaaaatgcacaggctttggaatccaaacagatctgggttagaatcctggctttttaaaaaaaatgaaataatgagtatataaccatggtcaccttgacatcactggaactctgtttctgtgtttgcaaagtggagtaagaatgtatactaggcagggcatagtggctcacacctgtaatcccagcactttggaaggccgaggtgtggaaatcgactgaggtcaggagttcgagaccagcctggccaatatggtgtaaccccatctgtactaaaaatacaaaaattacccaggcccggtggcgcttgcctgtaatcccagctactcaggaggctgaggcaggagaattgcttgaatccgggaggcagaggttgcagtgagctgagatggcacgaccgcactccagcctgggcgacagagtgagactccattgcaaaaacaacaacaacaacaacaaaaagaatatatactagtgttggtgtttttatttttttgaaatagcgatgacacatataaaactcttggaacgtaataagtgctcttaatgtacgtttgagtcaaagagtagataaatggagctttgttttgcaactttccacttagtctaggccattgctgatagatttcttcataataagtcaagtttagtaattgagttgatgggcactctcagaaactgctttagtctccctcttgtagaataaggtgactgtgcttattatacttaataattattagtgcttttaatactaattaattattagtgcttatcatacttaatacttagccagtggaaccatggtgtccataggaatgctttcacacaaggaatggcttgttaaggtcaacaaggagcgaaataagaaaacaaatatctcagagatgggctaatcatattgtcccccaccccgcactgcaatgtgggtttcagttgttagcatgtgcttcatcctttgctgttttccacaacagttataaagctttttctagatgcctgtgtgttaactagaggcatcttgactcttttgacttctctaattgttctaaattgtttaagttttctgtggggtagatgactgttattatactaaattattcttctttcctgtcttttttttttttttttttttttttttttgctggagagttggtgccctggagttgagtctctgctttgcaaactgaaaatacaattttcctgtgtgtgccttatttttttcattccttttctccctttcctactacaaggctctgacctgcttggagcccttattacttggtcacaattgatactttgtccttcagagtcacataggacatagccactgcgttgattcagtgctcagctatcaaatatggctctgagaaggaattacttctctagaatgcaaagtgggcatctgagccagagaatgaagccctggtccatatttagtcattatttagggagagtgaggagtaacaatttcaaaattagagtttggattaagcaaagaaaatactagtcacaaattggctggtgtatgaggtgagtagagctggatttttaccagaagtagaaacctttgtaggaactgcctgtggttcaagaagttatgtatattttatggtatatctatgattatgaaaggataattttctaaaagtttatgttcttcctctggggattgttaacatctgttaatatccacaggaattttactaataataatgccaacttactcttgattcagtccctttgacacagggacccaaactaatttacattaattttgtcagtaattcttataatatccctgtgtgggagctgctttttagatgaggtatgtgagaatttgttaagtttacatagtgggtcagtcccttggatggaaagttggacccaggatttgtgcttccaggcttagtgtgtttgatcactgaagtgtgcagtctttttacctaattctcctccccatttattcttcctatgatggaggaaatcatatcaaggaaatagcaggagaattccatcttctaagaggttaaagacttttctgccttgaggcgtggagttcccaatccttggcttaggatggaaggaaacagcggaacactgtgatgttcagctgaaatgacccaactgtttttttgcatagttttttgttctctttttaaaaattctcctgttgggaggaggtgaatgtgagaattttctctctgccaatcttatatgtgaggcaggtggcttggttgtttttaatgctcagcagatatcactacttgcttttgggttggggaccagagaggaggaggtgaagcagccacttttgggtggggttgagaggagggtacaatgttggaaggaggacatttctctgtgttttcttagtcataggactctgaatcccaagtagctaaatttagctcaggttcctgttgaaagcatcgtctttttggggcgggtggtgtggggagaacggaaaacctttttgtgtatcctgctccatgaagccaatagggaagcaggaggaggtgaggttaccatggagatggtagctgtgtgcaaggggagagcagcagggtttagaattccaggaaggaagagagagtgatgtcatcagattccatggaccagcccaggaacccctgtgaggttggtggggagttgggtgtgtggggggtggtggagtgggagtttgtgcaggggaattgtggcttcagtaaggtgtggggagtccagttcaagcagagaggtcggtcgtgtggaattgtgctgagctgcattaatgcctgatttaaaaaaaaatctggaaaccattctgaatttgcagagtattttctttgttgaaagaagacatttatttaacaaaggagctcatctagatgtagcaatgtaatatctttttatagttgtatccctgaagtatttgtgtgtgcctttatcccttgtatgtgagggtatttgtgtgcatattttagtatatagttgcctttgtacaataccttttatggtgctgcatgcagttaaatgcttcattaatgcctgctgatggtattttttttatatggatgggtgtatataaataaaacacacttaaaaataatctgaaaagaatatcaaagcagttgctttttcagcagaaaggaaaactgcatgcttcaagacagttgttctgaacatatgcatgtttgtgctgatagtgaagggcaaatgtgtttcttttggtatgactaagaggctgctttttttttttaaacaaatataacagaacctgtgcatccaaatgaatattgcccttcaaaatagtcaccttggttggtgatacaaccattgcgcaaaacctgaggaactctcattcggaatcggctttagagatgagtgatgaggaaaacgttttcaatacctaacactgaatttttttatttaaaaaaatacctacctaggtttttgaaagacactaggtttcttcgaattggctcttcgtgattttgtggtgttgtcaaaaagtcaaatctgtgctcaaatggtgagcttttaccccatttgaagatacttaaagtcatgggtttaggctctgaaggcattttcattttcagatcaagggctctttaaatgtttagtttagcagtggccgtgttttgaatgatggtagcatctgaggaataagaacatagccttcccagggcgacatcttctgaggtgacccatttggatttatttgttcaagtgtgtctgttaaaatcagtgacattaccattgggtaatgtgggaagcagctttagatggtgtgtctgagggcacagactctttgaaatcgggttggttcaagtctgaacccctgttctgcagttcactcactgaccttggacaagttagtctcttggtgcgttggcttcctcatgtgtaaaatgggaatgatagtgctgtgagtaccaacctcacagtgtggtttgaggactaagtaagctaatatataaagctcttagacatttggtgtgttctcagtcagtgcttgctgtgattattgtcggtaataattatatatttctttgaattacagaattctgaggtagaatgtgcctggagatagtatagctcagtagtccctgttctgtacagttggcgtattgtatctgtggggtccacatctgtgcattcaaccaaccacggattgaaaataattcagaaaaaaaataacaatgcaacaataaaaataatacaaataaaaatactaaataactacgtagcatttacactgtattaggtattataagtgatctggagatgatttaaaatctctgggaggatatacataggttatatgtaaatactgtgctattatacatcagggacttgagcatctgtggattttggtgtctgagaggggtcctcaaaacagtcccccatggacatcaagggatgactgtattgaagtcaacctggacctcattccagacactactgaatcaaggagggaaatctgtagtttttagattattcccaggtgattcaaatgatcggtcaagattgggaactattgagtataatctgtttacagtatggccccagcactagaagcttcatttcctggtagatgcagaaatctcagacgccactgtagacctactgaatcagaatctacattttaacaagatacctagtgacctgtctgcatgctaacatttgagaagcactgcttttcttctaccaatgggaataattgggtgataaccgcaggttaaagatgaattatctctccatttttcccattgctggaagggaaacagtgtggctaaaccagtgtatagataatcatacacttaccttccctatttcttggcctaggggtaaatgcttttctggactaaactgctgcgtaacatgtaacagaaagaacagttataattatggctctggctctactgtttactagctatttggcctggatccagtcacttaatctctctgagtctgactctcctcacctgataatggaaataatacccagaaataatgtatatcaattatctagcgcattgcagtgcctgcatatgtcactggcttttccttttcccttgccttcaacctttcattgataaatctgtagtgtagttctagtcccttagaaagggccaccagtggagtctcagtaccatctcatctctgtgggctcttcttgcccttctcccagctatcttgagtatttaattgtacttgcagaaaactaagctttacacaatatatatatatatatagttttctctatctgtttctgcaaaatgccttttacttaatggagactattatctaagagggctagaagatgaagaactaaaggatttgagtaattgagttgatacaggaatcaaagtataacgagatatgacaggcagctcttttatgaattcttaatagttgaccatttgtttaaaaaaatgtaattcctggtttttaaaacttggcatcaagaaaaaaaatcctcggtaggtttgaagttgtttgaagtcttttagattggttccaagcaagaattaacgtggtaattatcagaagatcactgaattggtaagtaatgagcattatcttctttctgaccagggaattaatacaataaaaggaagttcagggacttgctctgaggacactagtagtaggtggcagagagtctaggtcagagagttggcagttgtagccagtagggcattggaagcaacagcagcaggaggaaatagaaaagtccagttttacccagatcttaatggacttagggataggcaggattgtgaactcaaagcatataataaaaattgttacaataatagtttttctctatggggtaggtatactttcaggtgctttgtataccttgtgcctaaacttaacatccttgcaaggtgtagacatgatcacatatattttatagaccagaaaataaaattgaggcccagaaaggtgagtaacttgtcctaagttgttcctctaataaacaccagagctggtttaacatcatgttcaatagcaatgtgagtgaagagactgttataaaactcaattgaaataatgtctatcaattaaaataaaatttattattttgtctataatgactttttttggggtagaattgttaatttaaatttagactgtgatagtcaactcagcctgtcttaaagggacttttttgaatgttgcagaatgatcctttgaaatgtatttcttttatactctgaggctaattaagaggtatcttttgtttttttaaatgccaaagcttgtgaagtcttcagtttagtgaaacaccagtttaaattgaaatatcacaacacaaactgatttgttggtggttatcaattggcatatttagtcataatgagtattcacataattgtgtctgttagtctgttattccattcagatccagatgtagataattatcaatgattgcacagagtgaatcatgtatttagacagatttctaagttacggttggaagaactacaaatgagaggacttgggttccaggcctgtttttgtgaccttggacatgtcacttgaaactcaagggaatgaacctgagtttccattatcaatcaaaagagaataatgttatctatctaacagaattgttatgagtaggaggatgtgcttgacaccaatttctgcttcttagactagctctgtaaccttgagaaagacatttaaaaccttgtggtacattggttttcttatctgtaaggtcagtctgtgctatgtgaatatggttgcaaggtaaggagggtgcaagtaaagtagctgaattagaattagatgatccctatgggtcccctcataatctgtggtcctgtactagtcagaactgcctgtgtgttggtatgtggtgaagtgttacatacaactaagatactgtttcttcttattattattgttaacagggccaccccattaaggaacaggcactgtgtaagatattgcatgtattacctcaatccttgtaacaatcctatgaggtaggtagtattctcatttaaagatggaagaatttgaggctgagagatgaattagctttccacagccatagagctagttggttaccagagacgtagatcagtgtgattctaataactgtactttcccccatacctcactacacatgctactgtgacaggccaaaactaggacatgggcttattatgccacaaactgcctgtaccaaagaatgtaatgacgactgagtagttatgttcttcaccaccaaacacttaacagttaaagaaggggagaaagacagtttcacttcagtgttcctgctgaagtagtaaaaattattactattactaattctccatcctcggttatgaatcttttaaataatctctttggcaaaatgggtaatacaaataaagcacttctgctgcatactaagtatgacagttatctaaaggaaaactgcttctgtgattgagttgccagctgaacttttttcatgggatgccatttttatttgaaagaacaactgatagactatggtattcggacgttttattaaaaatgaatgaggtggccaggcgcagtggctcacacctgtaatcccagcactttgggaggctgaggcgggggatcatgaggtcaggagatcgagaccatcctggccaacatggtgaaaccccgtctctactaaaaatacaaaaattagccgggtgtgctggcatgtgcctgtagtcccagctacctgggaggctgaggtgggaaaattgcttgaacccaggaggtggaggttgctgtgagctgagattgtaccattgcactccaggctgggcaacagagcaggaccctgtcttaattaaaaaaaaaaaaatgaagcaagcctgtcattttaaggaaaactgatatttgtggccagtgataaaatttgaactttcaagcaaaaactagagttttggaaaacttgtatcctggcctatgagcttgacagctctgaaccttaaaagacttttcagatgagattggtggtgatattagtgaatgtgaattttttgatgttatataatgagatgtgtcaacagttggaagatctttataacttagtgaacttgtattttataaatgaacaacacataatgttacaaaatcatgcataggcaaaaaaaatctattccaagtacaagatcaatgaatttttatattaacagtatgaaaaaattcattgataaggtttcacatgccacattgcaactaacctttggtacagtattaaagaagaatatctagagataggcgaaaaggctattaaaataccttgcctcttccagatacatatccatggaatgccaaatttctttcttatacttcagaataatattgaaacagattgaatgcagaagcaggtatgagaatccagccatcctccattccatctccaatccccaggccacagtctggtactggcttgtggcctgttaggaaccaggccacacggcaggaggtgagcagcaagcactactgcctgagcaccacatcctatcagatcagtggcggcattagattctcataagagtgcataccctactgtgaactgcgcgtgcgagggatctaggttgcctgttccatcgaatgcctgatgacttgaggtggaacagtttcatcttgaaactatccccaccctaccccaccccccatggaaaaattatctcccatgaaaccagtccctgtgccaaaaagattggggaccactgttctattaagttggatgttaaaaatatttgtagaaatgtaaaataatgatactcttctcactggtttagtttacaaactaaaccattttcataaaatattttttaggctaatataatggttggtttattattgatacttttaaaggaattaacatatttttaaaagtactcagttttagtttctcataggaaaatcgcagtagttataaccacagaagcaaaagctctttggagtctttggtaattttttaaagtgttaaggtattctgaaatcaaaaaagtttgagaattgcagctctagttctctaatctttcatttcagtagtggttgaaacctcttaaattggttctttaagtcatgaatggatcttgacccacaaattgaaagagcgtgggctagagttagaggattacattgtgaagggaggtgggattttgctgaattttgcttgagttgatgtttgagaacgtgccaaggtgtgaagtaaattgagtaaagtttctatctggaaattagctatttgtggtcatcctccaaaccccattcaagtcttacctactgtgagtctcctctttgtaatttctttatgcctttctcacttgattatcaaccatgtacactggttctctctgggccatacatttacattttattacatggttcatattgtatttgtttacatgcctctttcccttactagactgtgagttcttttgagaaaagaatccctagcttattttcctttgcattcctaccaagttgcagacacataaacgtccctcagtaaatgtttgctgaaggagtaaatgagaagaaaaagagaataaccaagtggggcaaggcttgggatatttggaacctaatcatgtaagcaatggagggccattactatggaagtggtatgagtggtgttttaggtagttaaccctggccctggtaagaaagctgggcaggggtggatggaggctagctcttagctggaccagccaagagactattagagtaatttaagcttgaagtgatccaggcctggattaagatgagtgctttcgccatagataataaggcatacatcctgaatcctgaggagtatttgcaaaaacagaaacaataccatccatactgcttgacagttgttgtgtacttatgctgaattctgtgttaagagctttatgtatattgtttcgtttaatcttcacagcttccctgaggtaggtgttgttattatctccatttttttctagttaagtacaaataatacatgttcatttgttgaacagttagaaaatacagataagaaacctcctccccccacaaagacatatatcactcataaatccaaatttaacaccaagacatatgaccactataaacattttgggatatatccttccagacataaaaaaacatatatattgtgtgttatatatgcctgaatatgaggaaaccatgaatataaggccttaatgctgtttttccattgaaaggaagggctaacctattaagcgtttagggaaataggcaaatatctacttaaaatatttatttatgtaatttagaaacattttatctttttgggaaaaaatgtgtatatgctctactgcatcagtatctgtattgttgcttagaaccactttgaatcttcagttttccagagtatatattgagatacagcacttttttgtgtctatatttattgtagtcactgatgattttatctcaagctgtaagtacttattcaaataacaacaggaagtttcttcatttgtactgtggtgtatactgcattgcttttaaaaaaaatgttaatggaggttaaattcatataacataaaattaaacttttaaaaaagtgaacaatttggtggcatttaatacgttcacagtgctgtacaaccactatctccatgtagcttacatttttacatcaccctcaatggatacatcacccgtatccattaagcaatcatcctgtctttccccttccctgctggcaaccaccaatctgctttctcttttgatgaatttacctgttctggagattttatataaatggagtcatataatatatggccttttatgtctggcttctttcacttagtactgtgtgttttcattgtttatccatgttgtagcatatatcagtacttctttcctttttataactgaatgatattcctttgtgtgtatatagcacaatttgtttatctgtttatcccttaatggacgtttgggtttccatcctttggcttttttttttttttttttttttttgagatggagtcccactctgtcgcccaggctggagcgcagtggtgtgatctctgctcactgcaagctctgcctcccaagttcatgccattctcctgcctcagcctcccaagcagctggaactacaggcacccgccaccaggcccagctaattttttgtatttttagtagagatgggatttcaccgtgttagccaggatggtctcaatctcctgacctcgtgatccgcccgccacagcctcccaaaattctgggattacaggtgtgagccactgcacccagcccatcctttggctattgtgagtagtgttgccatgaacatctgtgtacaagtattggttttgagtacctgttttccagttctttgggtatatacctaggagtggaattgctgggtcatatggtagctctatatttaactttttgaagaactgccaatctcttttccacagcagctgctccattttacattcccaccagcaaagtacaagtatttgtcaatttatttttaatgaagaacacaataagacagggaaagtaaagaggaagtatgtgtagcctttgagtctattagagctctgtatctcagattttgctgatggacttattaaatatttatttagcatcacttcagcactaaatgaaatttagctcagggaaatgaatctaatctgtttcaagtagtgaacagactaagaagtgatgatcagaggaatgaaggaatggaaatttaaatagactaaagttccttgagggcaaaggccttattcatctttgtgtcctcagcatttaacaaagtacttggtgtattataggtttttttggggggtctccaagactaccctaggtccagtgaattatctaggacttatggaactcagatgtagtcatacttatagctatgctttatactagtaaaaggctataaagcaatgtcagcaaagaaaaaaggtgcatgcggtgaagtccagaggaaacctgactcaagcttccaaaagtcctttccaagtggagtcacaggacttgcttgattcctccagcagtaagttgtaacagtgttgtctaccagggaagcttgttacagacttagtgctgagattttttggctggggatggtgaagggggctgttcacataagcaccctaaccctagcacaaatcaaaattccagactcccgaaaggaaagcaggcattaacagataagagccactctgatcagttctggggatagaacccttgtgaaatcttcagttctcagatactagctaaggccaaccttagcagtcagacctgctacgttaattctttttcacatagatgttcagtttctttaaaaaatatgttcttaggtctgtgaagaaaaataaacaccatagtagaaagccagcagggactttaatgtaagacagacctggatttgtaatatgggggaaaaattgtatagtttttctgagcctcagtttccttactataaagtgatatatcacagggttttagtgagaattaaaagtgataatgtttataaaacactaggcataatgtctgtcttatatatagtaagtagctgtcagcattttttttcagctcacttgtatcagtccaggtccagccaggagagagagactacacagtactttggacagggcatttaatataaagaattatttacctccaggcgcagtggcttatgcctgtaatcccagcactttgggaggccaaggcaggcggatcacctgtggttgggagttcaaaaccagcctgaccaacatagagaaaccccgtctctactaaaaatacagaattagccgggtgtggtggcacatgcctgtaatcccagctactcaggaggctgaggcaggagaatcgcttgaacccggaaggtggaggttgcagtgagccaagatcacgccactgcactccagcctgggcaacgagcaaaactccgtctcaaaaaaaaaaaaaaaaaaaaaaagggccgggtgcggtaatcccagcactttgggaggccaaggcaggcggaacacgaggtcaggagattgagaccatcctggctaacacggtgaaaccccgtctctactaaaaatacaaaaaatttagctgggcgtggtggcacgcgcctgtaatcccagctacctgggaggctgaggcaggagaatggcatgaacccgggaggtggaacttgcagtgagctgtgattgtaccactgcactccagcctgggcaacagagtgagactctatctccaaaaaaaaaaaaaaaaagaattctttaccataagaggagactgaaataatgagaaattgactcctaggaagaaaactctaaataacagcagatatagatctgctgtatctataataagaaatataataatatgattgatgtgtgacaaaatagaattagtataatagcagctaagcagctaccccgggaccgagatatcatacccaaagagccgtctccctcaataccaccaaacacttcctggccgagagactgaaatctgaggggctttggtggagaaggcatgactttgactctcagaatggcagagaagtaagtccctatggacttataccagcagaacttgctggaaatctgtccttttgaagttgccaaaaactaccctctaggatacttgggaaagctcttcacaaggagttgtctcaccagaggcactttgctgccatatgacaacatgaaaaggtttactgagggaagctactagctgctggctgctgtccattgtaggagctaggatggagggaaactgcttatcctgtaagaacctgctaggcaagcacaatgggacctggaagcgaaatgctttcctcctacagtgtatctcctgtgtcctctatgggtaaagcttgacatcatgcatgctttgcaaaggaaaagtatttaaagggcccaggttcattttcacacagccggcaaaaaaggtaaatttggagctgataatcaattaattgataaccagtatatagatggaatggatgtttaattctaaatcctcagaaaacaggaagaagatggcaaatggagagagatctaaggaacctcaaaaataagtaagacacatgcaaaaaaaaaaaaaaaaaatgaagttggaccttacatcaataccaaaattaactcaaaatggatcaaagacctaaacataagagctaaaactataaaactcttagaagaaaacttagagtaaatcctcgtgaccttggaattggcagtggattcttagacatgacaccaaaatcacaggcaacaaaagaaaaaacagataaattagactttatcaaaattaaaaacttttatgcatcaaaggacgctattaacagagtgaaaaggcaaccaactaatggaagaaagtatttgcaaaaatatatctgataagggattaatatccaaaatatataaagaacttttacaactcaacaacaaaaaagcaaatggcccaattataaaatgggcaggggacttgaatacacatttctccaaagaaggtatacaaatggtcaataagcacatgaaaagatgaaaaggacatgaaaagatgctcaacatcactaagttgtaaaggaaatataaatcaaaacaatgagataacacttcacactcattaggatgaaaatacacacacaataacaagtgtaagtaagaatacggagagattgaaactcttgtgctttgccggtggaaatttaaaatggttcagtgctgtggaaaacagtatggcagtcccttaaaaagttaaatattgtcactgtgcaaacaccaaagaattaccagtgatccagcagttctgcttctgaatatttacccaaaagcattgaaagcagggacttgaatagatatctgtacacccatattcatagcagctttattcacaatagttaaaaggtggaggcaacccaagtgtccattgacagatgaatggatggacaaaatgtgatttttacgtaccacatattgtaggctacaatacagtgatatgcacataaaattgtgttttatataattttaacacaatattattatttggacttagaaggaaattctgacacgtgctacaatatggatgaaccacaaagatatggtaagtgagataagtgcagtgagctgagattatgtcacggcgcaaataaatattgtttgactattcacgtgaggtacttaaagtagtcacattgatggagacaaagtagaatgctggttggcagtggacggagggagacaggaatggggagttagtgtttattgggtgcagcatttcagttggggaagatcagaaagttctggagatggatggaggtggttgcacaacaatataaatatacttaatgctatagaagtgtatactgaaaaatggctaaaatggtaactttatgtatatttaaccacagttttaaaaaaagatgaaaggaaactgcaaagaatatttatagtatgatcttgaacctcagtactagaaaagatagattaacggggaactttatttttaaaattttaattaaaaaaaatttttttttgagacagtctcactctgttgcccaggctagaatgctgtggtacaatctcagctcactgcagcttccacctcctggactcaagccatcctcccatttcagcctgtcaggtagctgggaccacaggtgtgcaccaccacacctggctaatttttattatttcttatagacccagggtctccttatgttggcccaggctggtctcgacctcttcccaccctggcttcccaaagtgctgagattacaggagtgagtcactgtgcctggccagaattttatttattatttatgtacttcaaaatataattttgtcatgattgaattttattttatttttttaaaatgcaagaacaaagtggatttgtaaagaaaattgaaagaactgagggtgttagccaaacaggaattgatgacagcagagtggactatctggctgtatgaagcatacgttgtcatacctgggctgtgtgatacggccttttgttccgaggctgcacatctgtacagcatgtgactatactgaatactttaggcagttgtaacacaatgtatctaaacatggaaacatgtatctaatgtatctaatttatctaaacatgtacagcaaaaatacagtataaaagataaaaatgatacacaggtatagggcacttgtgaatgcagcctggagaattggaagttgctgtggatgagtcagtgagtgagtgtgagtggatgtgaaggcttcgggcattactgtacactactgttgactttatcaacactgtacacttaggctacgctaaatttttacaaaattatttttctttaacaacaaatttgccttagcttactgtaacttttttactttataaactttaaaatttttttaactttttgattcttttgtaataacacttagcttaaaatataaacacattgtatagctgtacaaaaatattttatttgtattcttattctataaggtttttttaagatttttaatttttttttttttttttttttttttttttactttttaaacttttttttgttgaaagctaagacacaaacacacacattagcttaggcctccacggggacaaaatcatcagtatgctttccacctccacatccttcccactggaaggtggtaatggccagtaacacacatggagctgtcattttctatgataacaatgccgtgtgctggaagacctcaggaaggacctccctgaggtaacttttttttttacataagtagaaggagcacactctaatgaaaaaaagtatgatatagtaaatacatgaaccagtaaaataaccatttattatcatcaagcactgtgaactgtacattgttgtatgcgctagacttttatatgactggcagcacagtaggcttgtttacaccagcatcacacaaacacataagtaatgttttgtgccatgacagttatgatgtcactgtgataggagtttttcagcttcattataatcttttttttttgtggcagggaagagttttgctctgtcgcccaggctggagtgcagtggcacgatctcagctcactgcagcctctgcttcctgggttcaagcgattcttgtgccctcagcctcccaagtagttgggattacaggtgctcaccaccacacccggctaattttgtatttttagtagagatggggtttcgccatgttggccaggctggtctcgaactcctgacctcaggtgatcctccctcctcggcctcccagagtgctgggattacagatgtgagccactgtgcttgaccagcttcgttataatctcatgggactaccattgtttatgcaatcagttgttgaccaaagtattgtcatgtggccttgactgtgtatgtcacaaaaggcagagtttctttggtcactttagaggtattctcattcattctgttcttgaatactagaaacagtttataatatcactaggttttgaacaccttacagtgaggcagaatggccatttagcacatattcctaaatagctgatgtagaggaagctaaggaaattaaaggttggttatttggaaatgtgctactttgtaggatttattcccatagactatataattttgcaataaatagacgtgggggttgggaaggaattctttttgagcttctcctatatgttaaatattgtgccagataagcgtcacctgattatctcattggatgtcacaactttatgtggtagatattatctattacacagttgagaaaatttagagtcagagatattaaggattttgactagtcacatagttagaaagtgacccagccagaatttgaatctgtatcttcaactcccaaggttccgtccaacctttctattgcatgatgaaaggagttacatatatctgtaatataactagtagagtctgaagtgaatagtttatatgatttgagagtcaggagttgtaaattctgggttctctttcatacctacctagtttgagtgactgtgggcaaggcacttctctaagtctcagcttcctcacctgtaaagaaaaggggtttgattggttatttcttagacacctgcgaccactattgaagaaattttggtgtgtttcaaagataatcttcaagaacccagtaaatcctgtatcagattttaccatgaaacatactgcttataccagctgatttttaatttaaaaaaaaggggggagcggtaaatgtggagggagtagtgaatgtaacaaataactgtcattgattgtcttgatagggaggtagaatgagtttttttgcagcgaaagcttagtttactagttaacagttggacctcatgttgggaccatgttgttagatactatcagattcgtatcacttataagtcttcatcttatctctaggtattttgaactcttatggtttggaagcagaatgacgccctgtggtcacttagcaatttctcttcttgaggccaggcacagtggcttattcccgtaatcccagcactttgggaggccgaggcaggacttgaggccaggagtttgagaccagtctgtgcaacagagtgagaccttgtccctacaaaagataaaacaaaattagccgggtgtagtggcacatgcctgtagtcccagctactcaggaggctgggataggaggatcgcttgggtctgcgaggtcgaggctgcaatgagccatgttcatgccactgcactccagtccagcctgggcgacagtgtgagaccctcaaaaaaaaggtatatatttttttctcaagccagagagatttgttgctgggattagtttttgcatgtaatagcatatgggattttacatcttctgttcctgtggcattccttttatgtcccaattcaaaaataggctcaatacttgaaaaacaattaacttgctgcgaataacatagtgaaacatcctgagcaacttgatttgcttttttttagtcagtgtggtctgtttccttctgttattagatacatgcaaggtgatgtgaaattcattttcgactggggagtaagtcaatgaaaaatctgagctcgtacccattacccaagttatttgtagaagacagcttcattttgtatcttcctttgctttatctcgctttcttctctccaaactgcagagtggtaagaattctttttgttccattttcattattcttcccctttcattttgttagacacagaagaaaggcagtgggatggttttgtggatttgtttttttgttgtcgttgttgtttttcttgagactggctaatttttgtattttttggtatagatggggtttcactgtgttggccaggctagtctcgaatccctgacctcaaatgatcctcccacctcaccctcccaaagtgccgggattacagccgtgagccgccgcggctggccagatttgtttttttcattgcttggtttaactttgttgtgtatttccagttttctgcactctgctcatagccaactctcagcaatgatagaagccaggaagaaatactttgattggcagcatgatgtctttcttaagcttctcgggcaacttcactttggttattgttttattggtcaatgcttaggatttatggctagtatattatatcacaagtataactgtatggaaagcagagctttggagcttcagtattgttaagttttctttgtacctctcttaactgtatttttaaaatgctacaaaaaatagtaccttttttctcctctatgtgctatattctgggtaatttcaccagtattttcttgtaattttgccagtattctttctgggaaaatatattgactaatcattcagaaatgatattgataatttccagaaaagcatttagaaaaacggctttaaaaatcactgtcttttcagcatgtatcaattcaacatagtactggaggtcttgtcctaataggtttgaagttatcactcacctccatccccccacacacttttaaaaagatcttctgaagtcctgtagttatttttaatagattttagttatggtatcagtcgcactgtcttgtaattattatgactctcagctcctcaagggcaagaataccagcactatgtttctcaaagcagttgttcaatccactcttactgaataagtgaaggattcttctgcttaaagagattttacagatgtaggtacatataggagcatctaagcagccaaagaagaatataaaagtcagatgctatttttcttgctgtgtatcacttctgtctgtatccactgtacattcacagtccattggcagttgggttttttttgagacggagtctcgctctgtcgcccaggctggagtgcagtggcgcgatctcggctcactgcaagctctgcctcccgggttcatgccattctcctgcctcagcctcccgagtagctgggactacaggtgtccaccaccatgcccagctaattttttgtattttgtatttttagtagagatgggatttcactgtgttagccacgatggtctcaatctcctgatctcgtgatccacccacctcagcctcgcaaagtgctgggattacaggcgtgagccaccgcgcctggccagcagttggggtttttttgatagttacttaaggatttttctgttgcattgtcacatgtccactaaccagaagcttctaaacggttttaattgctgacctcttagttaataaagattcttacggttggtattttatttcttatgtatttctttttatttttgagcagtctctgtgccaagacagagtccgtttctttcattcttaataggccaataatgcttgcttatagacatatcgctactaaaaccttttctttttggacttctaacacatctgatttccatcttgtctgttccagtagcttttcttgtaatttcatctctgctttaaatgccagttattgtttttatgctgattaaaaactcagacttgcatatcattagataatcataatcatctctgaccagacgaggcaaatctttcccactattcgactggcacaaaatagttgcggtttttaccattactttaattttgcaccagcctaatagttgtcatgaagtagtagaagtattgggtatagaatcaagacctaagtctggaggcatctcagccactgtcattagttatttgattatgagcaaatcacttaaagtgtctgaaattcagttttgtcatctgtaaaatgacatttataaaacttgttttatgcattgtgaggactaagtgagatatatagttggttttataagttataaagcagtaagaaacactgacaacagctttattctaagtcatatgtgaattttacacaatgtaaaatttgggtaaaacatgtcctttcaaccttccacaaatcttattcttctccctagaggtaaccactattagaagtttgttatatatccttctttatattttcgatgcatttagttacctttttttttttttttaagagatgggatgtcgctgtgctgcccaggctatctcaaactccagggcttgagtgatcctcctgcctgagccttctgtgtagctagccatttctgcttgagtgttctgttctgctgtcatttaatatgacctgaggtcatttataaagattttaccttattttaaaaaccttgcaggtgggatgttgaaattttgcaataattgataacactattaccttattattaatggaaactgaggttttttttcctagtttttcactaaggcaaacaacactgttttgaaaatcttcgcacatgcttctttgtctagatagagatgtgaagttacaggaaggtatatgcattcaatattttgatagtactgccaaattactttccataacagcatcccaatatacttatattcctactattaggtgtgagagtatctattgactcatctttttgcctattcatggtgttttcatttttgctaatctcatatgtaaaacatggtatctcaaatctaaaagaatgttcgtaggcagcatggtgtgagcacaaaaaccattaagtggaaacaattcaattatccattaacaggaaaataggacagataagtaatttatttgacatgtttatagtttataagagaatactaaatggcaatcatagtaaaatacagttatgtgccctagtggaggtgaatcttacatagtattgagcaaaaatgccaaattactgaagaatacctgcaataggatccatgcctgtaaaattcaaaatcacgcaaaattaatgcatttgtaagagacagatatatacagggagggcttgagagttccaaatagccttatctgagaggtaggaaataaagaagagtgctaaggcaggtggaggagtaaatccatttcctctgacacatctctgtgcaacctgttatgaccaacttttctattgaagtttttgacaatactggcttatacgaatgtgatcttttccttatatttttttcattgttgaactccaggattttatggaatatggttcatatgtgggatgtcctctgggagtgatgaatttctgttaatatgcttttggggtttttgattactttcttaatcagataatccccttctcagacaatcatgaaatgtttattgtaagggaataatatggaatcattagtagggatgagaacctggaaaaatggaaagaacaggggtttgtagtccagcagacacaggttggcagtttgaatttcccattcaatatctatgtgttattgggccagttacttaccttctttcagttagtttccccagtgataggaaatatatttttgtatactgctatattatctcattctttttgcctctatctcttcctcttttccaccatcctggaactgtactgattaggtgcttaataactggggggttatcatcatcattgttaaaatttgtagagaatggtgtgtggaagtaaatttatagaatccagaacaaacaaaaggcacttgtgcatttcggaaagagccttgttcttttgttaaaatctaaactgcatgtctcccctataaaaatcagtatgaaaaatagccaacattgcctataactattattatttttaaataacagatttaatgagatataattcacagaccataaatctcgcatttatgaagtgcttttagtgtttcagtggtttttaatataataatggatgtgtgcatccatcactaaaatctaactccagaacattgtcatctccctccagataaacctggtagccgttagcagtcactgctcatttcttcccgctagtccctggaaccactaatttatattctgcctctatgaataatctgcctattcttgatatttcatacaaatcaaattatataatttgtggccttttgtgtctgttttcaagcatggtgttttcagtattcatctgtgttgtatctgtactttatttttaaaattactgaataatattccactatggatgtaccatacttcatttatccattcatcaatcgacggacattttggtttttttctgctgtttggttattatgaaataatgctgctatgaacattcatgtatattattttgtgtggacatatgttttcagttttcttagttacatacccaggtgtggaattgctgggtcatataactctatgtttaatagaaggactatccaactgtttccagagcagctataccattttacattcccacccgcagtgtagaagaattctgatttctccatgtctttgacaatacttattgttgtctggcattttgtttataaccattctgatgagtgtgagttttatctcaatgtggttttgatttgcataatgacttatgatgttgagcatctcttcatgtacttactggccatttgcacatctcttttgcagaactgtctgaattcctacacattttctggttatttagctccatttatttattacacattcttttgggtgtctacatgtgttagatactgtgctagatctcagggaaaccatgatgaacaagacacagggtctctgcagtaagcttaagttgtcttcagacttccatgcttttgactatcaaatatctgaatatagtcaacctaccaattagtggaaagtttactctattgttatattcaaaagtcctatcaatgaaaatttcttttacgctgttctgctagtaggaatgaaagtacagtgaatggaagaagaggatgaatatctaagtagcaatgttgagcactttgaaaattacaaaagcaatgtatgttctcatttactccttcgtgtgcacgtgcatcttccctcatttaaaagttcccttgaaagcaagggccttatttttaattcatctttttttactccatcagtcgactaacagtgcttggaaaatattaatattagtatatattaactgaatgattgaatgggtcaagtaagctggaaatgagtgttcatgttatatgaccttatactaaattagggtttgcatggcttttattagctatcatccttgccctcaaggatcttgacttagtggtttaaagtgaaaatgagacagatactcaacatgatatacctttaaaaaataaggttaattagaatcataagtaacataaaaagtaagctgcacaagtaagctaagtaaatattaaatattaggaggagtcacttgagtccataggatgatatagagtagtagaggaagtcttgaacagaggtcagatttcatccagatttcaaagaactgaggggataaaacaaaaaataaataaataaaaaagtaaaaactgaggggaaacaggctgatagagacgaagacctaaaacttttctgggttaagaggcagttctcagcagggttggtacttgtcccctttccatccaggggacatttggaaataaaccaacaagtttttggttatcctagtgtttaggggtgctaacggcttagtgtgagttggggctggggatgctgaagtcccacagtgtatgatgaagttaggaattaactctgaccccagtcgcagtagcaccctgcctaagatatactggaaaggaaacagatttagctgcataaggaagaaatagtttttatgaatagtgctcctaagcaaatactgttttttgtttttgccagtgtagaggcttaacgaggagatatatacacttaggtagggtggaatacagttaatggaacattttaggaaccagggcaggaatttatatttgatcagtttggatgattttgattatgcctaacattttctttcatctcatggtttgatatttttcttgtctttctcatagaacgagcctctgactccaggttatcatggattcccagcgcgggacagccaggttggtatctgctgtttgtaactcagatgatgtatgtgtgtggtgtgtttcatcaaagggttgctatgatagagagcatttcctgaaattacttactttgaaaggaaatgtggcttgtttcagcagtgaatttacttttacagatgtaaattaagcatatttttaaattctataagtattatgttattaaaattgtggatattagaagagaaaataatcactcaagcacagtcatgattggttttgtattttcttctccaggctacataataattttttgacctggttttcttgatgccttataattctgaatgctggacttgtctctttattacctgccagttagcccctgcctgcacagagtttttgagtccttgtaatgatctgtagcaagaaaattccattctcctccctgggggaattcagccttatggttttaatcagggaaagcttgcctgagaaagcaaagtttctgccacctttctttgttagatgggaggatgactggaaaagcccaggccctattatgggtcagagcagaattgcttcctacgagacaccctcagtatggtttaggcaagtgtgtaaaatgccttccctatctttttgttgtttgaatacttgagcccatgacgttgaaacagagttaggatagaagaacaggtaaggcttcctcttagagaaatggtgtggcttaaatcacctcgcctctgaaagaaatttgtatctttgatgtttggggatattgacgttcttcaggagatttgaaagggtagctcctagaaatatcttggaatgccattattccttacagggttgtcaaaaaaagctaccattgttatacttgtccaggagatatgagttacagtgctaaacgaaagagttcatagtgtcctttccagaagttcattgaatctcatcagagctcctgaagtggatcttaaaaactaggatggtcggctgggtgcggtggctcatgcctgtaatcccagtactttgggaggccaaggtgggtggatcatgaggtcaggagtttgagaccagcctggccaacatagtgaaaccccggctctactaaaaatacaaaaattagctgggtgtgatggtatgcagttgtagtcctggctactcgggaggctgaggcaggagaattgcttgaactggggaggtagaggttgcagtgagctgagactacaccattgcattccagcctgagtgatagagcgagactttgtctcaaaaacaaaacataaaacaaacaaaaacaacaactacaaaaaaacaaaaactaggatggttgataatcaatagtcacctatttgcaggcctttcagatttgagagtatttgtccaattcttgcacttttggtgctgagttgatatcagagtggccccagataaggcatcgggagaagaagtgttgttagctctgtgttcatcccctactgagttcatcactgttgatattgaagatggaagcttttggtaaaagatagggccatttaccctaaatctaaagagaatgtaaagatttatttgtttttcattctggtttgtgtctgtcctagagcttctctaagctgggaaacttatgcctttgatagtacttttatatcttagtcatatatcagaaaaacattctcatacctggagatccaccccacggagtttctgattgggtaagtgtaagattgggcttacccattcaaatgtttaaaaatcccaaaggtgattctgctgtgtagtgcggttgagaactacagtcctatgggctgctttaaaagcagtgacagtttctgtttcatcctgtacttttcacttaggacatgtaataaaggggtcgtggttagtctcttaatctagtcttgcaaactaatgcagttactttattatttataaaatgttgcttattgtggatttaggaaggtaaagctaattgatgtaaagtatggaaatagacttactgagtttagaagactgaaagggtactgtattcttcttgtggggattatagatcaataaggagctaagcaaaaggagttaataggaatttattaaagcctaaaaaagtagtctctttgattgtacctactttttctttcttttgcagtaggggcccacttctgtaacctgcacattcattactcatgctgtctctgctgcaggcctgttacagaccctttgccatggtttaaagctgctgatttactttgaggcacattctgatggtgacaggtttattttagtttattttcttgggctttaatttgtactctggttggatctttgaattagagatcttagagtgtgcaaataggcaaatattgaatagctgcttgttgtatttgatgaatacagaatccaaatgagtactgctaattaatgcgcctaaccttgtgaactctcactttgcgttttgagatttgggaggcatttatcagcgtgaaacactggtcgctgaacagtctgagctggcggaaatggaacttgtgatctttacgtctcctcagcatggttttggctcagcaaatcgaggaactggggaatggggtgaaggtgaattttaattgtgcttttgtttgctttcccttttttttttttttttttttgttgttgttggtttggtttggtttttgagacagggtcttgctctgtcacccatactggagtgcagtggcatgaacatggctcactgcagccttgacccctggggtgcaagtgattctcccacctcagcctcctgagtagctgggaccacaggtgtgtgccaccacacccggcctgtttgctttccttattctttcactgttccttcctaaatagatgagaaccatctgcagacaagattcttatcagtggctgaatggtgatttaaaaagagataactcttttgattgttttggaccactttcattgtattttctcatcttattctcccaaacaccccttttgaagtagatgaggcaaatattccctctggaaagatgaggaaattgaagcacacagaggtaaagtgacttatccaaggcaacaattcaagtaagtagctaaataagagctgaaatttccccttctgtctgagggtccttttctctgtactggagaattattgattgaccataggaaaatgtggtcacgtgtgaatgtgcccattcactcatttacattattttatttaccatgtgggggcttcgtagacttcttcaagctcaaccacagatgtagaagtctgtgactcctgattaaagattattactactaagtttgttagcaccaagtgtaccaccagcatttcacttttttagtgattcttttgtcatgttatatacagtcccaatagcacattggagttaaacacctgaaggaaaggagcagggaaaaccacccgccacctcttgcatgtttatgcaaggtcacctcagccttctttcttgatctattaagaagctttatgggatgacaatccattgcttttataaagcactctgagcatttcactatactttctaatgtggtttctctatggaagtggaggagacaaacattgttccagttttacataagtgaaaactagttcagaaaagtgagaaattttatctaaggccatgcaggaccaagtgcagtggcttacatctataatcccagcactttgggaggccaaggcaggaggattgtttgagctcaggagttggagaccagcctgggcaacatagcaagaccttgtctctactaaaaataaaaaaaatcagccgggtgtagtggtgtgtgcctgtagtcccagctactcgggaggctgaggtgggaggattgctggaacctgggagattgaggctgtggtgagctatgattgtgccactgcgctccagcctgggtgacagaacaagaccctgtctcaaaaataaatgaataaataaacccaggcaggattttagattgatgatacaatgtagtggtttagattcctagttgactgtttgtgatttgtgcatgtgcttaggcgtgttcccaggccttgattaaggctagaatgttttatggatttgcagtatttttaaagtgggagaatacttatgtgcatcagctctagggtttttatataagaagagcttaagagcagcaatctgattagaagagggccttgttctgcacagcagccttactgtttttgcgaagattatttatatgggatggctcttaggggtttcctagaaagtgatgggggtcctaaggctcctaaggctggcccctcgctcgcttttggtgcaacaactttatgtctgttataaataaggtgaccatataaactttagcattcaagttggggcacttttgagaataaaaagtgatgccaataattagtttcaaacagtcccaggtaaactgggatgtatggccatccttctctaattgaagaaatacagtcagtgttttcttaaccaaagtgatcagaactagtaggccgtgggttaatctaaacaattggttgaagtggggaaatattttaaacttttattttaatatagagcatttttaatttaaacaaatatatgcttactctttagtttcctgatatgaggtcaagatccttatatatagatgtgattgaaatactacttgaattttttgcataaactgtgctcccagagcatcatctgtgagttctaatttgtttttttttttaaagaggaacacggtcttgatgacattcagagcaatttgggtgaaactgtctatctagatttgtatggttttcccttcttgcccggtcttttacagttatcctgcccacatctaatttgagcctaagttttcagtgtcttgacttatttttcacaaagcattcacattagttattttcaaggaaattttctaatttatttcattgatgtgtgtatatatatatatatatatatatatataacatttaattatataattataagaacttacgacttctataaactggcaggtgaataaacacaagtgatttttggtaagcatacaactcagctactgggagaagaaagggcttgggggcaaataggagagagttgtttactagttttaggtggtttaagactgttaaaagcgtccctttattagacttgggaactggagaacattagttaatttaacaagttaattgattaaaagaggcttatactttaatcaaccacagggaagacttacttttgtttcatcaattttgtatctccttagtggttacttgactaaattttgttctattgttttagagtcaactcggtttgggggatgggtagggaagaggattagaacagatacacacaaactagagataatttgttttgcttcattggggtggcctaaccaagtaagggatgttcagcagtgggatacttgcaaaactaagtgttgaaagctttcattatttcatcattaaaaattatttaagctgtagtgtactattttgtttattaattgatgaatacaaatgtatatatttgtggtacacaaaaaacccaactaatatctgctaactgctttacagtttacaaaaccctcctgtgtatatccacttttgatcttcacaatagttcagctaggtggcttgggctttattatcccaattttatagataaaagaataccaaagcacagagactgtcaaatgaatctcccagtcttagttatataggtagtaagtaaagaattggacttgaaccccgattttcagcctccatgtcttgtatttcccttttgtatttgtctgtcagtgtctctctgaatataagtgttcttttgctggtgtgacaagataagatattctggaatctttggagaatgtgggagcatgaagtcttcatatgacttgaaagttcttgagtaacttatttctgtcaagttttctatcttgtttgttaaaataacttatgatctaaattttatcttttcatattttaaatacaaagaaaaatgtcatgttgtcaatttttttgagactctgttgcccaggctggaatgaagtggcgcaatcttggctcactgcaacatttgcctcccgggttcaagtgattcttctgcctcagcctcctgagtagctgggattacagacatgcgacactaagcctggctaatttttgtatttttagtagagacagtgttttgccatgttggccaggctgatctcaaacttctgacctcaggtgatctgctcacctcagcctcccaaagtgctggaattacagatgtgaaccaccacgcggggcccattctttgatgtttaaaatgcttgtcaatgacttctcaaaactatatttttttcttcaattttctaaaattctgttgaaagacacaatgtcccattgattagcagaaacaagtgggaacatcaaaggagatgcttaagttgacaaatataacatagacaattatagatttaaattcagagtggcagccttacttttaataagagggtaaatttaaaatgacctaagggtttcttttcttaacaagtattttctttcctcaagattttttttttcttttttctaaccagttttttcatgggtagaaaatgaactttattttagtcaaatttttgcaatgaactttcaaggctttttttttattgggagctgtggacaacagcaaatatatcttctgtagtgctcatttggcttgattgaagaaatgatgactacttttcttccctcggggatagttggtggaatggaggacatggtaagtgtgttcaggttctagcttagtgcttttgagcttaaaaaaagactgaccccaaggaggcagttgcttttatgtcatgacccagtatacacacatacatatatgttgactataacttagaattagtcttaccaaatgctgcctatcttaaccatgttctaagtactgtgatattttctgtccccttcaaaaaattgtcgattgtgactaacgattgaccaaaattgatttctgctggatttttcctggacccactaatggattgcaacctgtttgaaaaacattgttctaatacttacattccttaaaaatgcaaccttaaagaaacctcatgcctttatttttttgagatggagtctcactttgtcacctaggctggagtgcagtggcatgatctctgctcattgcaacctccacctcccaggctcaagtggtcctcctacctcagcctcctgagtagctgggaccgcaggtgtgcacctccatgcccagctagtttttgtatttttggtagagatggggtttcaccatgttgcccaggttggtcttgaactcctgagttcatgcgttccacccgcctcaacctcccaaagtgctgggattacagccgtaagcttccatgccgggacacaagaaaccccataccttttagcagtcactcccctactttccatctctccacccaagctctaaggccccccagctggagactgaattaaaatggttcagaagtaaaacgttaccccttctgtatctcgcaatctataataattttctttctgatcctctttttttttttttttttaactaaacatgcttttgctttgctcttaaattacaggaagtgtgaaattgctttttttcccccctgttaggttgtctagaaccccactttcagcctttgtgcaaagctttttcaaactgttgcttctgtccaacatctgacctcaggtcacccatcaatagtttaggtccttctgtggtgttgtccttacaccctctagtggatgaaggtctggtatatgctgtagtgtctagtgttcttgtagcacttttctcaatccatgtaatcagctttactattacattttagatcatttcattcttcaaacagttaaaaatcttttcactccaggaaagactgttttatttcttctgctgctcactgccatgctaagtaatatgcttattctgctgtttcatgatttgtccaaattttggcactattctttggcttcctactgttgaagatgagaaattagcaattttattttattttatttttattttttgagacaaggtcttgttgtgttgcccaggcaggagtgcaggtgtgtcatcttggcttactgcaacctccgcctcctgggtacaagtgattcttgtgcctcatcctcccctgtagctggcattacaggcgcacaccaccaaacccgactactttttatatttttagtagagatggggttcctctgtgttggccaggctgatctcgaactcctgacctcaagtgatccgcctgcttcagcctcccaaagtgctgggattacaggtatgagccactgcgcctgcccagaaattagcagttttatagacctctttccttctaataaagccattttttgggtcaaatcaatatttattgatttgtgaatatataataattattatgactatttattttatatccaaacaaaatattattactttgcctgtcttacatatttgtttcccttggagttactatgtagagaaaataaatataaatatgtatttggctgttgctttttaaaaagctctatggccagcgcagtggctcacgcctgtaatcccagcactttgggagactgcggcgggggaatcacctgaggtctggagctcgaaaccagcctggccaacatggggaaaccctatctctactaaaaatacaaaaattagtggggcatggtggcgggtgcctgtaatcccagctacttgggagctgaggcacgagaatcgcttgaacccaggaggcggaggttgcagtgagctgagattatgccactgcactcgagcctgggcgacagagtgagactccgtctcaaaaaaaaaaaaaaaaaaaaaagttctattaagatgtcatttctatacctaaaatttactcaatgtaagtgacttgttcagtgatatttagtaaacgtatagagttgtgtcacagtccagctttagtacatttccctcattccccaaattctttcaaattcttttgcagtcattccctgctccctctccagtcctccctctctcccccagccaaccactgctctgctttctgactttataaaattgcctcttttgtgctggacacggtagctcatgcctgtataccagtactttgggaggccgaggcaggaggatcctttgagcccaggagttcaagaccagcgtgggcaacacagcgagaccatgtctcaaaaaaaacaaaaaaaatggtcgcttttggacattttatataaatggaattatatgatatatgtagtctttggcatgagatttcttacaattagtataatgtttttgaggttcatccaggttgtagtatgtatcactgtgtcattttttatttttttttgctaaataatatttcattatagtgatgtatcaccttttgtttatttgtttaccagttggtagatatttgtattgtttccaacttggctattatgaatagtgctgatatgaagaattacctgcaaatctgtgtgttgacatactttaatttctcttgggtagatttctaggagtggaattactgaggcaatggtaaactcatgtataatttcttctttttaagagaaataagccagtgtggtggctcatgcctgtaatcccagcactttgggaggctgaggtgggtggatcacttgaggtcaggagtttgagaccagcctggttaacccagttaaaccccatctctactagaaatacaaaaataaaataaataaaataaaataataataatcataataaaagagaaatgaggtcgccaatgctggagtgtggtggtgcaatcatagttcaatttagctttgaactcctgcctcaagtgatcctcctgtctcagcctccctgagtagctggtattaccagcttgagacaacgtggcctcatgcataacttttaaagaaaccacagactgttttccaaagtggcttggttttatctaactttttgttataatgagtgtatggtaatagctcattgtggtttaatttgcatttccctaataattaagtaggtaccttttcatgtgcttatcagccacttatgtttgctttggtgagatgtctattcaggtcttttgcccactttttatttggtttttcttcttattgagttgtaagaagtctttatatattctgggtacaagttctttgtcagatttacaatttgcaaatatttgttctcagttatgaggttttgtaatatgtatcttcgtccttctccaataaaagaaaacagaattgttttcatccatatttgctaagtttgcataaattctgaataactattttatgaaagcaactatgaaaacaggcatttgcctctctgctgaggcctggtggttccttcaaagaagatttgcaggtttgtagtggcttcgtgcttggctacagccttctcccgatgcttggtggcaagcatgtttgggcaggaaagctcttcatgtgatgaagagaaattgtgctgctttctgcatgtcctaaggtatatggcagagtgaggatcagctaggttcattggcttttatttttttaaactgtagcttctatataaagctgttttgtggcaatttctctgcagacagacagacagacacccctgcccccccaacagacacagacacacacacatatgcacacaccctccttggctttaggtttaaatatcaatcctgctgttgcaggctaaatgactttaggcaagtttttgttctctgagcctcaatttcttcatctgtgaaataggaataattcctattatgaaaggttgttacagtattagagataacatatgtaaatttcttggcatgtaaatagggctagtaagtcatttttctcatttattttatggaaaagaggccataaggaagctttacaagggaatgattagttctcacattctgatttaagtctattttctcattttccttttgattcttattcactatttgaaatgaattatctgtagatttgaaatttctagctcaggaatctagctgttggacatctccaagaaaaagaggtctttgtgaaggaaatgaaatctgtgtaagtttatttacctgactcttgggtcttggcagcatgcgtataagagggagtcatttttgggactttataacttgagcagaattttgtaaaaactgagccagacattcaaggctcgctacaatttgcttcccatttttccagctctgtttctcattactaccctagtaacatatttcttctgcttttttttttttttttttttttgagacggagtttcactcttgttgccccggctggagtgcaatggtgcgatcttggctcaccgcaacctccacctcccaggttcaagcaattctcctgcctcagcctcctgagtagctgggattacaggcatgtgccaccacacccagctaattttgtatttttagtagagacaggatttctccattttggtcaggctggtctcgaactcccaacctcaggtgatccacctgacttggcctcccaaagggctgggattataggcgtgagccactgtgcccggcctttcttctgctttatatatgtctcttcactgtccttcaaatatctatcttgggcatttatttcttcctaatgcctttcgtttgaaatgtttctcctttaccagcagaatcctaagtatccattaagatccttgttcacaacttaatctcccttatgaaatttttccttattgcctctgattgtttcaaatcgtttaacatgtctgtatgaacatttccataaagtttggatccaagagagtttgggaaatactgcgaggactaggaggaaatcacttaacttctctcaagactcagctttctgtgaatgtgaggataccataggatgtttgaaaggattaaagtcttaaaaatgtcctaggtcaagagtgacttattgcctgatgttgtgaaaataggttgcactaaactctgcctttggctttccaggtaacccagaaagtctcttctcatcttctcatctctgggcccaagtttcttctttttgctttaaggactctttggtggtaatgggtttggtttttgtgggtcctgggagtgtcatactttgagcgttctctcacctcctaaatccttcagggctactgtggatctgtggatagatgaatgatgccagaagtattaaaaatatggctggcttttattctcatcgctcttctgtacctggtttgtcacatcttgccttttatgccgcagtttgacttttccccctagctttgcctctttttgcttagtttagggttgctgggattgttgagctgtgattgttagtccactcatgacccagttgcttaaatattttgttaatggatggatcataatttcactgattgacttttcaatagattgacctgttattttgtatataggcaattgatttgtattgtaatgagaggtttaatgtgaccatcaaaaagaattatctgactaaagatagggccatttacaaaggaaaattatagaatttccattagcaattttcaaaatcgagaaattcatctgactagacttggttagggcagctaagtagttagtagggatattcttgctgtagcggttagtactaccaagcaatcgatggtcttttataatcaattctggctaccattttgtgagttacatttaagaagcttgacatatttattcagtgctttgttcttcaacagacagtcactggcagatgatttagaatgaaaccaactaattaagtataaggtaagacaaaaggcctcatagttggtggacaatatagttacgggtttcagttacagattaaatattttaattttcttaatagcattagctgcatactattatactgatctcatctagggttgattagagagacaggggaatacaacaggtaacttaagatcttgtgttagaaactttggtaccaccagaaaatactctcagcaagtactatgtaatcatgcatttaaacagctctgatctcactggagtctcattactctgcttagcttttatctgctgaatattctttagtgtgatatcctaagccttctgtgatatggcctcagtctttttccttctgttttgtgtaaggtactctgttcaagccacactgtggggtggggtagcgtagctttggaattaaatgtgggtttgaattctaattcctttacttacactatttcccatgtcccatgtttaaatacaggtcgtcctttaaatctcacttcaaatgctaccttctccttgaggttttggctagtgcatttatttgcgagctgactcagtgtcccagggcacatgctttctactttgctttttgtgttttttttggagacaggatctctctctgtccctcaggctggagtgcagtggcggagcctcgaactcctgggctcaagtaagtgatcctcccacctcagcctcccaagtagctggaactacaggcatgcatgtgctaccacgcctagctaattttttaatgttttatttttagtaaagacagcgtcttgctatgttgcccaggctggttttgaattcctgagctcaagcaatcctcttgcctcaggctcccaaagtgttgggattacaggtgtgagccactgcacccggccttctactttttttttaaatttttttattttttatttttattttttgagataaagtcttgctctgttgcccaggctggattgtagcggctggatctcggctcactgcaacctctgcctcctgagttcaagtgattctcctgtctcagcctcccgagtagctgagattacaagtatgcgccaccacgtctggctaacttttatatatatatatatttattttagtagagatggggtttcaccatgttggccagttcgagttggtcttgaactcctgacctcaagtgatccgcccacctcggcttcccagagtgctgggattacaggcgtgagccaccatgcccagcccagcctcctactttgtaatagtactttatcactgcctattgcattatggtgaaaaggtttgaccaacacacagaattctgtaagaacaagagttctctcatgcttcttagttttcttgaatactttgcacaaagtatgtgcccaatatgaatttggtaaagtgtggtaacgggataaattaaataaactcaacttcagcttgttgaaatacagagactactccatttggattttctcttatggacaaagtgggggaaaaagcaaaactgtggtcagactttcactaggtttttattgcctttgccttgccagagcgatatgaaaaattaatacttaagaagctagatatctgatgttcagcaagagagtgcctcttacaagtttaatgggtttggtcaagtggatattaaatgtaaatctgtcattttatggagccatagaaggctcttaagacactcaataaatatacttattgaattagtagaacttttcccatgtatctcctattactacattaggatctttgttcccttagtgtgtctttagcctgtgctctcacaagctttgtggtgtcgtgtggatcacaggatcgtttaagataaagatacttttagctctttaattctggtattctattattggtacagggaacccatacattatcttaatttcagagtaacacacgtctcggcatgggacagggggtgtcctaatgaaaagagggctaacaggtggaatactgactatgtgcaggcactgtataaagcaagtagtttttaaatcccatttgcaggtgaggaaaccaaggctcaaagggattaagtcattgtccaaggctatgtagttgttaatgagtgaatctgggttttaaaataaatgtgttaaattccagggttgatatttgcactgggcatttatttacttttatttgaatttttttttttttgcattttacttgcatgcttaatttttctttgctcagcagcaaacattatgttccccacttgcttcccacttgcttccctatttactaaggggtgatagttatgtgttatgtatctatagtcctgtatagtttacaggtattgctgtaatacctgtaatgggtattgctttcatacccattctcatttgatctttggtaagaccccagtgagtctttattatttgggtgggggggaagggttttaatctccattggcagatgaggaaatcaagatttgcagtttcctgagagatttgccaagggtggtaataagtggcataaaattggctttttaaaaaaaaccaattccttggccacaatttattaaaaaggcaaatggaatggtcctcctagaaaagatttggaagttagccagatgtggtggtgtgcacctgtagtctcagctactctagaggctgaggcaagaggatggcctgaacctaggagttcgaggcttcagtgagctgactgtgccagtgcactccagcctgggcgacaaaagaccctatctctaaaacaatatggaagtgtaagaagttggggaaataaaaggaaaaagaaaaaagaaaaaaaagatatgaaaggcctggagccctttcccccataaggctctgctgactggaagacagtttgaaaaccagtgaggaatgatcaaagaactctggtgtcagacagacctgagttcaaattccagtttggactgatacttaacttcccttaggcttacttcctcatttgtaagatgggatgcttttataggattgctgataagtattagccaaaaaacatgccagaaatctatcacagtaccttcagcttctgtggatgcaaggggagtgtgttaggcagtgtaggctgacccctcaccacgtgcaggactcacactaaatgttgggggaagtcattgctaagacagagccataggacttcaaacccagcacttcatacctgactgaaggttcaggtgtcacatttatcaatagtttaaaacaggagggggcaaactttctgtaaagcatctgagagcatctgggccatatggtctctgttagagctactcaggaactctggcacggtagcagggaagcaggcttagattatagtaaacaaaagattgtggctctattctagtaaaactttatttgtgggtaccgaaattttaatttcatataatttttatatgtcatgaaatgtcatttttcttttgattttttctttcaatcattacaagatgtaaaagctatcttagctggtagtctgtgtgtgggttctacaaaaacaagtagcccatagaccaaagtcctgatttagacatgtctagttttttttttttttgaaatggagtctagctctgtcacccagtctggagtgcagtggcgcaatcttggctgactgcaacctctgcctcccaggttcaagcaattcttctgcctcagccttctgactagctggaaaattagccaccatgcccggctaatttttgtatttttagtagagatggggtttcactatgttggtcaggctggcctcgaactcctgacctcgtgatctgcccgcgatggcctcccaaagtgctgggattacaggcatgagccaccatgcccggccttatcagtattcttaataccaacagagtttcacattgtatttgacactatttacaaactcagtttattccctctgtgtgaatactagccatttctaaaatgaaatgcaattgtgatttaaatttcacatatcattatgctaaatgctgttcactttttgttccatggtcctgaaacaattaacctgtttggagataagctgcagatacaagcacacagagaaggggacttaggaaagctggaggaaggaaaggtctgtcttgcctacatatgggcttaggaaaattttctaactggaaaccttgcctcaagtctgagtcacactagtgggactcttggccctagggtgggaggagaaaagggagggaaggaagtggctatgtcagtttttgtcaacagagggcacccagagcaaagcaagtgttctgtgacacaacagaatctgcccctctgccccagatgaatttaccagacaggcacagaacttcttgcagtggattctcttgtccatctcttcatttgtctgatctgtgtctgcattctcatgttttctcccatgctggaaccagaatattctaaatgcagtgttaataattgttatttgctgactgctttaagtggaagaccaattccctcaatgtgctggggtgaattatcccatgttgtaaggttggccttttgggtggatgtgcagtattagcttctaatttaattcagtatccagtgagcatgtattcctgaaatacttttgatgtgaaagagcacttcatacctgtataacatgttgtaagaagactttgtaagtcttattgcctagagcagtatcctcaaagtgtggcttcaaatccagccgcatcagcatcacctgggaacttacctttattcatggtctctgcctcttccccagacttactgaatcagaaactctgaggatggggtccagtaatctgttttaacatgctttggtaattcttatacacactcaacttgagaaccactgtcatagggtaaaggagtggaagagttaagggcactggtatttatggaagactatgtgccaagtacttggctaggagtttcctcttcattttccacatgagaacagcaagccttaaaagcattaagtgatttgccaaagtcgtacatagaataagtggtagaatagggatttgaaccctggtttttctgactcctgagccatactatagtggctggtaagaaaatgctaagaggcgttgcaatctttaaattaattcttttttaaaagtccttaaaatatttttttaaaacaaaagtaatttgcattcattgaagaaaatttagaatatacagcagatcaaaagaatagaataaaatctgccttaatatatttaactttatcttaacgttttgttgttgattatcttgtttcagcgtaactctgtttgcatatatacacattttaaaattccttaccagatgtcaatcatattgtgtaaacttttgtaaaatgcctccagctcaggcctactttattataaacatcgtttcatgccattagctatgtctgctgcatcatttcatggctgccaagtagtcccttgtaaggttgtaagcttttttatcataattcttgctaaagtccgtcttgttttgatttcatgatatgcttttaggaagaataggatactgagtgctttggtactatgggtaaacaatttgtccagagtggcttaaagtataaaattaaggcagtaagcagattttggttgagaaggggacatggaactggaaaggcaatactaaacatgtttgaggttaaagtgagcccagaaataagaaaacaaattgaagtaaaaaagccaaagtatcaggaatagactgggatctgtgagttagatgggttagaacaaataggaatactgatggtgaacaatttgatggcaccaacagcctgcttttattgttggctttttgacatagaggctgagctgccgaatgacagcatgagaaaaactgggcataagacttccataaatagcagttattatttattgaggaccttcatgaccaggcatcatattaatcatttaatttttataataaccacatgcaattagatacattagttttccccattttacagcagtggaaactgacagtgacatttaaagtaacttggccaaatgctttgattggaaccaaattagttaaaactcccaaacctgtgcttttatgctgtcgtttatcctcattctttttttcatggtgtggcaggtgtttagccactattctgtgtatatgtattgttttactatgtgagctgggacagaaggagactaggtgtgtaagaaaggacactaaagtccactagagtggaggtggacttgaagaacaaaacaaaactaatagcccagtcgttttcgtaggaaaggtgtaaacctgagctagatagtgcagtgagcagaggatgggaatagcaaagtgaatcattgataggaaggagcaggcaggcatttggaaacaagggatggctagaagaatcaaagttccctcattaaaatttccttcccaaaggaggtgatatactctccaagggcactttaaaacagctttattgagatataattcacatactgtacagttcacccatttaaagtgtgtggcttttagcatgtttacaatcattcagccatcaccatcaccacagtcagttttaggacatttttagtattccacaagaaactccattccccgtagttatcacttctttttcttttttttttttttgagacagtctcactctgttgcccaggctggagtgcagtagcatgatctcggctcactgcaacctccgcctcccaggttcaagctatccccctgcctcagccacctaagtagctaggactacaggcgcatgccacctgcctaattttcgtatttttagttgaggtggcatttcgccatgttggccaggctggccttgaactcctgacctcaagtgatccacgcgcctcagcctctgaatctgctggaattacaggcgtgagccactgctcctggccaatcatcacttcttaattcctctatgcccactacttccccagccctatgcaacaagtggtctccacttttctacagattttgcctattctgtatacagtttatataaatagactcaatagaatatgtggtcccttgtgtctggcttctttcacttagcataatgttttcacttagcacaatccatgttatagcagtacttcattttttaattgctaaataatacttcattatgtggatataccacatcttatttaatattttttttttatggtgggaaaacatgtttttatgttgggaaaagaaaggtgaagagactgagacaataaataggattattttccttaatttaaaatgggaggaataggtgactactatgaaaaccaaggctatcaggctttcttgaggaattgcagctaaaggcctaggtgacaggacagttggcatctgctgcttcatgaattgtttgtagcagagtggcagctcttttgacccgaacacgtgcagtattcagggagctcattgtgtaaatcttgtgtgttggccagcaccattgccccctacaatacctcatggggaactggagaggcctttgctgatctaatctggatacatttccctcagttactgcagctctgggtccccagagagtcctctctaaagagctgccagtttgttgagtgctggcatttgtaagattatttcttactatatgattcgtccagtgaagatgacacccatttatgaggtcctgatctattaagcagaaatagcaaccatcattcctgtgtttttggaatgaatgctgactctagggcccctgtatgctttctcagctgtagagtttggagggctcctttagcaagcaaacaatgtgcccttctgggtgccaggtgactttactgttgttctgttgattcctgttaattactttcttgatttaatctccaaggaatagagataccttcataaaatgagtggtatggctcaggatgtaagtctttttaatttgtacaccagaaatgttgtggatggctttctactttgccagaactttcagtttagtttagagagtgaattgtaatcatttgtcttgataccctggccctttggcatgtcagccctaacactgaaacaagaactctgggtagaggacatcagcttggccctcagttcctgagccattgaatgtcagcgctacatttaatcatatcacccccgttttacatttggggaaactgagttccagagaagttagatgacttaccaaatccatagtcttattttcttatagctcttgctagtggcaaagctgagtctgtgatattgagccttcattctcagtggagtgcttttttcccagtgcagagctgtttcctgaagaacatgtactgtcatgaccaaggagtggccaagccctgctgtactccatcagcagtgcaggctttaaggtgtatttgagagtttgacagattgcgattgtgatgatgaaaatttataggaaagagcaagagcactggtttgtgagtttgcacgccactgacttacagaacccagccccttctggcctccccttctcccagcctcccgtgcagtgcactgtgtccagtgagtatcttcatgactacgtgattataattccttgagagccccatgtctatttgctaaaaaataaatatgtgctgctacactaacctaacaagcagtcatcttgtagttcctgcctgaaaatgtttgatcatggttgtcaactctatgcctgctataatttttgcctagcataatgtgaagagaaaagataaaaatccttctctcactgtgcattttcactgtcccctcccctcattcttagtgtatagaattccagaatgggccttgctttctgacattttcctgccccatgaccctaacagatctattcaacatgaccctgacggctgagatagatctaaacccagccccttcacagtggaacacttaagctgggtagtagttccatactgagacccctttcagtactttctcttcctccccttcttttttgttgtgtcttcccctaccaacatgagctcctttttagggagaagttgtatccttcactcttttcccccatcacctaggagttgctcaatatagtcattaaataaattttggcattctcatgctgtttaccattcatgatgggatgggtaagatgcaggaatgctaataaggttgtcagatggccgtgttattcctttatagaagttgttttatggtccttaataataatttatagtaccaggtactatttactgaatgcttgctatgcatcaggtattgtgctaatgcacatatgcacataccatccacttttcattactctttttttttttttttaaatttttcagatagagtctctctgtgtctcccaggctggagtgcagtggcgtgatctcggcttgctgcaaaacctcctgcctcagcttccccagtagctgggattacaggcatgagccaccattcccagctaatttttgtatttttagtagagacggtttcatcatgatggccaggctggtctcgagcttctgatctcaggtgacccgcccgcgtcagcctcttaaagtgttgggattacaggcatgagctaccacggccggcccactcctcattactattaacaaccactctcctggctgggcacggtgacttgtgcctgtaaccccagccctttgggaggccgaggcaggcagatcacatgaggctaggcgttcaagaccagcatggacaacatggcgaaaccctgtctctactaaaaatacaaatattagccgggtttggtggcccatgcctgcaatcccaactacttgggaggctgaggcacgaggattgcttgaatccgggaggcagaggttgtagtgagccaagatcatgccactacactccagcctgagcaacagagtgagaccctgtcacaaacaaacaaacaaacatgcaaacacccattctctctataaggtggacagtagaagccatattttaccaatgaagaaactgggctttagagaagagcaagtcacagagctggaaagtggtagaacaggcatttaaatctaggttagcttgataccgaagcctatgtttttagtaaccatactgaacctccttgagtagttaatttgctgagcattactgtgaaagagagctaagtcacttatgttccctaggatttataaatgagacatctgtgttagcacagggcattagtaacatgatttagattaaatctggctttgggattaaagaatagagacaaagaggaggcatacggagcctctgccacttaacttcctggagctgatttgcttgtgctcagtattgaggaatctttcctctttgagtgagtgtagagtggttttgggtcatttgtagtctacacagtttctgagagatgatctgtccagcaattccagattgtttagggtgggcctgggagagggtatggcttactcctcgtttctggtgccgtattaaggtgaactagagctgattcatgtactggttgagactgtaaaaggacttccaggtttagtcattctgcaggaggctttctctttggtttaactgtagctcttcatccctcaccctggtttacataattgggactttaaaatttcattgtggctgtaagaacaaagggaatgcacttttcagcagctccttactgaccagtcgtgtggagtccctgtagtgtactcagggagagcggctgcctctctgattctctgcataaaacaaaagtattttgtacatagctttgaaatgggagagagaaacttctgaagaaaaaaagagttgtttggggtaataagattttgaggaggcagacacttcctgcattctcccctggggaaagaatctagctacaattgaagggcattgcctcaactaatttagttaagtggccccgtcctggattaataacttgggcagacttcccaatggatttggcagggtattgggtttctctctccccaaaccctcccttctctctgccctgcacatgtgtgctaacataattacagaaagttacaaggggatggggctgctcttaaaggaggtggctcagaggagagaatgtgattgtgtagtcctgtcatatttccgaaatggcagagttcgagtaaaatggtagggtggaagcaagcaggctggtttctctctgtaatggcaaagggggaggagggttggtggcagtgtcgatttcaagcacctagagcacacgagcactgggtactaattttgtgctagagaaatattaaactgtctttttgcatttgtttgtccagattgcattactaaggatctggtcattacagaacaacctttttgattaaggtcagaagttaacagtttttcaagtttggtggtcaagtgttcagaaatatttcacagatttagttgaaaacctgagcagatgcttttgctgttgtttacccccggggatcgggtgacattcttctcccttttcctcttccccacccctttgggaaccaaccaatcacgtagaggaatggatttcagtgcctaaggagtcagccaactccggagctgtagctgagactgaatgtttaactcttaggtatctgaatcacagggaatggcagacattgcagttagcttgttttcttgttggcatctactctcagagcccatccctaagggattgttcctaatgaggcgaggtacattgcattgaacttgaaggaactggcttttagccccaattctgccagtaactagtattgcaaccttggaaaagttattttctctttttagacttgcttctctttatgcacaatgagaggaaaaggagaaaatgggcatgtatggtatatcactatatattccagtggcgttttatcgctagccttgaggtttaggggaaaagcatttaacctgtattgagtgcctattctgaagcagtttgtttttatttgttaccttattaaattcttatgactctgcagggcaaatgctgttaacccaattttacagatgagaaaagtgtaggctagagaggctgtccagcttgcccaaggtcacttaaggaaggcccatctggctctaatgcccagactcttccattccactaggctggctaaaaaggccctagaagtcctgccagcattttcactctgatattctttaactccttcacagcttttaatcctgccctgtaggaggaccaaacattactgtctcctctttcacagccccgctactagagcaagtaaatgacttagggattcctccatcacctgaaagcagcaaaagaagatggtacagcattcaattttctccttcctccataaagaaattcccgtcctttatagccagctctgcccaccccttcctcattccccttttcttagacaggcagatattttcttttctctttccctttggcttgtgattatcaggtaaatatccctggtttgagggaggagcagaattttgattaggttaaaaaattatctttacccatagcctttctatgacatagatactacaatattgggtttatccccacctggaatttctatgatatctatatctataaacctatatagatttatagatatcatagaaattccaggtaggagtaaaccatatatatatcggtatatctctatccatctatatatatatatacacacacacacatacatatacacacatattataatgatataattatatatgtatacacacacacacacacacacacacacacaatagaaataacaggatatatatatcctgttaggcgctcccttaaagagctttatttttttgcttgtaaattatcctagccatctgatttaatagatacaccttacccaagagaacactttctgtttctcttcctgcagatcttactttttttactttttaaaaatagagacagagtctcactatgttgcccaggctgatcttgaactcgtgggctcaagcaatcttcctttcctcctctgcctctcaaagtgctgggattataggcaccagccactgcaactggccacggtttacttttaaattcacagagaaaatagctttttaaaggtgagttcttattaatattttggttacttccaattaaaaaaaaattacagtagaagccctaaaatgtcagatttgccaataaatcattttctgtcatttgttgtgggctaagaaaaatgacaatagacaaaaccattaacaattgaaatttattaagaaaggcactggcctaggtgttttatgtacattatttctaattttcatcttaattctgcatttgttgattacaaaacaggttaagaggggttaaagtacttgctcaaggtcactgctaatgaatggtgatttggcaatttgattgtaggtctgtttcactttcaaacctcagttctttcttcaatgccatgctgcctctgggatatgatcttgagagttttatttgatcattcatgctcatgcctcagctcagatcaccccggaaaacccatatatcttcttttaaaaagggaaatacattttatatgataagtttaacaactgaaaaaaaattaaaagaagtatttcctggtgtttgccaacttttacaatcaggtgacttttactggtgtttattttgaattatttttgttaaagtttggatccatcccttgttttaagtgaaaatgctaaatagctactcatcctcaggtactggagagcttaggggatttcactgtgaattgggtggacaggaagaggtaggccttaaaggttaagtaatatataggtagatggaaaaggtggaagaattttcttgcggtgaggaaatgttattgcttgctccatcacttggtacatcctgtgttcacaccatctgtttgagctcctgagaatgttgatgggaatctaatgaaagatgggttggtattaatgaatgctcatgttcttctcccttcctctcttgaggagttgcttgtgatttagctctgccacactttatgttgggctttcccagtggtgtgctctgagagattcatataagagaagtatacgtagtatgctgtttctgccatccagatcacctcaacaaatagttccataatgtttattatgtgcctgttatatgccagtcagttggcatgaccaactgatgatgctgagataagatgtgtcattgcccactaggcctttacgttgagtacaatttgcagtctcattcaggatacaagacctacaaacatggaattaacaaaaaagaagtatgtatttaagattaaaaaaaaatgagtgaaccaagaccagcaaatgttgttgaggtttagagatgaaaggggttaggatttgctggagcagtaaaaacagggttcattaaaaattttatccagagtatggagtggggaagggctggggtgagatgggatatgggtcatgccactgctagtgaaaggaaattgaaaatggctcattggattagaataaggtacttataccttctaaaattgttgatggagtcataggcagagattgggaaggggagattccaccaattagcattttaagtgaggagtgtaacgataccagcagctaatgtaaacaacaccaataataacaacttaatccctgagatcacaatttttaggaaaaatttcttacatttatttatattttggctcccttgattagctttcctctgattagagaatgtggtatcctgtatattaaaatacctttactcttgttggatttttaaaagatgcaaaactttaagataaatcagaggtcgattaagacaccagtaggccttgttgccatttccatttcccatatgcattgattactgtgtagcagtattcctgatgattgttgaatatttatgaggttctctcccaaaaaagcccaccaagtgaagaactatctttcattttttaagttcctgaaaattacctaaaactcttctgtaggagatggcttttacaaagaagattctttccttctcccttcccccaacccatagtagcttaacttaagtacctgggggagataaagataaatgtgggaaacttcaggatgaaagggacattattagagaccagagaagtcccgggaggtcatatcaggcttaaagtggaaactatgttacaacctaagcaaggagcaactgataggtctataaatagggttttatctcctcctagaaaatttttgtcatggttatagctttccatgtgggggactattatatttactaaaaataaaccgtttcagaaataattaaaataagtcccactgaactcatttatgttattaaaagtaaagtcatagcctgaaaataagtttatagagtttggcatgtactaattttaaggaacattttgatgctgcagccattgcttatatatgggatagaatggtaaagcccaaatggatttgtatggattaaaatagattaccttctcagaaaataatgttatttcagtttttttccgctagttcagaagaccctcaacctcctttgcatgcattcagacacataagttggcattacaaatgaatcatctagggaagtgggagtacttctaattctccaggaatctcacacagtaaagctgcttggatatggctattcagaacagaaaggtatagaaatggacaatggtatcccttccattggtattccttctgggcaacaaaaacccttaagctgtctgagtctgtttctcacacttctgttatcctgattgtagccctttaaattgtggagcaaattcttggcatctgtctgcctgtcagctacctatctctgacacccctggatagcttgttttcttcctatgagtatatgtgaaatttgtaaaaaagcatctattaatttaagtatcctgttagaagcctgcgaaaattcaaattgggcaaacaataaaattgcttaaaccgtgtttctcaaagttaatttgaccatagagtacttttcaaaatataatgaattgaataacacagcatcagtatgactcacgtacaatgtgtgtgtggattaaagtcaccagaagtagtgttaaaaagatgaattaatggcttcaggaagtgacttcattggctttttttcaaactttaaacattttggagaagttaaatcattttaagtataaaagttaaagagattcagttatattttgtttaaagagcaaaaaatcatgactttgttgaaattaagtaaatatttatgattgtcaatcatcaaaatagattacatttgtattgtctatgcctttgggtacaggttaaaaattatcttctttttctgcctaaaaaagaaagtaaggcccggcacagtggctcacgcctataatcccagcactttgggaggccgaggtgggtggatcacctaaggtcaggagttggagaccaacctggccaacatggcgaaacctgtctctactaaaaatacaaaaacattaaccgggcatggtggcttgtgcctgtaatcccagctacccaggaggctgaggcaggagaatcgcttgaatccgggaagcggaggttgcagtgagccgagattgtgccacttcgctccaacagggggactcacatgttacccttatttctcgaagacattgctcggagacattgcacttttcatgatagattgttgcatactaagtagaaactatatttgtatttagtatttttcttttgaatgaagaaaaatattgctagcgttacttttaaaattgttgtattaccttttgacaacttgtaaaatgctaaaacagggttacatatttcaggtgtatctgacttcctaattactttaagccttttactgctgttgttctttttctccccttacaacctctcaactcccttctttccacccatactttaaagaaggaaactgaaattcctgatgtaatgtatattttttcatatatatatgtttaagagactgggttttgctatgtggcttaggctggtctcaaattcctggccccaagcgatcctctcaccttggcctcttgagcagctgcaacaagaagcatgagccactgcaccaaacctgataacaatgattttctgaaagatagcgagatgtgctgggcgcagtggctcactcctgtaattccagcacttcgggaggccgaggtgggcagatcacgaggtcaggagatcgagaccatcctgactaacacagtgaaaccctgtctatactaaaaatacaaaaaattagccaggcgtggtggcgggcgcctgtagtcccagctacttgggaggctgaggcaggagaatggtgtgaacctgggaggtggaggttgcagtgagctgagatcatgccactgcactccagcctgggtgacagagcgagactccatctcaaaaaaaaaaaaaaaatagatgagaaattggatgaaagaggcttggcaagttcactgaattccttgagccccaaacctaagtttctgcctatttaataggtttcatctagtattttttattttgtgactcatatttaccaattggctattgtggtggtaattgtaatgataacaatagtatatattgctctgtttacataatagcctaacatacagatgttgaaccatccacaacttagaatggttctgcttaacagttttctgactttacaatggtacaaaagcaatacacattcagtagaaaccaatgttcattcagtagaaaccatctgagtacccattttttcacttttattataatattcagtaaattacatgagatattcaacactttattataaaataggcattgtgttaaatgattttacccaactgtaacctaatgtaagtgttctgagcatgtttaagataggctaggctaagctatgatgtttggtaggttaggtgtgttaaatgcatttttgacttactatattttcaacttatgatgagtttatagggacaaaatcccattgtaagttgaagaacatttgttctctatttgggtttgacaacatccctgtaatgtaggcattattaactccattttgcaggtgaagaaactgagtgtatccatatttgactgtttctcattatacgaattcaagaatggttaagttaaaattttatttctatcattttggtgtggaatagttatggatagtagatcagagtgatacaccagttgacttcttggcctaaacatttgaaatagacatttcaagattctttgacagtctctgttttggtcatcaaatgtgcacactgttgatgtgcataaagctttctgttgtttcaagtgaaattgaattttgggtagagcacagtggctcacacctgtaattccagcactttgggaggtcgaggcaggtagatctcttaaggtcagaagttcgagatcagtctggccgatgtgacaaaaacccgtctccactaaaaatacaaaaattagctgggcatggtggtgggtacctgtaatcccagctacttgggaggctgagcacaagaatctcttgaatccgggaggtgaaggttgcagtgagctggagtcacgccactgcattccagcctgcgcgacggagcgacactctgtttcaaaaaaaaaaatcgagttttgatttgtaagttaaagtaaataatttattattgaaaacatttaggattaagttcagctgcatataacaatctcctcttccccacacagaatcttaacaagagagagattcatttgtctttcatgaaaaagaagtctgaaattaggcagtccaggctaatatggcgctgtctggttaccaaggatctaagatccttactgctgtttacttctctgactgtaggatgggcctagatgattcagccatcatttccccctttccacaaagcagtttgagaggaagaaaagaggggtgtcccctcccctacctaagaaaacttccaggaagttccatgtaacatttctgcttatatctcattagtcggaattagtcttagggccatatgtagctgtagtggaggatggaagatgtagtccttttctggggaagcgtgtacagtaatatgctaaaatgaaaactggggttttgttactaaggaagaagagaagagaggatattgggaagccactaacattctcagctccagggcctatcagagtgacccagccttatctcccacatgatacagaagaccattctgcggcttccctgggagattttcaaccagtctttgccatgttttccaacaagatgatttttttcttgaaatgtatatacttttatgcaaagattttttaaaagctaaataatacaagattatggtaaggatcactgcagtttccattttaagatcaagtttgagtttttttccaaaattgattagtttgttggaaatggaaattcaaatggtatagaaagttttttggttttttgtttgtttgtttgtttgtttgggacagagtcttgctctgttggccaggctgggatgcagtggcgtgatcttggctcactgcagcctccacttcctgggttcaagcaattcttgtgactcagccacccaagtagctggactaacaggtgtgtgccaccacgcccggctaatttttgtatttttagtagagatggggtttcactctgttggccaggctggcctcctgacctgaagagatctgcctgcctcagccccagaaagtgctgggattacagacatgagccactgtgccaggccatagaatgaggttttaagtaagaataaagtatgtgtgaaatatttaaatatctgaccattggtaaaggaaaaagtgtgattttttttcttttgttttttgaagcctgggtaagtcattagattatacatttcttagggatagagaactcacttttataaaatgtatgattattgtattttgaataaataacatttacataagttaatattttaaaagtagaaaatggtcatatcgtgaaaagttgctctcccattcctgtcttgagttcccagtgtctttcccctacaggcactgggtgttttttacttcttgtgtataattcctcctttgatcttttcctcccatttaaaaaaccactggttttaaaaccattgctaaacctttcttttttccacttaatgacatatgcggtatgcatggcttaatgataaggatactttttgagaaatgtgtcattaggtgacttcattgtgaaaacatcatagaatgtacttacacaaacctagatatatacctgactatatattatatatggtacagcctaatgcctttaggctgcaaaccagtacagcatgttactttactgattactgtaggcaattgtaacacaatggcaaatattttcatatttaaacatatctaagcatggacaaggcacagtaaaaacatggcattatcatcttacgggaccaccatgacatatgtgttccatcattgactgaaacattgctatgcagtgcatgactctattagagtatttcataatggtattttaagagcttcctcatccccctcccccaaggctatactgttcagtgtttcactgtatggataagccataattcattaaacaggagagtcatgtcttacttacatatctatacctgctctgtaaacgcattcattcatattcaagggactgaactcttgaatttgtgcagaatatttctcttcttcatggctgagtatcctaaccagctgagaggattttcccttctttaaagaccaaggtatttaagattcagtcatttcagaaataaatccttctaaattgtgttgtataactataaaatttatttcttcttaacagtaaaatagtgggcatttttaaatggttttaacacaggtatcagcatcagtattgtttaggaatataaaagagtaatatttcaggagcttttgctggttttgccttactaagtggcaccattttgacatatatcatctatctattttacctgctttttagattttttttctcttcatctttcttgtttcctatgttggctgcctctaacataatattcctttttcctctggtacttattccccactgcttcccagttccttttcttaatttgctttgtaaatttttggtggacaattagccagataaccaggacagaaatattcctaaaataaaaataaatagattcagagagaaggtctgatggagttttcctgccgatgaaaattttggaatgaatgttttggaattctggatacctagagggcctttttgcttcctggttattaccgtgttctaggacagctctgtctaatagacctttctgtgatgatagaaatgttttatgtctgccctatccattatgatagccactatcctcacgtggctcttgagcacttgacatgtggctagtattaagtaactgaaattttaattttaattaagttaaattcacataaccacatatgacagctggctgcgtgttagacgacgtagttctagactctagttaactaacttatatacagcaagcttgattagaggagagcttgaactgggatgctattattgtgctgagaagaataaatttatagttttggaagggagacaatttggaatgtagattatcagattagcttaaagtaaatgattaaattggaactgccttttcatattgacgttatgattatttcacagtgtagcattttaaagccattgttaccagcatttatttgtggtttgtatctgtggcaaagctgtgagtccttttggtaactagggtgaaattagtagcactctaactttatttataggacttggttagacagttgcctgagtgccagaaactcctgcaaataactttgaccttccctaacaaaaagtcaaaggataaagcgtttcatagtagaagatttcagttgtatctgacatacacaaaacattactttctaatggagaaatctgtaaccaaaaaaagcataaataattaaagattttggtaactgctaggaagaacataaacagggcacagtaacagagagtacgggcttgtggggaaagacctccaactagatagaggagtctggagagttttatttgaggaagtgatatttaagctgagttctaaaagataagaaggagcctggcttgcaaagaatgaaggtggaacgaggagggatttcagaaagagggaattaaggggtatgggggagaggaattgacacaaaatcagtgtctttagaatagtgattgagaggagatatggtatgaagtgaggttggagaagtgggcacatagcaggtcatataggaccttaaagaccatcataaggagtttggaaagaaaaatgtaatgtgatgccgtggaagtaggagagtgataagatctggtgtttgttttacagagtttctctggctgctgtgtgatggtgttttggaagggagcaacaatggaaatggggaaactagtgtgatattcaggaaagagatgatggtggcttgggttaaggtggtttaaggcagtggaggtcaagtgaagtcacacacacagaagttgctgtaggttggatgtgagggatgaggggtgaaggaagggtttctggctttcataattgtcaggtagtaccaggggacttcaagggtggtgatggtggagaattaaggacccaattttgggcatgttgagtttgacatgcttgtgtgacagctaagtagtcatattggagcatggggagaggtctctgctaggggtgtaacttggtagttattaacatgttgatggtatttgaagtgatgggaatggatgagacaacttagagaagatgactcaggattgaaccccaaggaacacttgccttttagaggtctgtcgagggagaagccataaaaagatactgaaacagtaaccagtgatgcatgaaaaaacaaaaaaaatggcattgtagtatctcagaagccagaagaagagaatgttttaagaagattgtcagctttgttgaatcctgctaagaggtcagataaatgtggaagtagtagaccttgataagttgatttaatggagtggagggcttggaaactttgttttgagtagattgaagaaaatgagaagtgaagaaattgagacagatatagacaacaactttttcaagataatttaccctgaagtggtgagcagggaaatagcaggtagctggagggagatgaggggtcaaaggagaactttaaaaaaattagggttcatttaatcatttacttattatagaacattagatttagtggtaagaagatactgtctgaatgcttctcatttaaaatgacatagaaaattagctaagaggttgtgtgtagtggctcatggctgtaatccctgcattttgggaggctggggcaggaagattgcttgaacccaggaattcaagactagtctgggcaacatagtgagacccgccccttctctaaattttttttttttttttttaattagctgggcgtggtggcatgtgcatgtagttccagccacttgggaggctgaggtgggagaatagtttgagcccgggaggtcaaggctgcagtgagccatgatcgcaccactgcactccagcctgggcgacagagtgagatcctgtctcaaaacaaacagacaaaaagtaaaataagaaaattagctgagagtaggtagtgaagagtgaatgagggaggtttgaggagaagcaagaaatagtcattttggggagtaggaaagctttcaagggcagctttggtggattgcttggcatcgttgagtgtccatttgaggtttgtgatcatgaatatatagtgaagtcagtcagcttggttatgtgatttttcttcagcaacattcagctgattgggcataggcactagaaaaggcagacaattggatttaaccaggattggagttgtgtcaggtggcagtgatggagaggacaaatgattgagggtatttgcaagggagagattgtaattatggaacacggcatcaaaattggacaaagagggtgcagaaccggagtgggtagataatggaaaagtggttgggatgggaggacttcatgacgtcaaaaattgtagggaggggataccagagaaagctagttagaagtaagggaagttctttgagagtataattgaaacgtaataaggaaagatgggtcttttaagatgatgcagcttttcttctcttttttttttgagacagagtctcactctgtcgcccaggctggagtgcagtggtgcattctcagctgactgcaacctctgcctctagggttcaagcgattctcctgcctcagcctcctgagtagctgagactacagatgcaccaccacacctggctaatttttgtattttcagcagagatggggtttcaccatgttggccaggctggtcttgaactcctgaactcaagtgatccgcctgcctcagcctcccaaattgctgggattataggtgtgagtcaccgcgcccagccaagataatgcagtcttctgttttaggggtggtagctctgggtttcctaataactgggagtaagagctctaacaaatcacttaattgcctttcccaagaggctagctttgagatggaccgctttctccatgtatatatacatctagagcttagtttagacatcatagaaggtaaccaccattcacagaagtttctgggtctattctctgaatgacatcagtagtagcagtgttttggccagtgcacaagtacagtatgtgtacaccaactcccaaaccctatctctgtcgtttgttgttgttttttacttttttcttgagatgagagttttactatgttgcccaggctggtctcaaactcctgagctcaagcaaaccctcctgcctcagcctcctgagaagctaggattacaggctcacatcaccacacctggcttcatttgttatttaaagtcttggtaatgggcagaggtagagtgcagggttatttatatccagggtaagtttttcagtgattttttttccagtcttgattcagttttgtcagtgaataggtatgatttagtggaaatgatcttggagtcttaaaaacgaacgttgaacttttggctctttattcactagctgtgagaccatgagtatattatgtaaccactttgggcctcaatttcctttgatctgtgaaaaagataacagggcctgtcttacagagatattgtgaagatgcaatgagataatgcatgcaaagttgtggcacataatatgctctgagtaaatagtagcggttggtggtgttacattgaaaccagcaagtgggagaggaatgttcactgttttgtcttccagggtggtttacatcccctaactggaaagtggcagccatatctacgccttctcccatgagtcgctactgctgcatgtggccagtgcctctgtctagaccagcttctcagatttcggtgtgcctgagagttacctggggcttttgttatcatatgattttgattttgtaagtctagggtggggcctgagattcttcaaatctaaggagtttccagttgatgctcattctgctgttgctggtccatgtgtcacatttgagtagcagaattctgttagagattgccctgtgggaatccctgctattttaagctgagaggaagtgagggaaaaagagcctcattctttcgacttttttttttttttttaagtcagcttcatagacaatactcatacatctcatttctctacctcagtgttgttttggtgagtctgtattgtctctaccagtccaggaagtgataggaatataaactatgtatagagggttgcctcagatttcttctgaagaatttttagtgcctgatttctcaggtacatttttgagaaattgtgctggctcccccggtatacctacttccccccgctatcctcttacaaccacagagaaactcgtataaaacaagtagcctgccagcctggccaacatggtgaaaccttgtctctactaaaaatacaaaaatagctgggtgtggtggcaggcgcctgtaatcccagccacttgggaggttgagacaggagaatcacttgaacccgggaggcggaggttgcagtgagccgagatcatgccactgcactccaacctgggccacagagtgagactccatctcaaaaacaaacaaaacaagtagcctcttgaattattggagtcagaggcagagcatctaaaatgtggctccagaccctttctgcccaccagactcacattgcaaaatccagcatttttgagatgtaggaattcaggaagcaaggttagaattattggcaatacccatattgctgtcccagattatctgatttttctttctcagaagcaagcatgccagaaacttcttctgtgggccctcctcagaagactttctttagtgctcaaatggacacattctctcctctgaactaacagatagggtgataagctatcagtcacaaagtctgataacatgctctcctgatagaatgaagtatgtgtgcatcttaatctctgtgtataagactgtgattctttttagagtctctttatagtgtggagtttttacacctttttgtctcttaatgtgaattgtatatagctataaagcatagctttccttatttgactttgataattggaaataaatttttttcttctcctaccactttgttcccccttttttctttctttctttttttttttttgttttgttttaaaggtagaaaaatgtgaacatgcaggagcatgaataaaaaagataacttagcttccctgtgggtttttggtttttgtatgttttcataaaggtaacatacagaagagttttatttctgaccagactgaccacctaattttaaagattatgatcagaaaagaaatagatgcatttataataggaatttacaagcccttcctgtggttccaaagaagtttatggtggttccacccatgggagtttcagaggtagtttgcagagtttttgtgacatatttaaacttttctttattttgagggtttcttttcttggtatttttctcctgctttgctgcagggtatgtcttttatattttattttattttattttttatgtttgttatgttatgttatgttatgttatgttatgttatgttatgttatgttatgttatttttgagacagaattttgctcttgttgctcaggctggagtgcaatggctagacctcggctcaccgcaacctctgcctcctgggttcaagcaattctcctgcctcagcctcctgagtagctgggattacaggcatgcgccaccatgcccagctaatttttgtatttttagtagagacaaggtttctcatgttggtcaggctggtcttgacctcaggtgatctgcccgcctcggcctcccaaagtgctgggatgacaggcatgagccaccacgcccaaccttttatctttatcctatcctaaacttgattaaaagataacactataaaattacagtatgaagatccagaatttcattgtatttattttattgatacttggttaagaatgaatgactgccagtggtcatggtggctcatgcttgtaatcccacactttgggaggcccaggcaggtggatcgcttgaggtcaggagttcaagaccaacctgggcaacatagtgaaaccccgtttctaccaaaaatacaaaaaaattagccaggcgtggtggcgtgtgcctgtggtcccagctactctggaggctgaggtgagaggatcgcttgagcctgggaggcagaggttgcgatgagtcgagatcacgccactgcactgcagcctgggctacagagtgagaccctgtctcagaaaaaaaaaaaaaaaaaaaaaaggattgtgggagaagatggcggccgctgcacaatcccgggttgtctgggccctgccaatgtcacattctgccattactgcaatagccacatccgtgtgtcacagcccactccattgccagcttcatcatgccctcatacctcatgggaaaggtgaatgttcctcaagtcagtgggattgtggccactgggtttggagcaacaggattcctgggccgatgtgttgtcaaccaccttggacgcgtggggtcacaggtgatcataccctatcggtgtgatacatgtgacatcatgcaccttcgtcccatgggagacctgggctagcttctgtttctggaatgggacgcgagagataaagattctatctgacgagtagtggaacacagcaatgtggtcataaatcttgttggacgagactgggaaaccaaaaactttgattttgaggatgtttttgtgaagattccccaagcaattgctcaggtgtccaaggaagctgaagttggaaaattcattcatgttgcacatctgaatgtgaatattaaaagctcttctagatatttgagaaagaaggctgttggagagaaagcagtgagagacacatttccagaagccattatcgtaaagctgttggacatctttggaagagaggatagattccttaattattttgcaaatatgtgttggtttggtgctataccccttgtttccttgggctggaaggcagttaaacaaccagtatacgtcgtagatgtatccaaaggaattgttaatgcagttaaggatcctgatgccaatgggaaaacctttgctttcgttgggccaaatcgatatctcctctttgacctggtgaagtacatctttgctgtggctcacagcaaaggggtacttcctcccgtaccccttgccaccttttgcctatcagtgggtagcaagagactttgaaataagcccatttgagtcctggacaacaagggataaagtggagcgtattcacatcacagacatgaccttgtctcacctgcccagcttagaagaccttggtattcaggcaacaccactggaactcaaggccattgaggtgctgcggcttcatcacacttactgctggctgtctgctgaaattgaggatgtgaagctggccaagaccgtcaacatttagtgcctcccgagcaactcttggttttggtgtcttttgggtcagcccgtgtggtttgagcacccagccaggtggtctctttagagaatcctgtacacagtgaataagatcccaccattaaaacatttgaggttaaaaagaaaaaaaaagaatgagtgtcgagtaataaaagactcttcaaagaatttgaaaaaatgaatctcttatcagtgtaattttaatatagttatttacagtatggtatggggagtgttggtgacttaagatttagggcatgagcccatgtaactagagaggaaagttgtgtataaaaactgattatggacatgtaaaagagtctaagtaacactttatggaaagtcaagatttatttttctttttttcttttatttagaaaacaggctatctcagtttcaggcttggaagttctttctcctcttttgtactagaaatgtagtaatcttgccttcagaagaagcagagaggttctatgtagagaaaaagaaaaggtttgggtgaggccaagaagaatacctgccccacctctccaagtttaaatgagctgggagtttaaggtgggaggagagaaaacgttcgtctgcggaaagcatgcgttcagtgtgaaagaaaaggaaaagtgattctatttctaccctaagaggaagaaaccccactatggcaggtaactaagcccagagcacgcacagtgggaatattaggtagggagagtgaaagtacctgcatggggcctaccttgaatgtgagacttgtagaccttacttggagattttataagcaggaaggagctgtttcagcatgtctgagggggagccaaaaccctgaggcagctggaaggtggtttttgtttgctttttattttgttttgtgttttctttaatgagtgggaaggagtggaatattcctcaaaacctgttaccgtttgagaatgttttgtgcacctactgtgtgctaggtactatgcaaaagactccatggccaaaaatggatgagccaagacgagatgttaggtctccactgaggaagatgtgcagaggagaagtggtttgctataggaatacttggagaagtagcccacagaggtggtcaatgccatgttacaaacaccagtccccacagagaaaggagagctcactcacagctggggtttgcttttggatttgaacatggagaaaggggtcggggaagcaaggaacacgtatgggcattgacattggcattagaatatgggggataattacgtgattttctgaataaaaaccattaggacaggtgatttgataatacttgttcaccactgggcataatgaatgaaaactcgcctggcatataggaagtacttaataaatgtttgaactgaattaaaattagaaaacatggtcaccaggaacatggcagacagtttacgtagttatatcattacaacacctctgaaaggagtattaaacctattttttggtagaggaaacagaagcctggacaggttggaaactttccccaggccataatgatagtacttgtagatctagaattgaaacccaagccgtgcaccttagcccgtctgcgtggtgagtaaagtgtctgtaccatgctacgagctcatgatccacttgactccttcagaagccaggctatgttgatgtgaactagggcagtagtaataaaaaagatgaaaagcctattcagttttatatcttaagttttcctgtgttttgaaatcttgcaagattaagaattattagtggtgaaatgacgtaaagaatagtggtgtcaagcacacattgtgagaaaggaatgtgggctctgagcaggttctgtgtgtgtgcttggcttctgcaaggggctccacaattggggcagagggaaagcttggctcacttgccttgatcttagagggcagagatttttgattgcttcattcatgtttaaagaactcatcttaaactaatgtatatctagcactagaaactggtgctggtggtttattactgaccccacccatccctgtcttttgcaataatctttgtgagtggtgattgtgtttctagaagtagaattgcagagagagattccctgaaggcaaatacagagagagtgtgctgtacactctagttcagatactcagagctgggaactcccagagagagagagagaaagagagagagagagagggagggacggagggagggtgagagggaggagagagaacaacagaacagtcagctggagcggaggggggaggagaccagtcttttcttttttttttttttaggattttttaactcaagtgattttggggggtttctccccacctcaaactcttgccccccagttttggcatcttctttcctgtggttcactgaagtgcctttttgcagtccaggatccactgaccgctgagtttgagcagcccgatctgacatgatgtacctctgggtgagtacagagtgctgtgggtgagggtttgcacttgcacatataaggagtggaaagctgcgaggttctgctgttgcacaaatggcctccccacagagcacagactgccacatccccttctgttccaaggtgttaggtttttaaaacctagcggtgattgtgacattgttttttttcctccccctatgttgtttatcttgtcagacttaggcgcaagggctgaactccctgcgcagtaccatcccctgggcttggtaggtttggagaaggcaagtggggcaggtgaagttgtgagctggttgcttcaggaactgcagtcttcctggtggctcaggatcgacttgtgttttgttttgggggtactgaccttgttaagccatgtctttagatattgagagccaataggcggcatgattattaattaggaataagctttcataagcttttatctaataatttttactatccttcacaatagtcttgtgaaataggtcactcactactgttattaaaattgtgtgaggaaagtaattaagccacaaagagtgacttgcccgtagttagaaatcaagtctatagcagttagaatagtaattaataatgagacattataaagcattttatatttgccaggaatgtagtaccttctattactgtaatttaccgtcaatagtagcattgtagtttgggatggagagaaactttctgggactggagaagtttgtaaattatgaaatgtgataacttttagagaaatgtcaggggaaataatagagaaactgctcccccaagccgcctgcaatttttagttgttaagacaagaacatcttacagtccgttgcaaagatggcagtatgtctcttgagcaaacagctgttgtgtgttgctaagggagcctactagatgtgatgctcttggctactaaccagctttttgaaagtttccctttgccctttgcccttcagcccagatgtctggaattgcaggaacctacttggctaacacaggctaaatttataaattatcagaaagcaaatgttaactgcgtttgcagagatggagcttgttcacagaagatgtatatgtatgtgtgtatgttcggaggggctgcttttcgtgcttctcccttcatgtttaaatatgaccttgaaatattattttctcttctctattgattttttttgtagtatttgtaagagctcagaacttttctgacacactaatgtgcattaagtagttttcgcctccctgtaaactagtcatctgtgcaggctctttgcagccttgtgggtgggattgatcagccctgttgacctgaaggatgggctgttctgtcttttgatttgtttggaagaggagttatgaaaggaagcaagttgaattaatctcattttcactcacttatgtttgatgaaagcagacagtgacagtctccttagttatttcctttgtgcttatgttacagttacttgtgtatttatctcaatttttttttttacttattaaccctggaacagagcttccctaccaatgctacatgccagattgagatagaaatatgccaagattactataccccacaacccttggagcagccagctggggcttgggagtcccctggtcactttgatcatgtgcaccctaatttgtttaccactttgtgctataaaaatatttcctatgtatgccatgacacctgaaggcttgggtagcactgcctagagggcaaaaagcaggtcagctctatctcttttattatttgtgtcatctagcccaatgcctttgtttacttcattgaggacgtgcagaaggagctatagcgaataatgcccagatacatagaaggaagccttggtggtcacgcattcagtgggaggcacagaggagctgctgtggactaggaataggagatgagagttttagtgtaggtttagccagtaccaagccatgtgactttcggcagtcatataactattctgagactcagtttccacatgcgtaagataattgaactgaacctcttctgattctgaaattccatgaagtgaattttatgtaacagtagatatgcctgaaaaatgcccagttctgcaaggatgtttaggtctaggtgatcagagaaaactgtcaaacatactgtatcacctcccttgcatgcttggtttggtaccagtaatgggtcaaaggcactctttctgagtattctagaaaaattactggactatgttcagttgtcagtacctctgaattggtgcagatgggcatttttagaacctgtagaattgaagagtaaaagttacagcttatccaagcattttcatttgtgtagttagatgcagctcattaatttgctcctgtgtgtctagaactctgagatagaatgctatcttgtgcgctctctatgctgctttgccagattttctccccgctttcctgttgagtcatcctcttttttagtgaatttggtagcgtcagttggcagcatgaggtggtgaaaagaatacgggtttcagaaacctcactaggtctaaatcccacccctgccatttccaagtgtatgactgttaagttacttaacctctctgagcctcagtttcatttgtcatatagggaaaatagtggcactcaggattgttgtgaagatttgagataatctatgaatatacttaacatagtgaatggcacacaatagatgctcagtaaataactagtacaagccaactttttgctttgaacatttgcataggcagactactcaccactccgaagtgttttctgtatcacgttgagggtatctttgaattcatctagggagaactttgataaacacaaactagttttttgtgaaatatttttcctcttagtttgtatgttaagtactcgtggctcgggagcccttgttaaggttgcctcctgatggagaaaaatccccattatttgttgtaaactttttttttttttttgcgttgcacagtactattaagcattcattatgtcatttattttccctctctcgccatcatcaaaaacagggaaagagacagacagatatgattcctgtactgaggcaacttacttgtttgatgattatgtaatttatatccaataaacataattatagaccacttacttaaattaccagaaaacaggatatgttctccctgtctgtgcagtcttagctggacaggcaccaggccctctcttattcatgctctatatggatgaacttctggattttattttgaactgttgttttttcatagttcaattctgtcttcttaataaatcagttcagccaacatttaatgaatgcccataatgggtagagccagctgttgcaaatacaaagatgattaaagattaaagacatagtgtgccctggccggccttagtggctcacgcctgtaatcctagcactttggaaggccgaggatggcggatcatgaggtcaggagatcgagaccattctggctaacatggtgaaacaccgtctctactaaaaatacaaacaattagctgggcatggtggcacgcacctgtagtctcagctactcaggaggctgaggcagaagaattgcttgaacccgggaggtggaggttgcagtgagccgagatcacgccactgctttccagcctgggcaacagagcgaagacatagtgtgcccttaacaaatttataacaccatggtagagaatctgtatgcacaggtaataatgatttttgaatgctattcgaatctgtctacacagataataatgatttttatatgctattcaattaacatacataagtgaaatccttttatgtgctatttcatcctcacaacattgctaaggactaagtatcattatccctattgtacaggtgaggaaagcaaccatgagagagtatatgacaagcagtaaatggcagacctggaaacgcaatctcatcttttaaaaactatggctcttatttcattttatgctagcttcttttgggagaacctgatttttttttgtttcattttattttattttaaactgtctattgagtgataacatttactcctcagtgcacctgagtgttagctattatcttcattttacagatgagaaagcagatatttcagtaacttgcaaagtcacacagtttgcaattgtcagagttagaatttgaactgtggtttgtccatccctaaaacttgctataccacaattagcctcgtcttgtatttgttcagtggtttccagtttatcagtatagtagtcccccttatccatggcttcactttctgtatctctagttacccaaggtcaatcacacttcaaaagtattatattttgagagagataaagaaaccacattcgtgtaacttttattatagtatataattattcagttttattattagttatcattaatctcttactgtgcctaacttacaaattaaacttaatcgtagtatatatagaattcagtactacccaaagtttcaggcatctacttgggggtcttggaatatatttcccacagatgagggacactacctgtactagcattcagcatggtacaaggctagagtagagaaatgaaaataaggaaacctgaattctgttttcatcacccttcgttacttgagacaattacttaactgtgtataccttgatttttcaggttacgaaaaagatatattcttaggaacattcatggaataatcttagaaaaatgcatatcagtcattttagaaatgaagtagcaagtaactgatggctttatcataaaacttgaaagtcacagactgtgagtcaaaagatacagtttcgggtcttggttgtgccatttgtcagtgtatcatctttctgagcatgtttcctaatctttaaaatgggaccaagagattatagagataatctgtgaaagtttctggaagttcttttgtgtgaggcaaaaataagctaataacaacaccttattcaggtttcacgttagtcatttagtgctttttatcactattttgccactctaattgctctacacaattagagaactagacttaatagtaaattgaattatcacaaaatgtagacaatggctcagttcagataacatttaaggtcagatgccgtgataggtaccgtacttgacagtgaaaagccattaaaagattctaagtaggattgggagtagggtgaagtgaagtttataattagattttttaaaaagatacctacatagattagaggagagtaaaagtgcagagagaagttaggtgattgttgtgtaagagtctgagtgacagggaaggtcatgatagaatgggctggagggaagcggaactgtattgagagattcagaaggtaaaattgacaggatgttataatttagaagaggaccaggtttttgtaggagggaagatgaaagggatcatgggtttggttttggatttagtacttgggtaactttgagatgttcaagaggaaatattgcttacatggccacctaggtctggaaacagaaggaaagacagaggctttcctctattgtgagaaacctgcatgccccgagcgggtctcataatggcttaaaatgataacggtctagggaggaatgtagagcaagaagagaagttaatgcctggagaagaatgaattttcttttcttttcttttcctttttgagatggagtcttgctttgtcacccaccctggagcacagtggcatgatcttggctcactgcacccttcgcctcctgcattcaagcgattctcctgcctcaagcctcccaggtagctgggattacaggcacccacaccacgccgagctaatttttgtatttttaatagatatggagtttcaccatgttggccaggctggtcttgaactcctgacctgaagagatctgcccaccttggcctcccagagtgctgggattacaggacttagtcagtgtgcccggccaagattttcaaaggaagcagggaactaggttttaaagaccttattcttaaggaggaaaaccaggacattaggaaatcaagataagagattgtggcaagacactgaaaactgtccttggatttagcaatatggaagtcattggtgactttagcaagggttattttggtggaatgatgagggcagaagcctgagtttagcaatatggaggtcattgctgacttcaacccctcttccctttctgccatgagtggaaggaagcagccagagaccctcaccagatgcaggtgccagtgccacacttcttgcacaacctgcagaactgtgagccaaataaacctcttttctttatcaattacacagcctcaggtattcctttatagcaacattaaatggactaagacaatagcctagagcaatgggctgtattgtatagcctaggtatgtagtagactagaccatctaggttggtgtaagcacacggaaccttgatgttctcacacaatcagattgctcagtgatgcatttctcagaacacattcctgttgttaagtgatacatgactactatattgcagatttgaggagtgaagcaaggtataaaatagtaatctcaaaaaaatggggagtaaatttactacagagatgaagtaggcctaagatttgtgatcataaatttgatgtatgtggtggcgagtcagttgtgtgagttttatccagcaatcttctgttatttaaatgcaggagaggaataagtacatagttggagctgccaaatgagttagactaagggaaaagaggacaaggaaattaagattttttggagaggactctgtgtagtatgaggccataggatctaaactggcttaggagggaggtagaacataagaaggagtaatagtgaaaaagtggtacatcagcctgtaaactatagatcttaaggaggctggagaattgccacaggggtcaaactactattgtaagcaaacgcttgatggtgtgataatagaatacttgaaatttttgtaggtaatgattgtattagaatatgatgctaggtgaatggctttaggtgaggtggtggaaaaatacagttggtgctaaagacttcaaaaagaaggccaaaatgttgaatctatgtggctgttgaagttatcagagtgataagactaacaatggagatgaaatcagggagccctatttagcaggggacaggtgcagtttgcctggagggaagagaagtggtttggaagcagtattgggaaggaaggaagaggatatctggaaggtccaacactatatggtaatggggagtaaggccgatgcttgcccctgctgaggtatgtgatgagtaagaaaaaagtgtttactgtagaagcaacagtaatctcaggggcagtctggtttccttaagatcaaaagagtaaagagaatatcacagaagagaggtgagtgtgtagaggagtttgctgagaatagcccatgacctccagggcgtgggagggcaaggaagtgcaggagatgggatcagaaaaggcatagagaacagttaccattgtagttgttcaggtatgaggtaaaagggccttgaggtcagggtttgacaatgagaataaagattttaagtagataggaaaggcttacgcatgaatgctaaaatatggcaagcttcagttatttaggaaagccgcctttactatttgttttaatatgacatttaatgttaaacaactatctctttctggtcatgtttcaaatcagaatatggaattttgttgttgtaaaatatataaattaaggactaaatttggaaccaagtaagtaaatacttagtagattttaaattgttcgtttggaggagcagaaaatcagcgtggtcaaagcacacatattgacaagacggagagggagggtggaggattaaacacccaagatatatttcctctggtccttttcccaacaacgacaaaaatatattttaggagttgtagtcttacttcactaactcccctttctccttcttggttctggaaaactgtacagtcgtgtaccacataaagacgtttcaggtagctatgaactgcatcattcatcagtgcagttcaatgcatcagtcaatgcagttgaaggcatcagtcaatgcagttcaatcttacggtggtttcataagagtgtataaataacaattgtatctttactgtcccttctctgtgtttaggtacataaataccattgtgttacgattacccacagtagagtattcagtagtcacctgctgtacatgtttgtagcctaagagcaataggtcgtacataccgtatagccgaggtgtgtagtaggctaggccatctgagtttatgtaagtacactctatgatgatctcacaactatgaaatcacctaacaacacatttcacaggatgtgtgcctggcattaagcagcacatgactatattgcttttaaaagttgtaatccagttgaaagcattacattcctgtttagaattaataggtttttctgaatgtgagaacttggtgctcctcttcacacatttttttttagcatctttcactattattaaataagagaacatatgttacttgtaattgaaggccagcatagaatagacattccacagatattggttgaaaagttaattggatattctaggtataatgaactgtctgggtagcaaagtgttcaactaaaatattgtgtttgggccgggcgcggtggctcacgcctgtaatcccagcactttgggaggctgaggtgggcggatcacgaggtcaggagatcgagaccatcctggctaacatggtgaaaccccgtctctactaaaaatacaaaaaattagccggatgtggtggtgggtgcctgtagttccagctactcaggaggctgaggcaggagaatggcgtggacccgggaggtggaggttgcagtgagcccagatcgtgccactgcactccagcctgggcaacagagtgagactctgtctcaaaaaaaaaaaaaaaaaaaaaaaaaaaaaaattaggtttgggtttcacttaacccaaatctataggctctgtactgtcttcattgtgtattaacttgtacggtgttttacttgcttatttaaatatagaccatctattcagaggttaaataaatcaagagggaggtaagagtcagaagcttatgttgtttatgcggggaaacgacctagctttcattccctaaaataactgtcaaattatttttcctgagtgtgtgagatgaactttaatcactggcaagattcttgtatccatgaaaatcagaaaactgactatggtttcattgtgtttctcatcatacgctagttacatttctgtccctggcctagtcattagcctgccatatgattagacagatgatctttatgctcttgtgtctcatctgtaaaatgggcatgatttttcccagtagaattgttaagtattatttcttagataaattgacattcacataaaatattcttaatgatttatttattctgcttcttgtacagtacttgaaattgccagttaggtaaaaaacatcatggtttttttggcaaggtgggactgaaggtctcactaaacagtacagtagatgccaaaggctgggcaggggtaggtggtcagagcacgtgttgggaagatcagttgttgctgtgtctgtgttctcctctgctatatttaagtaattttagatatttatttttatttttgtgtttaattttattaaattaaggttattaaaaataagtttcttggattcattgaaaatcaaaaccatttttgcatgttgctcaacaagttgctctaatattggatgtttgcagataatattcaaactggagaaattttcgattgttaaaggcagttgggattggaagagataagaaaacaaattcccaagtgcctcctatgataggaggcactgggtctgatgctttcattactattatcttgtttcatcttacaacggggaaggaagattcaaatgcgcagtcttgcttcagagtcagtactcttaaccaatatgttgtaatacattcagctagtctgtgataggcagcatctaagatggtccctagtgatccccacctcctgatattcatacccttgtgtattatcttccccttataggctggacctagtgactcactttgaatgcatagaatatggaaaattgatgagatgtcacttctaagatttggttacaaagagactgtggcttttatcttgggtgcttgccctctctacctttctctcagagcccctacactgttaagtagccttgtgggaaggcccaagagccagtgatgtctaggcctaacagctagtgacctgccagcagccaggtgagtgagtttggtggtggatccttgatagtcaagctttaatgattgcagccccagccaacaccttgactgcagccttgtgagagtccctgaaccagaagcacttagcttacccagctggatttctgatccacataaactgagataataaatgctgttttaagctactgtgattgaaaatgaattgttacatagaaatagataactaggccgggtgtggtggctcacatctgtaatcccagcacattgtgaggccgaggcaggcggatcgcttgagcccaggagtttgagaccagcctgggcaacatagcaaaaccccatctctactaaaaatacaaaaattagctgggcaaggtggtgcgtgcctgtagtccagctacttgggaggctgaggtgggaggatcacctgagcctgggaggtgtaagctgcaatgagctgagagcaagaacttgagcaagagagcgagaccctgtatcacaaaaaaaaaaaaaaaaaaaaaaaaagagataactacagattttggtaccaatagtggggtgctttttggtgaaaatctaaactgggagtgactttgaaactgggcagtggacttttaaggagagtgttagtataagattagaataccttgaacacattataaaaatgggactttgaggcgattgtcacgaggtcttaaaggaaagaaactggaagaaaggggatccttgttatgtagtggtagaaagtttagcaacactatcatttatagttgtggaaagcagaaagtgtgtttcatgaactgagagatctagctaagtaaacttctaaacaaaacattgcagatcccctctggttccttcttgctgcttaaagtatgaggggaaataaataaattgagggaagcactgttaaaaaaggagccagaacttgatgattttgaaaattctcagcctttctggttggcagagggtgatgaaattgagacacggcaaagatcaattcaagagccactccggggagaatggcggtctaaagataaagccaagactgtgcctttaaagcctgctgttaagacctgagaaggtagtgccttagcatcctcttcagtcacactcaaggcctctccgtcaaacaatagggcttctagcctttttagcaggagcccaaggtagaggtagaagagttcctcttggagagatctatgggtatagcttttgtctattgtggtgagatatgcaggaaatccactgtagctaggactgaacaggaaaagaaacagtacaaaatgaaaagaggctgtcggacacccctagcattctgctggcaggaagcaggctgagaaagtgctcaggagctaacacatgccacctttcatcaaaagggaaagatgactcagaggttggaagcaggagcctagagatgaaggcaaaagtcatggagaattcttttcccagtgttgagacctaatcaaggaactttcagtgtttgccctgctagatttcagagtcagtatggatcagtgactcttttgtgccccccaatttcctgcctttcttttgtagaaaaagttatgccatttagtgattgcaaggattttagagaacagaaacccagagggcaagtgagaaagcagccctaatactctgccatctaggctcccagaatgccatgctgttgttaaattgcttcttttggcttttgcttacaagtcataagtaccagatgatatgtgcaaaactgaagcaatcaggagaggatttcccacccccgtatttacccactttctctcatcagtatgaataaactgtcccctcactcatgaagcatttgcattcctatataaggtgaaccttccagttgtatactaggtcctatctctgctagtctgtttaggacatggatccagcaattctcttccctctctctgggatcatcaagttttctgtctttattggattagtcccgtcagcatacagttaagctgttcttccacttatttaaaaataatactcttgacctcactttgccagcaactgctgaatttcttttcctttaaagcaaaactcagtagcgttgtttatatttgattatatctgattatatcagttctcctcttaaacccacgcagccaggtttttattgcaaccacaccactgaaagggctctagtccaagttgccagtaacttgcatgctgctaaatctagtggtctggtctcagccctcatcttacttgacctatctgtagaatattctatcactgatcacttcgttctctaattcactttcttggatacttgacttgcaggacatcatactttcctgattttcttcccacctctttggaagtttgtactcagttttaaagttgtaatattttgagccaagtcctttcacctctttttttgattctctttcatccactctcatggctttagttctcagctaaccaggaaagttttaccagccgggtaaaatgtttttttcctttaacatatattaagttttcttttcttttcatttcttttttttttcttttttcttttctttcttttctttttttcttttgagacagggtctcactctgttgtccaggctggagtgcagtggcgtgatcttggctcactgcaacctctgcctcccgggttcaagcatttctcctgcctcagcctcccaagtagctgggactacaggtccatgccactacacccggctaatttttatatttttattagagacagggtttcaccatattggccaggcaggtctcgaactcctgacctcatgatccacccgcctcggcctcccaaagtgctgggattataggtgtgagccactgtgcccggccctaagttttcttataattaagaaataagaataaagggatagtgaaaaaacaactgcattagacattaaaaaaaaatttcttcctttttttttttttggagacagagtctcattctgttgcccaggctggagtgcagtggtgcgatcacagctcagtgcagtctcaatctcctggattcaagctatcctccttccttagcccctcgagtagctgggtgggactacagatgtgtgccaccatttttgtatttttatttatttttttgtagagacaagtctgtggctgtgttgccacaggctggtcttgaatgcatgatctcaagtgatcttcccacctcagcctcccaaagtgctgagattataggcgtgagccaccatgcctgaccaaaggttcttccccctcctccctgccacccgagacggagtctcactctgttgccaagctggagtgcagtggcgcgatcgtcggctcactgcaagctccgcctcccaggttcacgccattctcctgcctcagcctccagagtggctggactacaggcgcccgccaccacgcccagctaatatttttgtatttttagtagagacggggtttcaccatgttagccaggatggtctccatctcctgacctcgtgatccgcccacctcagcctcccaaagtgctgggattacaggcgtgagccaccatgcccagctgtcaaagtttcatgcaactaattagatattacccctacagtaaccatcaatcacatttgaatgctgtctatatcttttaatcccttttataatacctcatggtttttgtcctttttgcctatccctcctttcttccttccctccctccctcccttccttccatggctgggaatagttaaaaagtaaaagttgctgaaaagtcagaatgtttcaagatgtaggaaaaataaagatcttctaaaatttcacagtgaatcttaggtttataaaagggtccaaggaatacatgtattattacaagataaaatagtttatttttaaagtaacaatttcgtttttctgttttctttttggaatacctctaagaaagaaaaatcataaagtataaattcttacaggtagaactgaactgcttgaaaagaaaagttgggcccagtggactctgatgatacactgggtgttaaattctgtctgtatgttcttggctctcaaatgtatacctctagctagaactctctctagaagctcatatctaactgcctacttgacatttccatctgtaatataatagttacctcaaacttgacatgtccaaagctgagctcctggcctttacttgccttcctctgccctcagacttgctaaacccacagttttcttcttctcagataatgacatctttctgttacttgagctaaaaaaaaccttagtcatcctggactcctctttctccctcactgcggtcctgttaattagcaaatcctttaggttctgcctttcaaaaataacctaaattcaatccatactagctcttcttccttttttttttttcctcagtctcgctctgtcgcccaggctgcagtgccgtggcatgatctggctcactgcaacctccgcctctcaggttcaagcgattcttgtgagtcggctacctgagtagctgggattacaggtatgcgccaccatgcctagctaatttttgtatttttagtagagacagggtttcgccatgttggccatgctggtctcgaattcctggcctcaagtgatccaccgaccttggcctctcaaagtgctgggattataggcgtgagctgccgtgcccatcctactagctctgccacttctatcctggttcggtattccatcttctcttgcccaggtttttgtaatagtctgctacctggtctcgctatctccactattgacactgaagaatttattctaatcacaacatctgacataatcctttgaaaatataaatctgatcatgcacaaaatccactgatgtgtttcgctcagaagaaaagctagagtccccacaaggctccagtcaagcctgctcctaggtacttgtttgactttcatctcctcctgttctcatttctcacagctacttaggccttttggccattcctcaaatttgccaggcactttgtacagctgttccatggtattcatgagggggttggttccagagcctcttaaagatacccaaatccgcagatgctcaagtccctgatataaaatagtgtggcatttgcatataacctacacatattcttctgtatactttaaataatctctggagtgtttatagtacctaatgaagtgtaaattttatgtaaatagctgttatattgtttctggaacacgatttacggtgacaaggaaaaaaagactgtacatatccagtacgaattatttctcctgccccaaatatttcccattcatggttggttgaatccagggatgcagaacccacaaatatggagggcttactgtacttgtttcttctgcctgtaatgcttctctccagatatactcatgtcttcctcctggccttcaaatttttgctcaaatgtttcctattcaataaggccttttgaaagccattttactttaaatttttcatagcatttatcttctaaatattataaaaacaggccatacggccaggcacagtggctcatgcctgtaatcccagcactttgggaggccaaggcgggtggatcacgaggtcaggagattgagaccatcctggctaacatggtgaaaccccatctctactaaaaatacaaaaaattagccgggtgtggtggcgggcgcctgtagtcccagccactctggaggctgaggcaggagaatgatgtgaacctgggaggcggagcttgcagtgagctgagatcgtgcctctgcactccagcctgggtgacaatataaataaaaaataaaaaaacaggccatgcatggtggtttatccctataatcccaagactttgggaggccaaggtgggaggaactccttgaggccaggagttcaagaccagcatgggcaacatagtggtaccctatctctacaaaagcaagtttaaaaattagccagggttggtgggacacacctgtagtcctagctgcttgggagatggcatgcacctgtagtcctggctacttggaggttgagacaagaggattgcttgagcccaggaggtcaaagctgcagtgagctctaattgtgcagactgcactccatcctgggtgacagagcgagaccctgtatctttattttattttattatttatttagatggagtttcactcttgtcacccaggctggagtgcaatgacatgatctcggctcactgcagctatcgcctcctgggttcaagtgattctccagcctcagcctcctgagtagctgggtttaaaggtccataccaccatgctcggctaattttttgtatttttagtagagacagggtttcaccgtgttcgccaggctggtcttgaactcttgaccttaggggatccaccaacctcggcctcccacagtgctgggattagaggagtgagccactgcgcctggcttgagaccctgtatctttaaaaacaaaacaaactccgtgtgtgtgtgtgtgtgtgtgtgtgtgtgtgtgtgtgtgtagtagtagtagtagtagtatgtatatgtatgtaaaataaaaactttttttcccacctgtctcctcttttagagttttttgtctggtgtattcgctgctattatcttcagtgtctagaataatgaatggtgttcaataaatatttgtcaaattctagaggtttttttacctgtgatttttttcagtaacggaatacttagtaactatagaatttatagtggtagaactctagctgacatcagctattctctctcacatcgcagggaccagtgctttgtactattgaggcagtagtgctttaatggcacaagctttggaaccaaattaactgggtccaaatctggttctgatgcattctgtctgaatgacattggataagttaccatgctttctcatctgtaaaatgagaataacataatatctatcacagagggttgttttgagccatgtaacgctctcagaacagttcttggtgcatagtaaatgttcagtatatgttagttatgattgttaccgtttcagacccatcccagcagttctgagtctgttgtactcctgagtggcaatactgagaactgattcagggtctcctccttatcaccaagtctctttctcctttaaaaatatcatgggtatgttaggtctgcctttctacccttcacctccagttctctcttctactgtttaatctttacttacactaatagcattcttttatatatccacattttcccctcttttttttctcttcctttctcccttcctgtccttttagcaagtacttattaagcattactttttgcttccctattctgttctaaatcttgctgtttctttttccttatcttcatgtctttgtttcattatcaaataaaaaattacctaatttatggttgattgactagaattacatttgtatcagggaaaatgggaatgcagtaggtgttgaaataaaattgaaattattttttaaaaagttgcaccagtgactaaaacccttgaaagtactcctactccttcctctaaatctacagaagtctctactttcttagtcagtgattaaatttgtcttctaccaaccaacgtgcaaggtgatctgggggaaaagtatctcttatttaattacattggcattatttgtaattttctgctattttagctatcttgttttttgtttatttttatttcagatggatagtagttcaggtacattactggtacagtgtgctcaaacgttttccccatgattactaggttcttgtgatatctggtctagaaacacagccatcatttataaatctgtgtgtgtgtgtgtgtgtgtgtgtgtgtgtgtgtgtgtttcttttaatgggagaatgtgatcagagttctaaaaaactgaaataaaaatgcatttttagaatatgacttattttgtaaattttagatagattatagaatgactacaataccctttttcagagcagaggaagtgaacccatttaggcatccgtttaaaggagttttgttttgaggctttaagggtctttcatctgtaagatgagctgtggtactgcctattatatattaataaacgttacaaggaaaacagtactctttttgctcccttttctcggtatagtctttttttccgagcacatttcagaaataaagaccactaaaatgctacttaatgtaatctcagttacttgggaggctgaggcaggagaataccttgatcctgggaggtggaggttgcagagagccgagatcgtgctactgcactctagcctgggtgacagagcaagactccatctcaaaaaaaataaaaaaattttaaaaatgctacttaaaagtaccccccaccatatttataagttctgggttcacatttctttttctagtacatatttagcccgttcattcatcagttattaaggccatgctatttgccagcaatttgggtaatgaacagcactataagacacaattaaaagtatcagatttctacctttgtttatcggtgatttgcattttttcagtaactctcattttcctttgaattcttaagatttacctctttgacttaagaagtaaactaaattttaactacagctttcaaaatttgtattagaattggacaataaagctttatttatttatttatttttttactatttcacaaaacaaaatgtagctttcttaaaatttgttagttaaaatgttttctttgttttcccaataaaatgtaaagtttaatatgtgatggctaaactcctagggggataaggaggcgctaggagaataggcaggttggaaaagggtagtcgggacttgtccagattcttgtgtggtagtctgggtagtctgtatatttaccatatgggctacaagacacacacacacacacacacacacacacacacacacacacacacacacacacacacacacccttgtgagcatttattaattcgcagttgatggtgcatagtttggggagtgggtaaaggatatgttacttttgtaagtacagaatcgattctgaccgctcattcattgaatgaaagtttgagtttctactacctgtaggtacctttagggaagctttagaaatgtaacctggaattttgcataaactaaacctagccagaggctcagtggccccccttttcattctctaatagaaaagtaaagagggagtgagtgagtacaaatcaccattaaacaaaagtaatatattttaggtttaactatttaataaacctaaaatataaatattacctcactccctctttcctttacttttctgtttcttttccttttgaatgccggaagactttaatgctcattatcttagtctgctagggctgctatcacaaattaccacagtctgagtggcttaaccaacagcaaattgatcttggaagtccaagaccaaggagccagcaaggcagatttcattctgaagcctcctcttgtggcttgtaggtgactgccatctagtcttgtgctcacacaacctcttctttgtgcatagggacaggagtggggaggggagcaagctctctggtgtctcttttaaggacaatgatcctattggagcagtgccactcccctatcacccccaccttacttaacattaattatttccttagaagctccatctcctaatacaggtacaggggtgggcagggtgcaaagaggtgagttagggcctcaacataggaacttggagttggggggacacaaacacttggtccataacacttgtctttttaattcataaaataatttgagtatttactgtgtgttaatcaccttggtagacttgctactatgtagctgtgcaaactcaaggaaattacttaacctcattaggccacagttcatttatcagtaaaacagagatgttgaacccattaatagctatgatgcattccagcttaatcactattacttccatgttcatttcattcccttattttcctctctccctaagattttcttccctccctaagatatttaagattgttatgtcaaatttcctttctgtttttgaccatccttctttttctttcattctgttcctttatgttttttatgtcttaggttgttttctgcctccatccacccctttcctgaattggacatgtttttgacaacttgtaagtttactagatttattagctctttaaaagtttaggaggtagacggaattttttttttccgctcaacatactgaaagcctttaaattaaacttactctaggtaaattgctttgtaccttttacattgccttgtacatgccttacctttgttgcgtgtttgatttcttttcctgtagtctactgcctttcgctaggcaggtttcctcacagcattatttcttagaattgtgaggagactagtgatactgcttttcatgtatgcctttactaaagcatctaattcatcatatgggcagttaataagtatgaattgatgagatgacagtcgtgtattttttactcttcagggaaagaaagaccttgtgctatcccttccaatttctcccttttgatctgtgacatttggaagtagttatggccgggcgccatggctcactcttgtaatcccagcactctgggaggtgggtggagcacttgaggccaggagttcgagaccaacctgggtaatatggagaaaccttgcttctactaaaaataacaaaaaaaattagctgggcgtggtgacacctgtccgtaatcccagctacatgagagactgaggcatgataaccatttcaaccagggaggcagaagttgcggtgagccaagatcctgccactgtactccaacctaggcaacaaagtgagacttttatctagttgttctgcagtctcagtggcagtggcttttctccttttgtgaatatcaacaacaaactacagagttgactcacaggatgtaaaaaattggggtgacatgcatgggagactgtgttgatactaatatttgcatgactgattgagaaagtttgtcagaaacattgtcactagtactattgtaggaactacgctatgagtggggtgaagtcttgccctagcattagtataaatccttagcctgctgggcatagtcttaagaaacaacccattcagggtcgggtgtggtggcctgtaatctcagcactttgggaggtgggtggattgcttgaagtcaggagctcgagaccagcctggccaacatgacgagaccccgtttctacaaaaaatgcaaaaatcagctgggcgtggtggtacacacctgtaatcccagatacatgggaggccaaggcatgagaattgcttgaactggggaggcgaaggttgcagtgagccgagatcatgccactgcactaggtgacagcaagactgtgtctcaaaaaaaagaaaaaagaaacaaccaattcagtaacaaattttgcagtttaaagctgtttcttttagaattaaaactctctaatctctgcagtgtggtaatgggtattgagataatggtggtgataattataaagttgctgattatcagctactgatttttgaatgccgactatttgccaggcttaatactgctacgggagggggtcagggaagtgctggatagagaaaggtgacccctggctagggctccactcctatggacctaggtgagtagaggcactccagctttcatgcccaagtgttgcatttttcaagaccatcctggcctgccatgccccccatcctgggcctataaaaacccgagaccctagcgggcagacatacaggcagccagatgtcaagagacgaacaccagctgaagaagatacaagcagctggatggtgggaggacgtcaagggagcaagccggcagaagagcacaccgacagacgtcagcaccctggcaggccattgacgggtgggacaaggcggagtttggctggggcagtcggaggagagccgaggccactgagcagccgaactctagggctaaaccatctcccttctggctcccacattggtggaaaaatccttccactcaataaaactttgcactcattgtccaagtccacgtatgatccaattcttctggtacaccaaagcaagaacccgggatacagaaagccctctgtccttgcaacaaggtagagggtctgattgagctgattaacacaagtcgcctatagacggcaaactaaaagagcaccctataacacatgcccactggggcttcaggagctgtaaactctcacccctagacactgtcatggggtcggagccccacagcctgcccgtctatatactcccctagaggtttgagcaacggggcactgaagaagcaagggggaacaagagaacctttcctgtttcaataccaagcattttacagtcattaacatgtcgaattctaagagcaaccccagtaatggacaggccattctagctatgtaaactcttcaaaggcagcacttggtacagtgctgggcacttacttgtcaggatttggtagatgctgaactgatttgaactctagcatcatcttgcttaaaattgtcattctttgcctacccttgccctgcccagctatggatacagaggttttacaaatttgaatctctgtgctctaaattagagagtttaatctgaccttatgttaaggagcttgcctcgccagtagtcagctggtttttcaaataattcgatacctcattacccatgtaccaggggttaaacattacccttattaaattggctagtctactcacctggtcttcttgccttggtgcatggtggcactctagtttctcttggaacctgagccaactctgaaccctcagccattttttgtcagtgcctcttttgagcttactggatcccaattccttttttgctttgagtttgatggtattcctttccatgtggctaggaaaagtgagaccatgccttgtcatcttacaccaaagcccttgaataagaacagctcagattaagctagtctgatatattcttaagacctgaccatttggatcttgacctccatctgcagcacataataagtcttttcccagtttctaccttgaacagcctttattttagtttcataatttctgtacccaggacttcaccatttccctgtatttccattgttgcatattgaggttatgcagtctgaagctcctctgaactgtttttcagaatgcctttccttctgcttcggaccatcagagcttcctagtttcctctattcccttctctcaccttcacatttcttttgttcccctttcctccaaccatagagtacacattacttgggaaaacccgattatataatattttagagcataggtcttggaaacatgtttatgcactgtcaaagttgcgtttccattcatctgtctctccccaggtaattagcataaatgaaaatagtgaccttttagaatatctttcaagggtggtagccaacataccaacccaggatactgctgagtaggagccagctggcatgaagaagcaaggacaagagtaaaccttttaagtgggcagtttcaaaagtatagaactaaatggaagcaagaaaaatgaggggagtgtggatatggtgctaattctaatgtggcaaagattttaaaataatacagaggcaatccagaatacattgagagccccagtgaattgttttctttaaatttcatgtcatgtgtagtcatgtttctcaatggacaaatggttagtggaccaaatgacattttttactcatccctgagtaaaaagtccaacgaatatagttcattagactgctgcttgttgtctccaaacagatcctgaaagttcaaatgactgggagtcagaacctaaaaatataatataccccactgttttggcaggaaattgagacctgcttttatcagccacttatccagaaagcatatgttctatataaatcaagccaaatctatattgtctgcaagtattcctgcaatatagttgatgttcataatgtgatccagatattttcagtatacttctgtgtattttgattatcacatgactttttatttatttgtttgtttgtttatttatgttttgagatggagtctagctctgtcacccaggctggagtgcagtggtgcaatctcggctcactgcagcctccacctcctgggttcaagcaattcacctgcctcagcctcctcagctaatttttgtatttttagtagagatgggatttcactctgttggccaggctggtctcaaactcctgacctcatgatctgcctgcctcagcctcccaaagtgctgggatggcaagcatgagccaccgtgcccaaccatgactgtttttaaatagaaactcctgggcctcctgcgttccaattttattgtttctctaatgacacagcagtgactgcaaaccccttttctgttatactttttcttttgcatatagactactattttgaaccttttgaaagggccttgccacaaaagtccatatttacattctgtatgtttagagccatgatctcaatcagaaatgagagggaggtataaatcagaattcagtgttagagtaagagactgtatagttcaaaaaaatttaaacctctaactcataataaacatttcagaaagtaggttgtacgtgctattctgggttgatgaaagtttcagaagataaaagtaaatatgataaaggtttttaaaatggttaaaaacacaggtttagagtctctcattttctcacagtgactaaaagaatttccactttggtaagtctgcagtagaagtatgtcattagagcttcttcagactaaaagatgagggatgacttgagaaaaatttggacatgaccataaggggcaatatattcttgacccaagattttctcctgaggacttgaaccagattagcttaaacaactgtttaaagaaaaaacaacatcaaaaggctcacgcctagaatcccagcactttcagaagctgaagtgggaagatggcttgaggccaggagttccagacaagcttggacaacatattgagaccctgtctacattttttttttttttttttttttttttttttttttttggtcagccgttggctgggtgtggtggctcatgcctgtaatcccagcattttgggaggctgaggcaggtaaatcacttgaggtcaggagttccagaccagcctggactggacaagtgaaaccctgtctttactaaaaatacaaaaattagccaggcgtggcggtgggtgcctgtaatcccagctactagggaggctgaggcagagaatcgcttgaacccaggaagcaggttgcagtgagccgagatcgcaccacaacaaacaacaaaaccccacagaagtctttcttagtggactagcccctttagtaagacagttggaatgtgttggagctggaatgttttcttgtcagttggttcctgacttgaaagaatcacagtggggtggggtagcctaggaattggatctctggcctagcccttagtagaaaaagggattgaggtttctgtgaaagcagttgagggttagaaataaaggtaaagccctttaaccaaaggaaaacattcaaaagaggtagcattaggaagtagacttggggggaaatacctaaactagaagtaatgattgtttgccaaggaaagataggtgtgtttaaatggaacaataccttaaagaaggaattgtctcatgaccttgttaatttctggcctgttgtttcttaatctttattttgagtctcgaacatctttgagaatttaatgaaatctctggactaggtccccagaacagtgtacgtatttacaacattttgcaacacagttttcaggagatcatgggccttgtgaagctcaaccatattaagaatacattaactagtgcccatacttagtggaaacttggcacgtgccaccacacctggctagtttttaatttttttttttttaaaatagagacagggcctgactatgttgtccaggctggtcttgaactcctgggctgaagcagtcctcccaccttggcctcccagattggtaggattacaggtgtcagccaccacgcctgcctattatcttattttaaaaagattattccaaaagtatctgtgatagatcctttctcacttttgctgtttaaaatgggaagtaacaagcactatggtgttaacctacactttctatgaaggttctacatattagtattggtccttatttgattcaagccaaaatttctatcctaatttttcttaagttccaatagtttatataggtaatataaaaactggtttttatatttgtttatttatttttgagacagcatgtcattcctgtcacccaggtcccattgctcaggctggagtgcagtggtgccattgtggctcactacagcctcaactttctgggctcaggtttttctctgcctcagtcgcctgagtagctgggactacaggctcacaccaccacacccagctaattttttgtatttttagtagagttagggttttgccatgttgcccaggctggtctcgaactcctaggctcaagggatcctcccacctcagcctcccaaagtgctgagattacaagtgtgagccactgtgcctggcagaactggtttttaaaaagtggtgtgatatgctgtgttggatattacgttggcaattaatcatatctaaaagtgtttatgtcttttgtttgatagtcatattttgtttttggctaagaggattcaagggaacttcctctggaggtaaaaaagaaaaaatttaaaaaaattttaaattgtagaactgatggtcaaatggaagatgggagcccttaattttttcttcataaaatagttttcaaagaatgctaattttaaaaagctaatcaaacttacttacagagggcccatctctttaagttctggtaacccttaccaaagcaacaatatttagttagtatatttaagaaacatgaataacaaattaaaaaggctattacaaggtggtttctgcatactgattttgtcctatggtgtgagcaattgtgtgtctagtaaacgcaaagaatacattgtaaagcccatacaatgatttggtaactccaaaggaagaaatacatgatataatcattacaaacattaggtgtcatcactttatggcattctgggtgacatcaaaatataaaactgctggcagatgtactcatattattctggatttcagtgccaagtagattttgttttcattaaactttgttttgagataattgtagattcatgcaaatgtttcaagtgtggtatttgatggaattttgacataggcaaactacttgtgacacaatcacaggaaaggtagtgaatatatctgttaaccttaaaaggttcttttctttatcattttgccacatttgctgtactattctctttttttctgaaccatttgaaagtacgttttaagtgtgtgtgtgtgtgcatgtgtgtgcatataaaatcccttcagtcttagataatttcatatttattttctaagaataaaggcgttttcttacataaccacaatgcagttatgaaatcaagacattgaacgtagatactgttacacattctgtagggctccaagggctctctaattctgtgatatttcttggatggggatgttgagactcctggttagagcctggccagggtagaagtgaaggctcctcacttggcctttcctggcgtgagtgggagtgaagtggtatttggctggattaaggcagcctgcatgttttctgtcttgctaggccaccccttttcttgttctttggctgagaggagcctttcactgggggcttttttttgtcagtgcctgttggtgtttctgggtcctttagttgcaagtctgggctacatgaggcaagaagaaaacccaaggaactcaccaccctgtctagttttcttgcttctttcaacctttgaggagtcatcttatgtttaatatatgaaatgtctagggttttaaattgtacttagtgggagggatagggaaaagtatgtgtattccatcttcctggaagcagaagtctgtagttttgttttatgttaattaaataatagtatgtctatcaaagagatgcatgtgtgtaaattaatgcataaatataaatattccaagataaattgtttgaaattaataaatataaatgagtttgaaaattaatgtatgcactttcaaaaaaatggcgtatatattatgttccaaattgcctttctgtgtttattttaggaattaaaattctaagaatcataagactacaaaggtatttaggaaatacatatttaattatgcagtttgaataaaccttcacgttgtcttttctggtatacccccaaaagtcttttgttattgtttgcttttgattgatggcaggttttaaaagcttacccctaaaccaaccttttgagaaattttacttaaaatatactatttttctagttattaaaatgtaattatcaatctgtagcatatgtagttccagctggatctctgtgtcttctaatttatccccagtgcatatccatcttagacacactggctacagtgtgatagccaatatttggcatgttgttgcttattgtgttaacaattttaatttttttccttgatttgctgttattcatggcatagctgccttttttttagctaaagaacaacacaacagtcctttatctgaaactctggaagccagatatgtattatcatttggaatcttttgggttttagaaagaatatgcaatacatgtaccctatattaggctaaccaccagtatttgggtaagaggcaacactgtgtaatcatactcatctatttgcagctaaatgtttttgaatattcacaccataatattgttatatccacactagtttaggtcacatttgtcactaagtgaatccctcttctatcaaagtgaatccctcttctatcaccatcaaaaaaaaataataataaagatgggggaggggaaaaggatggtgaagaaagaaacttagttttccaggctttttgaacgctggaattaaagatacgggtttttggacctgtgtaggtagggcagtcaccaagcctagtcagaggaaaagcccctgtttagtcctgaactcctcagtgtttaactgaggaattggtgctataggcctggtgttaccaactatgattgttttcaatataaaacaaaagtggctattgatttaatcctgttatatggtgttgatcttaaaaactcattggattcatactaggatttagggtttaatcctgtaaggatcatactaactttcatcttatttatcctaaatccctctttaatcttattaatcatgccaggctttttttccaagggccgagatatacatccatccatccatccatccatgtatgtagtatatattcatacagttatttttccaaagttatctatctttctatgaaagagaagatcagttttctcaaagagagccaaagacccatgaatacttctgcagagtagcattagtattgcaaggatgacatcagttctgtattcttaaacctaagattaaagtaggtcttggcagggcctcctgagagggaatctagtcttagccttggatttcctgagaaggcatatggcactcttctgaaagtgggatgttatttcagtttagaagctcttagtcaaaaaatattggatgaattaattgcaatggagacactgctttctaatagtggaacaaaaagtcatttcttagcttttgacctttgccctgaactggtgctgtgtgcattaggaaaagaaaatacacatttggtcttaagtcactgtttctactttgcacaatataactgattcagaccttgtgctctgtttctttcatttctcaaaggataattgtcagtgaccatcctctccaagcaatcaaagtaatagatcctaagtataagttattatttttcttatttctacttttgggggtgggaagtttgagaattagatcaaaacttttattgattgattcagcaaccagtaaacctgtaccaaatgttcacctttggggcctcacatgattatgttccctctagttattgggtggtggttgtcatcattgttttcaactgatttgcccacattatacagttttgacctggactgagtaacttatgtaaattccttaaattgctatattatagtggtttcaggtcatggggaaaaaaccctggtaggtactatgaacccttctatgtttatttcacttatgacttaattactcagattcctagatataaaaagtgtagcaaaacattgtattatgagttaaaataaaactggctttattttttgatattttatgttcagctgtactttattttttccaagtgaaataggtaaaaaggtcttttatgcatatatgattatgaatgtttactttgcatattaatttaaaaggaaattaagagaatatgtttgcaaaaacagatgaatcattattaatgaaaatcatgtaatgctgacactgatctgagaagcagaagaagtttttaccaggatctaattgtataaatgggaaatttagggttaaggaactcactttaggtgttggagtaattgtatatatgcatgctttgcccgaagtgaggaggggcaacttcgatttctaatccgctttgggggaagttccatatcagagctgcacagaaacattcagtgaagcagctcctttatcataaagggaattttaatttaaaaatattcttgcatcgtgagcagggtaaacgacagctggctacactgggcatttatctccttcaaaccacattaccagtaattgctgcattaaatcaaagtcagaagagattacaggtctgaatggatcaaggggctagtgctaacccaaggattcccacaactgctacattgctgctcttagagccctgtctctatccccagtaggtatgagagtcaggtgcagctgtcagattcctgacagctcatctgtaaggcatgagcatagtgaacacaatccaagaagaggggcaggtacacgctcaagacaccctggccgcctttttggattagctttttattttgaacgcaagagaatggcttcttattgtttttcggtactgttaaagagagaacatgttgcctgctttgtgcttaaggaaatttgctttggcataaaaatcacttcaattttctctcctcctttatttattgatattcccttcttggtcaagggtagtcttctcacttgatttatgttacagaaatgtaacataaatttacaaaaataacataaatatgttacaaaataacaaatatttgcaaaaataacatattttgtaaaatgttacaaatatttacaaaataacaacaatatgttacaaaaataacgtaaatgccctgtgctaggtatgggtaggtgctctcccctgccccccagctgacttttctcctcctaacacagttacctagttctttatatgctttctgcctgctgttgaggccacttattcctcagatatagatttagcttcgtaattcagataattctcaatctcttttaaatgtccttcaattatcagagataatgatgatgacgacgacagcaatgacgccgataacatcaactataatttaataatcagtatatgccaggcctattcatatatcaactgatttagtcatcacagcagccccatgagataggtactattattatcttctttttccagacgaagaacttgaggcagagaggtgttaaataacttttctcaaattacacagctaagaagttatggagctaagattcgaatcaagtagcctggcttaacagaggcctgaactcttacccacatgtgatgttgcttgtgtactacaaccaggtactctgctaggtattagggatactttaaggaagaaggtggactatgtagtacctgccctcctgaagtgggagagacagaaacgatgatatgtctggcaaagtgaggaggatgtatgcacgtgctaaaggggttctctagcagggggctaatctagactgatcagaaggaatttgctaccagtcttccttttcagaagaccttttctgtagtgttttagggaagacggatgcctttcccccatctccttttatcattcccccccccctccaaagaaaataactaacccttcaaaaattcattgcattaagtgggacaagaattcattattttaattttttaacaactcgatggaggtataattgatatacaatgaactgcacctatataaaattaatttgttaggttttggcatatgtatatacccgtgaaatcaccacaaccaagataattaacatatgaatcatctccgtaagttttctcatgcccctttgtagtgctcccaatatgctcttacctccccagcacatctccaagcaaccgcttatctgctttctgtcactattgattagttggcaatttctagtattgtataaaaatggactcatacaataagtactgttttgcgtggcttctttcgctcagcataattattttgaaattcatccatgttactgtatatactggtggttcattaatttttatttctaagtagtagtaattgtggatatatgacaatttgtttatcactattacttatctgttgatggatatttggattgtttccagttttaggccagacaaatagattttttatgagtattcatattcatattctttatatgttcttttttctcttgggtaaatagttagaatagatagatcatatggtaggtgtgtgtttgaatttataagaacttgctaaactgtttccacattggttataccattttacattccaccagcagcatatgagactttcggttcctccatagccttgccaaagcttggtattgtcgaagtcttttaaataggtatgtagtgatatcatactaataggttctaatttcctagtgaataatgatactgagcttcttttcatgcgcttgtttactatctcatttaccatcttcttttaatcaggtgttcattttttttgcccattttttaaaaaacgtgggttgttttgtttcttatggttgaattttgagagttcttgtatattctgaatacaagtcctttatcaggtgtatactttgcaagcattttctctcagttgtggcttgtctttttattctcctcacagtgtcttttgataagcagaagttttaaatgaagtccaatttattgttcttttatggattatgtttttaatgttatagcttagaaatctttgcctaatccaaggtcacagaagttttctcctagaagttttacagttttatcttttacatttttaggtatgtggtccattttgagttgttttgtatttggaaagaagtataaatctcgtttcttttcatccagttgtgtcagcaccatttgttgaaaagactgttctttctctactgaattccgtttgcacctgtggatctatttctggactttctattctgtttcactgatctatttttctctcttgacaccagtatcatacagtcttatagggatgtgagtattatgggatctagcagacttcagaagaaatgataagtgttacaaacatcaggtatagcattcgatttcagtacaggcctagagaaaagatagtcataatctttaaaaaccctttatttgaatagtggaatgaagtggagagatatactgtgttgatagtcagaaagactcaattctctcggatgttaattctccccaaagtgatctgtagattcagtgtatatcccaatcagaatcttagccagatatttgtagaaattgacaagctgattctaaaactcatatggaaatgccaaagacctagaatagccaaaacaactttgaagaaggaaaacaaagttgcaggactaacacagcctgatttaaagcctgcagacagtgtggtgttggtgtcagtattgaggtttacatcttcatgttatgcaatgaaattgtgtcagttaggttttgctgtgtaacaaactttcccacaacttaatagcttaacaaagtgttaatcatttatttgctcagagttctgcgggtcaggagtttgggtgattgttttagtcttggccgcatttgctgagcctcagtggtctaggataacctcactctcatgtctggcagttggcaggttagttgatctgggggctcagctggagcagttcatctgtattccacttgctctcgtccttcacacttcttcacacagtagtgtcggggttccagagagtagcaagagagggcaagcctcagtgaacaggcacctgtcaagcctctgcttgtgtgatatttgctaatatccccaagaccaatgtgagtcacaaagctaagaccaaattcaaggggtggaagaaacaaattccacttcttgatggaggagctgtgaaatattatgaccaattttttgtagttcaccaaaaaggtattatgagttagttgagataaaagttattatggagagaaaaaagttttgttgtataagataatgtatgtgaaattatttttaggtatgtttccctaacagtattagaatatttaaaattatttcctgctctgaaagttttacattttgccccttaacctttatatattgtcttgtaaatttaaagtgaataactaatggctaggcacagtggctcatgcctgtaatgccagcactttgggaggctgaggtgggtagatcacttgaggtcaggagtgtgagaccagcctggccaacatggtgaaaaccctgcctctaacttaaaaacaaaaagtgaataactattgtcctatccatttactgatttatgaatgacacttttaacaaaactgctaattccttgcctcacagtttgtatgccatgtctctcattccaaaacagaaatgcatatcagccattccatggtttactctgttattacccatacttcctttctgtaccatgtgtcatgcaaaggagtgtttccatacttaactatgatttgctattttctggtaggtataatttaaagatttccattggtgtagaaagccttacaattttctcagtaccttagaatcaatagaactcttccatggatatttttaaataggcttttgactttttttgggtatgctgacctgcctgcctttctgtaggtatggcttcatgtatgctatgctgttttatgcacttgaaaagttgttccactgcctcaaagcttcccaccaccaccctaatccatctagaaaactcccgctagtttttttaaagtacattttaagcattaattgcttgtgaaatatttctgggttttcttcaccctgagaaattagatggtggtggtggtggctatagtagcaattgctgctttattttctcccaagccatattggaataagcgtggcatttatcgaatggtattttggtgtgtattattttctactttttctcccctgtattttcagctcttgaatagtttttgctgtttgtaggccttcatgcaatgttgaagatatcatgattgaatgaatattgactgactaacaaattagggatggtctgtatgtggtgattcattcagttacctctgatttgtagtttgaatttattgcagaccttctcttttcatatactgatgagcatatactgtataaactgttttagcttaattcttttttttttttttttttttgagacagagtctcactcttgttgcccaggctggagtgcagtggcacgatctcggttcactgccacctccgcctcccgggttcaagcgattctcctgtctcagcctcctgagtagccaggattacaggtgcccaccaccacgcccagctattttttgtatttttagtagagttggggtttcaccgtgttggccaggctggtcttgaactcctgacttcaaatgatccacccacctcgacttcctaaagtgctgggattacaggcctgagccaccgtgcctggcctttagcttaattatttgtgagaaataggaagatggatggacaggttctatccttagagaattcatctaatcaataaaataagtatgtctaaaaacaaatagagaatgccatataagttcagaggaaagagaaatcacttctagttggaggtaatcaggaagagctttgtggagcagatggcatttaaggtagcatttttaagatttgggcattttgaaatgggtaagaaaacatgatcaaaggcacagaggccaaaaccaaacaaaataaagtaaaaattctccttgatagaggcaactgtgggtagttgaatgtatcaataattggttttgtactttattgccacttggaaatcaagtatcccaatagaaagtttgttaaaatttatatgcaggcattttgtctatttttcattctgaccatgagtttatcaggtttgctaccattctttttactcatattactaaaacagtgctctgaaaactctttaactcttgtttgctaaattcagtcatttatttctaaattctcattttctttaacctttctagatttctacttggcattgttatatattcacctctgatatcaatttatgaaataccttccctagtataaaggatgtgagatcgaagaaaagaaacagatgtcctctgtattcctggcttttgtgaatagtacacgattatgcttaatctttttatcctctgtttctatttctgccttcttgaagcaaggattcctcaaggttctattttcagcctttgccttctatctgtctgtgtctcccctccacctcccatttttcttttgtctctacttttctttttttggagtacatggttgatgtataataaatgttacagactgcatcagtgtgggagaggaatctcaaccccattatggccatggctatttctccttttctctttgatcttcgtgtctaaccctgacctctcctctagctgtaccttcaaccccgagtacctgttataccttctctaccattacttcaaaccagtttatgcttcagatttgtctgtattagcagtgttattcttatttggctagttagctagaattagaacctttctcttataccctacatgtggacagtcttcaattactgtggatgttgtcttcgtcatctcttatatatctataccttctttattcctactgctaatatgtattttttgcattagtcatctgtaacctcttgtaatggtagctgctaattggtttccccacctttaggttgttccctttttcattcttacctgcagccaccagagccattttcacaaaacgttatttatgtagcactcttttcctcttgctcaatctttaaagatcagatctgaaatacgtagcaggatgtcctagtccttccatagtgaacctacctacttttcttgtcatttgccaccacctacccatagtcaagtaaactggtcacacaatcccttagtcagtcagtcttgcatatttctttctctttttttccttttggagacggagtctcgctctgtcacccatgctggagtgcagtggtgcaatctcggctcactgcaacctctgcctcccgggttcaggcaattctcctgcctcaacctcccgagtagttgggattacaggcgcacgtggccacgcctggctaattttttgtattttagtagagatgggtttcaccgtgttgcccaagctggtctcaaactcctgagttcaggcaatccacccgcctcagcctcccaaagtgctaggattacaggtgtgagccaccgtgcctggcccagtgttgcatatttctaatgacatattttgcctgcatatatatcttcctcctccaccccctgtcccatcctcatccttccagctcaagccctagctcttttgctctttttttttttttttcccctcctggcctctagaactgacctatctctttttgaagttctgtcttaccctggtgcacagggtaatatagaatctttggaaccttctaagaatactgtgactaaaaccaaatttatacctcaggcagaaatctcggcaatctttgctaaagcattctaccctgaggcatagctaatatccttaaacatttggcaggattgtggcatgggcagaagggaaagaaaaagagagaagaaaacaggaatgagagaataggagaggaggaaaagaatcttaaatattttctggttaatttgattgactgaacttaaccagtgcttgctaagtcttgagatcccaagggttgtatgtcggtgtacagataacactacagcatcatcaaccatgtcctctggcatgagactgatttaccttatccttagcaaaacttaaaccttacaaatctcatgataatttctaaatatctcactcttaaatacgaggtctatttctaggtctagattttgaataactaggtctgtttctaagtctaggtctgtttctccctgatatcattaaatttctgttcaacagaacattctaagtgtgctaagtgttgaaactttttttttttttcttcctgagacagagtctcactctgtctcctaggctcgagttcagtggcacaatctcagctcactgcaacctccacctcctaggcttaagcagtcttcccacctcagcctcccgagtacctgggactacaggcatgtgccaccaggcctgggtagagatggagctttgccatgttgcccaggctggtcttgaactctttgacttaggcagtccgcctgcctgagcctcccagtgggctgggattacaggtgtgacccactgtgcccgacccaagtgttaaaacttatgttgaaaaatgaattggggctgggcatgctggctcacacccataatcccagcactttgggaggctgaggcaggtggatcgcctgaactcaggagttgaagaccagcctgggcaacatggcaaagctccatgtctacaaaaaaagttgaaaaaattagccaggagccatgacatgcgcctgtagttccatctacttgggaggttgaagtgggaggatccttgaacctagaaggcagaggttgcagtgagctgagattgtgccatagcactccaacctgggtgacagagtgagaccccgtctcagaaaaaaaaagtgaattggtattgcatgtctttgctaaagagatgtatggaaatatacatgaaggactattttctgaattcatgttttttattgatcaggacacatgaactttaatactataaaagcatccataatattgtagagtgtaaacttgaaagtggaatagattggcatcatcagccaataactcttgagtttattgtggaaaattagtctttttatttctagaatttttgagtaaatatattatttaaaattttaaggaaatacccagtcttttctgatgagggaggggactcaggagtaatttctgagttgaaaatattttcattttttgtttctatttttaaaatcattttgataaatgggaaaaatactgaaagaatgatgttgagctattgatccatgcatggaatttctttctgttaataactgaggctacattattctgaagaaagaccatatcaagaaaagagagagaaacctttcaagtttataatttgattttttgtagtgtgttttgtcttataggtaaaagattctcctttttttttccatcagtattatttcaaattttggtttgactaagttattagtcttcaaattatagcaattaaaaaaattttacagaaagaaatgggtaaaaggcaagataaagtataagagttataattcaaatattacattattttgacatttttctgaagagctgatgatttaagctatacctgggcatggtttcagcagaacctaggtgagatatcttaatcatatatctaaagattaagattctttattgtgtatatcctctagtctttttttttttcaagagacagggtcttgctgtgttgcccaggctagagtacagtggcatgatcataactcactgtaaccttgacctcctgggtttatgtgattctcccacctcagcctccgaagtaggtgggagtataggcacatgctgtgtgccaccatacccagctaatttttttggggcggggctataggcagggtcttaatatgttgaccaggctggtctcaaactccaggcctcaagcaatcctcctgactcagcttcccagagtgctgggattataggcatgagccactgcttccagcctatatcctctagtcttaaatgagagtttatagttatcacattatgttaggtaaagcaaatgtggtcgtattattattattattattattagagacagagttttgctttcgttgcccaggctggagtgcagtggcacagtctcggctcactgcaacctccgcctcccagattcaagcagttctccagcttcagcctcctaggtagctgggattacagtcatgcaccaccatgcctggctaattttttgtatttttaacagagaaggggtttcaccacattggtcaggctggtctcgaacacctgacctcaggtgatccacctgccttggcctcccaaagtgctgagattacaggcgtgagccaccgtgcctggcctagtcatataaatcagagaccatgggaatattaataatttttaaagtacttgtattgaaagtaaaatctgttttggttcctttaaacttttaacaaattataggagcagttaatgctaatttaaatgtgtatgaacgattggaaatttatctctaaattagtaagcgaaaaccagccaccaccccattccaccgcctggaggtactagttttgtcttaatggctacacacacacacacacacacacacacacacacacacacacacacacgtgtgtatatatatgtatatgtatggcatataatggtatgtgtatatataatgtgtggacatatggcatatattggtgtgtatgtcaaccaatacattacgtatatgtgtatacatatacatacatgtctaacttatatgtgacttaataaaagcttaactaattacacaataaattttttagttttttcattttatttggagcactgcttttcaaagtctaattacatacataatttattgattgatgtacacatagattcatacatgcatgcatacccctatataatttcatttacaaatatagaactataacacattattaaacaacataatatttttctttctttcttttttttttttttttagacagaggctcactttgttgcccaggctggagtgcagtggtacgatctcgggtcactgcaacctcagcctcccaggtttagatgattctgccacctgagcctcctgagtagctgggattacaggcacccaccaccacgcccggctaatttttgtatttttagtagagatggagtttcgtcatgttggccaggctggtctcaaactcctgaccttaggtgatccgctcgccttggccttccaaagtgctgggattacaggcatgagccactgtgcctggcaatttttttcatttaataatgcatcagtcgtatcttttcaccttgtatgtatagtctagaagaatttaatctttctctggaaattgactaggccttcaataacatttggggatcactttcatgcttaaattatgtcagttgttttaggatttgaattacagtctttcatcttaaatacaacagcatctgggaatttcctctataattaagtcaccaaatattgaactgggttaactcttgaagtttaagttagtcagtcatagttcattattacagccttttatgatgtataagacatatcatcattttccagtcttcatatcaagaagaatcttaggagatttaatagtgatttaagatactagcttataagtgtatatgtggcccatcctgctgtactgctatgtatgaaatgacagaagtgtacagggaggaagaaggattaataattatttgatttgattagaagaggaaatttagcataaggttttattgcagaaacattctttttttttttttttttttaaaaagaaaggtgtcactatgttgcccaggctagacttgaactcctggcccaaatgatcctccctagtagctgggactacaggcacatgctgctgtacccagtcttttgttatttcttaattaccattttaatacctatacaggagactgttagaatatatagtcctctcatatctgtgggagattggtaccaggatacaccctctcacacccctgcagataccaaaattggcagatgctcaagtttcttatataaaatggtgtagtatttgcatataacctatgttcatcctcttgtagactttaaattatctctaaattataatttccaaaacaatgtaaatgctatgtaaataattattataactattgtctttaaaatttgtattatatttttgttattatacagtattgggttttttttattgcttttcacaaatattttgtttgcagttggttgaattcacaaatgtgtaacccaaggataaggagggctgactgtatattataatcccttaaggtatggcaaagcacatctgaaatgttatgaggctttgataatctctgttaagaattgacaaagtagggttttatagttctaatggtgagagagactataaaactgtgtattaagagcaacttttttttttttttttgagatggagttttgctctgttgcccaggctggagtgcagtggcgggatctcggctgcggtggtgagccttcgcctcctgggttcaagcaattctcctgcctcagcctcccaagtagctgggattacagggtgcatgccaccacgcccagctaatttttgtatttttaatagagacagggttttgccatgttagccaggctggtctcgaactcctgacctcaagtgatccccctgcctcagcctcccaaagtgttgggattacaggtgtgagccacaccacccggccaagagtaatttttaaaaaatgtttttccatgtatgagaagttgcttacaatatttagttttgtgctgtagcattgttttgctttttggctttgcctgtgtccttatctatttctcccataaactgtgaattcattgacaacagaactgtgttcatttctccagggcttagtacaatattttgtctgcaatagatgttcaataaatgttttattaattatactgaatagatttattcttgttcttcatgtgtaatgcacatagaatcagtaccagcaaattgaagataatcgagtatagtggtcctcctaatctgttagaactgagttcaggtaaatgtttaaccaagaataccatcaaaatatgctatagccattttgactcttaaaaatctgtttcttctgaacaatcctaaaataaattacagtgaccgtaaaaggagaagaattacactgatgggggcggggcatggagggcatggtaatacttaaattctcacagatgccctcacagttgcatttaatcctcatggtttaatcatccaaaagcatgttacaatattactggctctccacgattagggacgtcatagcccctgaaacttatttagaattatttaccattttgaaattttgaatgcttgttccaaatagaagatttcgtaggatcaatagttacaactggtttgtcttttaataaacattaattttcactttctgctcactctgtgtcctttttctaaggattacttagcagttttctgatttttgatgggccatttaggctctgaaagccaactcttgaacctattgtgctttgtcagacaaacctaacacctgtccatgtttgttactgcttttaatatctgttatagaaatatgtgtgcacatgtgtatttgtatataatggcagggtgggtatagcagctccctaaaaggagaaaagcaactggcttttctgaaaagacctttccacccccacctttttgcagacagccggagttaatccttccaagtttgactggaacagctgagcaagtgtaccctgcatatctggaggcctccagtggactcatgttgcctcagagttggggccactttcttcttttctagtgctgatcctgccagctgtcctaacctctgttaaagcacagcgagggaggtgttaaatgatacaaaaacatacagtgtcatgaaagggatccccttactgcgtgtatcagtgtgacttttttctcccattcctttccgtggcagaaaggttttatactgttaatcctaacacctgtctctgccggagacagtgagaagggtgtgtgtgtgtgtgtgtgtgtgtgtgtgtgtgtgtgtgtgtatgagagagagacagagaatgcgcatgcgtgcacacgggtacatgctccccgcccaagaaagaatagagtagtaataccagtcccatctgcctttctgtgtcctggattgggagtattctctgacgcacttaaagcctggaacatatatattattttggctcctggataccttagacttcctaccgtgtttgtgtgccagtgtgaggagcctgtgttcccttccctggctgtcattctctgcctcttgagtttctggttgagttgtcaatttaaaaaccaacagtaacagcaaatctccagtgtagttttcagtctgtaactagtaactcaaagctttttgcttttttctgaacatctcttctgtgtattgtcaaatcctgttggggtggaggcctggtctcaaccaagctccgacttcatcagctgagccagcatacctatctgcgtagactggaggtcagcgaaggatttttttggtgctacctagttcctttggacaggacagccagcgcaaacaaggcaaaaacttagacactttttgtactgtccttatctgaagattttttcccttttgctatgtatggtgtatattgtatggattatcaatatcctgttgtccaggtaagctaagggttataatttctagatactgtttgatttatgtgaagctttatggtggaatgaaatgcctacaaggctttctgtcttttgacccggtaccattcagagcctagctttcccagtgctttttgctaatttactgtaataagaggatttaatttatagtattggcggccagacaaaggtggttggcattcacccctagaagttctgaaactttggagagattctgtgtgtctgtgtgtgtgtgtgtgtgtgtgtgtgtgtgtgtgtttgtgtgtgtatgtgtgtgtgtgtgttttgaaccaggtgggctggacaatataaatgtaatgtaaaaaacccatcatattatgataaactttaggctttgttttgagcagatgagaggcacagttggcagtttccaaatgttgtattttccagaaaggtaatatataaagtagagggcatctttccccactaagactatttttagtctaacgttttagactattttgtgatgacattagtaacatcttatttgttaacttgttgaaatttagaatcagaaaatgttaggtcattgccaagcatatttctgaatatcttatagtaagaaaaattgaagttaggagtcctggattctggttccagcaatagagttaaccaccaccatgttcatgctcaaataacttcaatttttcttgactttagttttgttgtatataaaatgaaggagttgggccagatgacctctgagctatcatgattttttgaaatattgtgatggaaacctagaataagaaaataaatacagttaatacaattaattctgaattaaagatactacttggtctgtcagtttgttttagtttgttttcatgttcctttaattatttttttctttcaaatagccatttctctaataattagcacctatgttgcaggttggaccggaatgcatagagttaaaagaaataatggactaactagtacatcttattaggtattttgggcctaaaggcccaagctattttggattgggcctgttgggtaagctctctggagtaaacttacagctttcattcaagtctaaagctatcaatattgcaatcatatggcagtggctgtgattatgtttctctttaactatattctaatagaggtctatattatatgttttatattaatgatataactgtttctgttattttggattattcaaattaagagtattttatatttacgataatgaggttttgatatatttgtggatttcacttatctatgaactgtatctctactgacataaaacaatagcttgggctttgtaacagcttaaggctggaagtgttatgagactagattagaaccaggtctttttacaagtaaatattaatgtgctttcaatgagaaacatctgtgaacagtaaatttctgacccacaaccagcaaagtatgggaattatagtaactataacataagtaaaattctttgaggaaaaagttgaaaaagtaaaaatgtttcccaagtgaattgaagtattagacatatatgaaaaaataattacagtatgtaattgaattttttgaggaaggaaattgaccatctccccctcccaattttggggtggattaaagagttcctgttcagaaattatgacatggtttgatgaaagtcttttgcagcaaaattctaatcaatattcataataagatgaattttccacccccaatttttttggttattagtatttagtactgataaatgtagtgcacagtatttgaaactacactttcctggctttactccatttgtaggtttattctatctgaaattaacgtcgtttagaaatggaggtaatgggatattaaaatttaagggtttactctccattctgccacataggaaagctaatgggattaaaaaaaaacaattttaaattgaaggatcccaagctattttacaatcttatttattacttttttaaagtaacagtttttttcagtgcatttataaatgagtagtagatggttggttactacccaaactcttaactacagttataaaatgtttttagcttcttttatatattcttttgcttagttaaatccaagctttccattgcataatgcttgcagtttcatactaatgcattatacagttggacgttatggaggacatgattgaacagtatttcttttaatgaaaggttttacatctatttttaattaagttatttctagaattgctagttttgagttaatgaaacaaagtgagttctcttcaacagaaagttcgaaaatattttaggtacttgacctttcattgctaaatcatgcctattttaagagtgtgccattgaaaatgattattttattagttataattttcgtagaacctagtctggccaaattagtttaaaatcaggcagagtaaggagatacaggcttgcttgtgatttaagggacaatgaatgtagtctccctgcccagacaaatctatttaagaaactgttcctgaagttattcttatagacagtctttcagattaaacatttactgcctctgatcagatggttaaaatgtaacttgttgcaagttaagggtattgtcttttatcacaggttttccttaggcacttttacttaacctgtcatccaagtggtgaatggggcagttggaggaagaggaaacagggtcttaaattattggaggtatagctaaatttcctgatttgagggtttagggtagccaaggacagcttaaggatattaggcatctagaaaattgagagacagaaatttacctatctaaaggacactttttcttttgaaacagagtttctttcttgtcacccaggctggagtgcagtggtgttatctcggctcactgcaacgtctgcctcccgggttcaagcagttctcctgcctcagcctcccaagtagctgggattacaggtgggcatcaccacacccagctaatttttttttttttgtatttttaatagagacagggtttcaccatgttggtcaggctggtcttgaactcccatcctcgggtgatccacctcctcggcctcccaaattacaggcgtgagccactatgcccagcctaaaggacacttttgatattgaggtatgctcaggtcctcaaaatgctgtagagtatattaggctctccatttcttcatgggaagttgaccttggtgttaagcagtacacacacacacacacacacacacacacacacacacacaactatataaatttatttacttatatagtttatacttatatagtttgtgtaattatattaacttatatagtttatacttacatagttatataattatattaacttatatagtttatacttatatagtttatgtaattatattaacatatgcaagtttataattatagtgtatgtaattatattaacatatgcaagtatagtttatacttatatagtttatgtaattatattaacatgcaagtttatacttatatagtgtatgtaattatattaacatatgcaagtatagtttatacttatatagtttatataattatattaacatgcaagtttatataatttatataaattgaatttattttctcattctgaattagtttattgtgtaccaactgttttttgagtacctactgtgtgccagatactatgccagacacagggatattagtggtgaacaagacaacaaagtttcctgtaacttaataatagaggcatggcatattcgtggcatgccgttggataaagagcagtcttcaattttcacagattaatcatgtattatcttcttgacaacccagttattgataaatttgtttacatcccatccattttcatatttgtctgagaaccttttccttaatccctcacagggatgtgtacaatgtacacataatttcagttgtatgtatgactctagttatctggggtttgggatttcttaaagatatgaataagttacccaaagacatgtagtaatttgtgaattaaattttttgatttgcctggcctcactgatgtcttagtttatgttatttgtggttttgtgctaaaggtttgactttggggaacaggaaataaatgaggattgttttttataagcctataagatctaaagcatttgatttcaaatttcacactcacttttttttttttttgaatggtgaatgggttctatatgactgaactctgcctaaactagagaaataaagttagggaaataatagagttagctgtaatttgacttcatttatgttaaggggaatgttggggcaaaggatattaaagtggtattgtattagaggtgcttctggaaaggtatttaatatctgttaggtgtaaattgttatttacacttagttagggttattgtgtgggggcgtgccgtgaagagcctttataccaacaagtttttattattgcaggaaatgctctccctttaatgttgcctttcacttgggtgtcagaggcagcctgggaaagttggagcaagccctgccttgtagacagggactcttagatccacttttatagcagtgctggtatgtgggtggaaggtagggaagctgagttacttctgtatgacaagaacacctaaaaaaaattttttttaaatgagtgggtattattttgtctagaatctgaactattctaataaaattgaaaataaagcctttctcccactctttttgtacatcttcctttcagcttcagatttctgaaagatactgaaaataaaactgaagtaaggccaggcgcggtggctcacgcctgtaatcccagcactttgggaggccaagacggttggatcacctgaggtcaggagttcaagaccagcctggccaacatggtgaaacatatctctactaaaaatgcaaaaaaaaaaaaaaaaaactgccgggcatggtggtgtgtgcctgtaatcccagctacttgggaggctgagacaggagaatcgcttgaacctgggaggtggaggttgcagtgagctgagatcgtgccactgcactccagcctgggcaacagagcgagactccacctcaaaaaaaaaagtgaagtaaatttataaatttgaagatatctccaagtgcgctcttggaagaaagaatgcttttataatattttgataactacataggtgctcttcattctgatgtatccatgtgtgaataaataaatggctagagtaatagaaatcaaggcattattgtttgatttcaacaaacattcatttactgtgtattcagatactgggttaagaactggggatatagtataaaacatgatttctaccctcagactgctcatagtctagtcatagttatgcagaacagtaactccaaccgttatgtaccatggattaggtgctaaggtaaagtatgctcacagataagggtacctaaaccagatgtgggagcaagtagggtcaggaaaggctttctggagtaggggatttctgaagtaagccttgaaggatgaataacccatatagtcggccatattcaagggaaaaagaatagaaacatggtgttcagaagagatgtatgtgctcaaaaatagaaatgtgggagccgtcagggtaaattcttggtaactgaagtgatagaatgagttggaacaccttgagcaagtgtggtcagcaatgttaacttctttgaggtttggacccttttgagaatctgataaatactacagatcctctctgcgtggaaatgcatataagaaaaatttctactggggtgcctgtgttaggaaccatgcactttgggttaagaacctctggtgtgcagtaaaaagagatctgaggatgacaccttgcaagtaacaacaacaattgagaggatggtagaggaggaagaagagtacgatggagaagagggtgaacagggaaagaggaaagttaagaaagactggtatcattttaagttaagagtgagagtttcccaaaggagggaatgccaaataccacagacaaatcaaagaagacataaaatgtccattaaatttggccatgatttggaggtcttcagtgacttcagtaaggtaaatttcaattgagtagtatggaggaaaggaagctggggttctggagattggatgaaacactcaaagagttgagactacagggagaagtacctctttccttcatttgtttatttaataaatatttcttgagtacttaccacgtcccagacactgtcctgaaagctggggatttgtccatggagaaggcagggcctccttcattagctgacatctcatcgtgcccaccctgttccaaagcttcccagcccctgcctgtctctctcctcccaaacacacatacaggaaatgtcctaaaatgattttctccttggtacattaccgggcacattcagccaccaggggactccagttttgctgggtcagacccaggctgctcaattgctcttctctctcttggacaccagggagcaaattgtcctctataataccagggacacacttcaaaatatcattgtgccagtcagacctcactatgagcctgtcattcagtgagtttataaaaatcattgtaacattttttttaagcttgtaccaattctttcctgtaataaatttttaagcctatttgcactgtaaaatattggttctaaatgtagaaaagtagcatgaattcctggcctgaggaaacctttatcctagtcttggactttttgcatgtggggacccctcatttgcccttttctttaaaaacaaaataaaacaaaacaaaaaaactccttggggccttgtctctttccatgatgtatggaggctgcagtcacacctaagtgtcaaggtagctgctgcttttctaaggatgggggcgggggacattgtgggggagatgctatcttcttagtgccccaggctttttgtcaagaatagtgtaataaaccagaggattcagagaatgatacacagtgattctgaggtttatttcaattattagaactgaaaacacagttatcccattagtatgattcaagattttttccaaaaatacactgggttgctcttgcttccagtgaaactcacctgcccattttctgcttactcactttgtctttagaaaatttgactgctttttatctccttctgattggcttttcagttgcaaattcagagagtactatatattctgtgttccaggtcacttctaaaaagtgttaaataagaacaggcctagtacttatctatattactttactcagcgtttttcctaatatttgaagatctcattctttttaaaattattactatggattatgccacaagtatacagatatctgtaaaatgcacagaatagagcctgatatactatgttacatcagtttctccaggttccacagatggtcctgtatttcctgtgttcctttcagaattgttaaaatgattattaatttaggagcgggtgtaatgatgttgtattggcagtgtgccagccaatggtgttatacaacacatttttttaattttaaaattttaaaaattgaattcacaatagagatagggatttgccatgttgccttggctggtcttgagcttctgggcccaagaaatccaccagccttaacctcccaaagtgctgggattacaggtatgagacactgcgcctggccaatacagaacatttttaaaagcctggtactgcatgttgccaaacagtccttatggagacagcaaaaaactatgtattctcagtgtgatttgttattttgaatttagatttctgtagatgtttattttttaaatggagagctcgtgttgttagccgtgggcttgtaaaaaataaaaatagataaaaattaaaaatgggaagcttaattttggaattaatctttttaacctttgggtagtcttttagaaagtatatcctaaaaatacatagcataactaaaatatctcataaatccttcagaatgagctatttattagaatgctgtaaaaaattagaaaatcttaattttatgagacaactgataaactcatcattttataaattgttttatttgaatgtgtgataatataaaatagggaaattatgaagtttatattcagaggttaaagatttttccaagatcactagtaaagggcagaattagaccaacttctggactgaaccacatctttgatgcattttttaattatattattttaataagagaactttaaagaaactcttattgtcagtattctcctaaacctgtagctacagcattctataacaattactatttacaataatgacacaaatttctagggtatatataagaaaggatttacctttttcaataaaggctgaaacatagaaggctggagaaaacaaaaggtgaattttcagttaaccaaaattttattgaagctggaagccttaagcaaatttgcatgcacctttgtgtatctcttaagtttcttaagcagtcatatttgtagacacctttttcagagtctccaggtattttttatagtaggaaaaaaatcatttaaattacctctcattacctgtgtcctctcttttagtcctttgctctcactaggctggtttggtcttccaggacaagcaagttcttgcatattcctgttccttgaaaaaccttccagttagtggtcatgtaatagcttttcacttcttcacatctttcttgttaaatccactgcatctataaactgtacatcagtaaaaatgttttattaatattaaaaataattttgtttcatttcttatttgacattcatggctggaatctcttaaatctgtatgaactatagtaagctgctatgaatgcttccagtgctatataattaattccatcatcgcatccttaaaatatgccagcacatggcgcttgcccctccctacctcctcccccctacacacacacacacacacacacacacgcacacacgcacacacgcgtgcgcacagcgtacaccaaactgccattctccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcaggtaagatttgtgcttcctcggcatgtttcttttctcctctctgggatctaaataaaggtttgagggtggagtatagtaagaagagttttaatcattattgtcttcttagaacagaccagatttattgttatcagctgaaaagtctgtgtctgttgagtccgtttatgtgtgtgttatgtatccgtatcctttcttccccctccctcaactccatagcagattcctgtttcctgtactgtgcagctgtagctcaggaaagaccctgtggggatttgtctacctctttgtcttggttctgagaagagggagggagagaaagactgcagaggtaggaagagattcttgtagactgccaaaaagaggggagcaggattccttttaagaatttcagaagaatttgtgttatagggaaatctgattccttgttcactttggtttctcaggattggctatggaattgtagttttgctgttactctaaactgcttattaaaaatgaaggttagaaaagaatgtttcattttcatgcctttgttactggcaaagaaaattttcagtaggagcattcaggtgtgacagaggcaggtagagccctccttgacaggagaacgaatctgaatgtataaatcacaatcacacaggctttaaaatacatttgaaggagagagagtaggaaatggaagatacctctcctccctctgtctcccctctcgtttttctctcttctcttctctctctcccactcccactcactctctcccccaaccccctcaatccccctttctctcctcatccttttcccctctttctccctgcctctttttggttatgccaggcaatatctaatctgcattttagcaagtcattcctgacaaatggaaaggtgaatgctcttccacagttctccctggcaaggcaatttttcttgttagcatccttctgtacgctccattaccctttttcctttatgtataggttaagaggaaatgatgaggctctgatttatcaatgagaaatcatttacactgtaggacattcaaatcctttagtctcagacttaagatcagtttcactccaggtttctatgctctgtggaaatttcatcactggacagtgctttccttttaaggaggttgccctttttttgtgttctctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagaacttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaagaaaagaaatactgctttattttttaaaaaaaatttacataaaagataaatcctgtttctggattctctttttgcttgggagatgatacttgcttaaccttagagccctcattcaatttttattaactggcaatattagagggtaacagctctcttcttgcttagcaattactgaaggcttttcaatgacttgacttttcattatttattttttaaactagtgaaagaatgatctaaaatggaaatttttatgatgagttttctattgcctcttggaacatttccccttagtttctagaggagctggtaagtgtagtgtgtgtgaccattaagttagagtgcacatgcttatgcacacttaatattgtggtcgtaataattagtatttaaagaagccataagtttaggaatgaagtagaagaaataaatggaaactggaaagagagattctggggtgcttaataattctaataataaaatcacctgttttatcaggatgtgctaaatattgaagaaaagttatgagtttttgcccatcctgaaattatacaactggcaaggatagaatatcaaatttgtgaattttcagtattccagcgtatttgttttgttgtatatactttctgtgttaatgtaatgtacatagttgttagtaatctagggggaaaacaatcaaaggaaataaccagctgggccaagtctttcatttgtcctgtggttgtgttgtgttgtgcctgcgtgtgtgtgtgtgtgtgcacatgtgtgtgtgtgtgtgtttgagccagacatccaatcccaacatttgataatgacctgtcacataagctttctcaatatagaatgtctatactggtggttaggcctgggttttcaaagttaaacggtttattacaatgtaagagcgatgtatggatgtgttttcactgttttgctacttaggttctttgcatcttcagatgataccatctctgtagtccccagtttccattgctcagctgttggaaaagggctttcagtgaatgactttttcatcataccatattagatccttgtcagtatttgcacagtgtatgcgctttattattacatatgctctacttttatagggcctgtttttgttttaattatcaaactactctgtcatttatagtaagtaatcagtgctctgctaaaaagcaaatggcaatttaatcacaaaattctaatatagccgatagacatgcttatgtgatacttaaaacgttaattttatcggctgttcatgtgtatgttgtaggagtatttcactgagatctcttattttttgggcatatagaccagattattgcatctcatatttatgaaaatagcaatatggaatatgaaggaaagataaatcattcttgtactatgtgtaaaattcgaaaaacaaaattgcaaatgacttcaacactaattagtaaaaaataaatgtttagccaaactcaaattcagttatactatctattgttgaaagggaaagtgtactaggcagagaggaaaagattttacagtatggatgtgaaagaaaatttttgtactctactatggtataagactgccagtttctgtggaacacaaagccctccctttcttggacagctcagtgctttgctggcattttcttcaaaatctgttttccatcaggaccaagaggagggaaggtgttaggaataagggaggttggaaagggggttgctgttcctttaaatagtgcagtgagtccatgtggcagcaggccgctctggagtgtattcttttgtaatgaatcaccagttccattgtctgctatctcccctctttgtagctggaaggctgaagtctttcacctgagctgctgccagttcgctcttctgttcctgggtggttgggagaagagaagagggagggtattttatgctttaattaaagacagataagagagcaggtatgttttgctttgtttcattttctcttttcctgtttttgtttgtctggtttttgaaaggagttggagtagagaatctattctgtgattttgctaagcatatcccattttctttgaattctggaggtcctctcagcatttagtctccattttgtggcactgctttaaagtgattccattcggttgcctgccagtcatgctcccttgccactcgaaccttatcccacccttcatccacggagctgcagccacactgtttgttttggcacactttccactttctatgggctttgcaggatttggggagttggaggataggcggggattgtgggttggagactgaatttatgttcctttacaatgaaaaaaaaaagcctcactttttccagagatttggtttctttctgaattcttctacattgctccatatcttcagttataatcatttcttcgctgaggccaagattgtctcttgaaaagtattgcttttctaaaaattacttagctttcttgaaaagataaacagaatttcataaatgaagctatgatgaaatccgagcaatcttgactcattaaattgttttttccgtcttagtcaccccctaatcacacacacttttctctttcttttttggcccccttctctattttttcctttatctttctccttagctttgcaattgagtctaggtaagcttaatatttgacaacctattacttaaatttgtattgctacaggagacatcttcatattgaacagtaatgacattcctcattcctctcagtgataaggcataagctcaaattcctggttttgttcctccagttttctgttctcccctgagaaattccaaactctgatctacacagattgccatatgtaaacaattttatctctctcaaatttgaacttttcatcatgtaattccttacctaggggttgtttcttggacatctgtttatggtagacagatagtttctgggaaccagtcatactaggtgatacagcccccccttacccaccctggtctccttctggtataccattcctctccgggatctgacattattggtatcccacatgttcccttccgaagtcataattcctcactcttttttttcaacatttccaaaccactgtcaaatcttttttgaacatttcctcccaacattttgtatgtgaaatttgccaggcacaaatacaaggctcccctgcagtaaatactttgctcttttgattgtagcacctttcttagtgggctccagtgttcaacctcttctaggcagtgagaaatgctgcattctgccatcacaatgtattgtgtctattccccagactcttaaatgtttctctattactattagaatgattaaattcaggaaactaattcattagaggtcattgccagagtgaatcatttaaaatgcaagtctgattttgtcattcctgtgcttataccttacagttgctccccttcagtctctgaataaaatcctgtgaccctgcatgatcaggaacctggctgtctctctagtctcatctcctgccatccttttctttctgtatttcattctaatgacactggcctctttgctgttctcttaacatgcctaagaccctcctgctcaggacccttctgcttttctccctgcccaaaatgtcttcccactggtacccatatggtttgttctactcttgaatatttcttctcaagggcgacctctcccttaactttcctagctaaaccagcactccctcatcactcctaccttcattctgctttgtcttcacttgtcactgattttagttcttaccgttgattgttatatgtttgtttgttgtctgtctcctccccgaccccaaacagaagctccctgagatcaggatcctcgtcagcagtctgttgtattcccagtgtgtagaacagtgcctggcacatagtcataataaaaatagctaatctttatatatgcttatgatgcattaatatcagataccgttctaagcactttaccctcattaactcattgaatcctctcagcagctctgtgttatctccattgtacaaaagaggaaactaggcatatgacggttaagtaacttgcccaagttcagacagctactaagagatgttgtggggaatgatatccagacagactggcttagaaattgatattcttaaccactgtactctaatgccccttgtaggtattgggtattcagtaaatatttgttgaatgtgtgaataaattaatttagttgagactctgattcatttctgaaatttccatccctgacttaagactttgataaaacacttgcagtaatggaattcattgttgaataagattacttcattcttataatatgtaataaagtatacattattctatgataaaaatattaatattatctaataatactaaataataatgcagagcacatactgtgcattaagcattgtcttaagtgctttacatattttagagcatttattccactcagcagccttatatacttactcagcagtactattaatgtccatgttgtagaaattaggaaacccaaggagtttggctccagcatttctgttcttaaccaccactaataatgaccattataaaaatgtttttgtttttttatacctactttgtgccagtcaattttacatacatagcacatttacaaacataattattcatattatgtatcacttgtcaatcatctttgagataggtgaggtttttcccattttttgcaggagactttgagattctaaagatcaggcagcctggaaacagagagagataggtttcaaactggagatctatttagtcccaaattcgcatgctcttccattattctgtgaacctcataagataaatagttccattgttggccatgataagtagaaaagttttctttatgagctgaaatctgttttcatgattgtcttctcactccttctcattttctcatctggagttgcattgagtggtttcatgtcttctacataaaaaccaaatatttgaagatactgctgaacgttccctttaatcttctgttgccttgcttatttttcctacttccttgaattactcctcatagatatgaaaacatacggtttccagaatgtttactgactgtcctggactagttgcattaatttatatgaatgatttgtcatttatgtctaatcactaagtaaaaatatcaattatgattactttttaagttttattgatgcataattatacatatttatggggtacatatgatattttgatacatgcgtataatgtgtaatgatcaaatcagtaattaggatacccatgacctcaaatatttatcatttctttgtatagagaacatttcaaatctccccttctagctattttgaaatacacaataaattattgttaactatagtcactgtgctgttgaatattagaacttcttcttcttctttgttttggagactgaatctcactatgttgcccaggctggagtacagtggtgcagtcttggctcagatcttggctcactgcaatctgcgcctcctgggttcaagtgattctcctgcctcagcctcccaagtaggtaggactacgggtgcatgccaccacacctggctaattttgtaattttagtagagacagggtttcaccatgttggccaggctgctctcgaaattctgacctcaagtgatctgcctgcctctgcatcccagagtgcttggattacaggtgcgagccactgcacctggccaagaacttatttcttctgtgtttttgtacccagtaaccaacctctctccatcccctgcctccttcccagcatttgctaaacattctacagttatgagtattaagtatcatatctttgttataagttttgttttatgataacatgtttggctttagtcagtttcttttttgttgtttttgagacagggtctcactctttcgcccaggttggaatgtagtggtgtgatctcggctcactgcaacctccgcctcctgggttcaagtgattatcctgcctcagcctcccaagtagctgggactacaggtgtgcgtcaccatgcccagttaatttttgtactttttggtagagacagggtttcaccatgttggccagactggtcttgaactcctgacctcaggtgatacacctgcctcgacctcccaaagtgctgggattactggcgtgagccatcgcatacaactggctttagtcagtttgtatagctcattgaacatgtagtgttgttggcaatttataatttcaaaaatgaagggatattaccttgaactcctaaaaagaataaatagaatattgtttttctctccactataaagcatgccctcagctgattggcaggaatctacctgtcttttagtatctgagtcttgccctgatccctcaaaggttactgtcactgagtaatggaagtcaataattattttatgaaattataaatgaatgcttttatgtccacaaatgatacaactgtattcttttttcctaatgttaattatgattcctcataagaagtttggaagagacaaactgggacttaagtgaaggagattgggttttgaaaagactcttaactgagagcaaagatccacgaactttttctgtaaagggccagatagtaaacaattttggctttgcaagccatgttgtttctgtcacaactacccggctgtgctgatgaagcattgaagaagctatagatgataagtaaatgaatcgttggttgtagctgtgttccagtaaaactatttacggacactgaaatttaagttccatgtaatatgtatgtgtcacaaaatatgattcttttaactttatttttaatttattattattttttttttgagacagagtctctcactatcacccaggctggagtgcagtggtgcgatctcggatcactgccagctctgcctcctgggttcacgccattctcctgcctcagcctcccaagggcaggtgcctgccaccatgcctggctaattttttgtaattttagtagagacaggatttcaccatgttagccaggatggtctcgatctcctgaccttgtgatctgcccacctcggcctcccaaagtgctgggattacaggcgtaagccaccgtgcctggcctcttaactatttaaaaacgtaaaaccatgcttagcttgcaggttatgcaaaagtaggtggagggctggctttgaaccacaagctatagtttgctgatccctgactcagagggatacaggacctcgcaatttcctttatagcatacgtaaggttttcccatatagcttcatgacagagagacagttttgagtggttctagcaggtcatgatggatcccttttataatagaatgaatcccctgatttgctctcttatttccccagccccagaaaatatgaagattcttctccttctttacttcctttctccctccatatgctgtattttataccttattgcttttcatatacattttcatatttttttaaaaacatttttcatgtagttatatactgtataacaacatttgggtcaacgacagactgcatacacaatagtggttccataagattataatactgtatttttactgtcccttttctatatttagacacacaaatacttaggtttgtgttatgcttgcctacagtattcagtatagtcacatgctgtacaagtttgtagcctaggagcaataggcgatgccatatagtctaggtgtgtagtaggcaataccatctaaatttgtgtaagtacactgtgtgatgttcacacaaagacacttgcttaaggacacgtttctcagaacatatccctgtcatcaagtgatacatgactattatttattactttgggccagatgcatttttctcccacatgattaatttgtctttaaaggttcagcttagacttcacctacttcagaaatcttcctgtctcacacagttgtccctctgtgcttcattaacattctgtatgcattgttcgtttagcttatatggtactataattgtgagtatatttctgtgtttttccatcagactatagtttctttcaggattgggactatatcaccagtgtcagcatccagcaaatatttcttttgagttaattaatgatttttaacttgctaattcattgatagtgtcctcttttgaaatgttgaatgggagagttaaattgggtagtcacttgtaacctaatgcttattacttaaatcagttaatacttagcacacatgtagtttgggaaatagatgctttacatggctagaagattgggaggattttggaataaacaactatttgagggacacaggaaactcttgtattgtagatgttttagtgaaagtggaagcctgggtgtatgacggtaaatggcataggagctctagcctcctggggagtcaggcaggaaggacgaagggcatgactcccgcaactggggaaagggcacgacagagaaagagaagtggaaggtgacaatgaaatcttagggattggcaacccatggcaagtataccaaatgtggtatattgagcatagtcatcttcctctctgctttgccttccactcaagatggccaagagttagattctttacatactacttttgaaaacttgtcatcgcagatatatagcagatcctaaccagccattctatgtcattttcaaggctcactattcttttaggtctttttccctccctctctctgtttctttttggatcttttctatatggtaacatcaaatgtacttacctttttttccctgcaacatctagtctgccattaatccaatccagtgggtgtatatgtgttttttaaatctcagattatagctttcgtctctagaatttttatgtaggtctttttcacacctctcatgtctcttagcatgttcatttttttccttttttatcttgaacatatgagacacaaatgttttaatgtcctcatctgctaattctaacatatgtattagttctgggtgagttgtgattaatttatttttctcagcattatgtgttgtagttttcctgcttctttgcatgcctggtaatttttgactggatgccatacattgtgaattttatcttgttgggttctagataattttttatgtctataaatattcttgagctttatctacagcacaactgcgtttcttagaaaaagtttgatcctttcgggtcttgggttgtttgtttgttttgttttgttgtttgttttttgagatggagtctcgctctgtcgcccaggctggagtgcagtggcgcgatctcggctcactgcaacctctgcctcccgggttcaagcgattctcctgcctcagcctcccgagtagctgggattacaggtgcgtaccaccacgcctggctaattttttgtctttttagtagagatggggtttcgctgtgttagccaggatggtctctatctcctgacctcaagatccgcccgcctcggcctcccaaagtgctgggattacaggcatgagccaccacgcccgacctcaggtcttgttttttaagctttgttagacaggactagagctgtgtttagtctctggttaatttttcctggccactgaggcaagactctttttaaaactctaatggatgctccttacatcattaggttttccactctggctgttaagaacaggattattcttggcactgtgtgagctcctagtactgttccctgtatttctttcaggtggttctttccccagcctctggaagtttcacacatagatgtggcagtcatcactcaactgagtacttgagatctttagagctctctttctctctgcaactttctccagtaccgtcccctgtgctgtcttggcttctccagacttctaggtctatcttctcaattcatggaacccaccaggttctgcctgggtccttccttctctgctgcagcctggaaactttatccatgtgataagttggggcagttgtaaagctcaacttgcttgtttcctgactctggaatctctgtccttccttgcctactagacaatgtcttgagtgctgttgtttcatgtattttgtggtttttttagtagtttcaggtaaaaagaaaaatctgtttcttttttttttttttttttgagacagattcttagtctgttggccaggctggagtgcagtggcagaatcttggctcactgcaacctccgtttcccaggctcaagcaattctcctgcctcagcctcccaagtagctgggattacaggcatgtgccattatgccctgctaatttttgtatttttagtagagatggggtttcaccttgttggccaggtcgaactcctgacctcaggtgatctgcccacctcggcctcccaaagtgctgggattacaggcgtgagccactgcgcctggccttaaatctggttcttgttactccatctttattggaagcagaagagtgaacacatacttttaaatgaaaattaagcagtgttgcattgaatatatttttaatttatgagtgaaaatcagttgaacagttcatttcaaggagtattaaggaagaatgcgtaagatgtgtaagtaattataatacaaagtgggatacagtaaattacatgaaaatgatgtcagtaaagtgttgttaaaagcttatatgaggaaagagtttgagaagtttggcagaagtggaaggtgtgaggagaatggctatggcattgctttgtgtgtgtatgtatatgcgttatacaagacattatctgaaactagaatcaaattctttagtattgagtgaggtttagtggtaggatagtttcagagagtctaggactgataaaattaatggggggaaaaaagtcattagcagaaatacctaagcaagaacacaggaaaaacagagtttccatgtttttatagtttggtgtgatttgtggtcttgcggaaaaggagaagcatccttttttcctatgtattacctgcccttgcaaatcttgcagaagagggagaaaattcaaagtactattttttcactgtgttaaacagtgtaaaagataggggcactccggactgtgaaaatgatgaccactgctgcaaacttggtggaaccttagaaaacctcaataagcaatatttagactctttgagtcattgctatttaaatgataatcagattatctacagatttcaatggcaacacattgtagaactaaataagtagatggcattgtttatagctttcttaatttcagttaaaatggtcacctgactgttgttcgctaacatagagcaactgtgaccaaaagcttatctaagtaaagtaatccccccatccacagtgtcccttttcatggtttcaattacccatgatcaaccatagtctgaaaatactaaggtatggtattttgagagagagcgagaaggaggccacattcacgtaacttttattacactatattgttataattgttctgttactattagtattgttgttaatctcttactgtgcctgatttgttaagttaaactttctcacagttatatatgtataggaaaaaaaacagtatatgagggttcagtgctatctgcagtgttaggaatctactgagagtcttggagcatatgccctgtggataaaagaggctactatatatgctttaaagttttccctcctgaggaaccagggggcatttttgaaaaacaggagatgcagggggggaggtttgtttacttttacttagcctatctcttatatgcaatctttaggaagaagaatgtgatttttcccctcatatttgtattgatgtgactgttcatatgaaaaagaacatggagaactttaagattataactcagctgttagcatttatattttggactatgtatgctttctattttttcttattctttcacaataatagtggtaattattatctctatttttttttttttttttttttgagatggagtttcgctcttgttgcccaggctggactgcgatggcgcgatctcggctcactgcaacctccgcctcccaggttcaagcagttctcctgcttcagcctcccgagtagctgagattacagacatgcgccaccaagcccagctaattttttctatttttactagagatgaggtttctccatgttggtcaggctggtctcgaactcctgacctcagtgatccatctgcctcagcttcccaaagtgctgggattataggcgtgagccgctgcacccggcttttttttttttttgccaaaagcaaagaattttttatatatgatcttagttaattccttttttttttttttttttttttgaagcggagtctcactgtcttgcccaggctggagtgcaatggtgagatcgtggctcactgcaacctccacctcccgggttcaagtgattctcctgcctcaacctcctttggtagctgggattacgggcacctgccaccacgctcagctaatttttgtattattagtagaggcgaggtttcaccatgttggttaggctggtctcgaactactgacctcaggtgatccacccgccttggcctcccagagtgctgggattacaggcgtgagccactgcacccggcctatcttagttaattcttgtaggtacccttttaggtaatgatccttattttcattttgcagatgaaaaaccgaaggccttgagagcttaagttactcatctaaggtcacacaaatagtacattcattgcagagcctaaattttaacccatgtttatctttctaaagtttatgctatttctggccctgcccccattttgatgacaggtattacattaagtataatataaagaatacagaccttactattaaactttttctttttttttttttttcacttagtcaaaatttatttgaaggcctgaagacatttagttaactttttctttacataaactctgccttcccccaccaagtctctgtaacccacctttggccaaacccttgagaaatgtctactaattgtcttggagcctttggttcctctggggtaagcacagaattgattaatttgactatctgatgcattttggcttcccaaaattttatcttattaactgcactcccaggctggagtacagtggcgccatcatggctcactgcaacctccgcctcctgggttcaagcaattctactgtctcagcctcccaagtaagtgggactacaggcacatgccaccatgcccagctaatttttgtatttttagtagagacggggttttgccatattggccaggctggtctggaactcctgacctcatgtgatccacccgcctcggcctcccaaagtgctgggattacaggtgggagccaccgtgccaggcctagaaaattattcttgaatgaagctggatagtgtagttgatttaattgataatgataataatgaagtttcaagtgaggaagactataagtaaagagaagaaatagatatgtctttttatgcttttttaaagtatgccctgttggtttagcattgacttgactttcacaggaaatgtggagtgaaaactacaaacattttcattactaaacaactattaaaatatggatggcttgtttttggttcttttgttagctggtttcaggtatccctagttctgtcttccgcaggccacctttcttaagttgagataggttttcctgttcagtaataacagtctgtttataatagcatttctgatgactacttctaacataggactcccatttcttctccaggctggcctcattgtgataaaggattcaatgttgtaatcactggtttacatttcattgccattcctgattgaaggatcagagtccatggcctgccttattgatccatttgctagagatcagtggggtaacgggaattattttcctctttagactgcattctgatcttggctactattgcattcatgaagaaggagggagatgaaaaattaggcattctaactggtaaatacttgatgttttcttttgtttctgagagtagttagacccttgcaaatcttttctgtttgtaaggatttaaaataatgtttagcatatagtgctgggtgtgtttgtagatggcattaggactgtgacttacagcacatatttagggtttttttttttgagatggagtctcgtccgtctcatcctgtctcccagtctggagtgcaatagcgcgatctcggctcactgtgacctccgtctcctgagttgaagcgaatctcctgcctcagcctcccgagtagctgggattacaggtgtgcgccaccacacctggctaattttttgtatctttagtagagatggggtttcaccatgttggccaggctggtcttgatctcctgacctcatgatccacccgcctcggccttccacagtgctgggattacaggcgtgagccactgcatccggccacatatttagttttgatccttctctgagttgctttgcttcctgtaatttaaatgtgtctaatttattaaagcataagtatacaggcagttttaaaaattgtagtaaacacttcttattttccttttaatcttctctaattttcttttaataaatcttcgagttcttaaaagttttttaaagaaacataaatgtttaatagttatttaacgtttctcaaatatatacaggaaactggaattaacagaactcatttatggttgaaatcttgttttgcagaaaataaatcattacttctgggtcaagatggtagatagatgctttcatttgcctcacatctcttacaagactcccctgaaataacagtatagaagtacaaaaaataaatcagcaatagcaaatagaaaaaggtgaaatgtagcactaatatacaagagagttattaaatttctggaaaagctaaaacaaatgagaaccaatagttggatgaaatgaagaataagcagatgcctgttggtgaatacaaggaggctgcttgctagtgttatggaagccagtctgtccagggggaacccatgggagctctctgagcaaaaatgaaagagacagaaaacagaggaattcagtgtttatttaggggataactcagttacctggcattgccaaaccctttccaaccccttcccagtggcagtagtcagcaagtactatgccatcccctttctctagcattaacaaaggaaaaacaaggccggatgcggtggctcatgcctgtaatctcagcactttgggaggccgaggcgggcggatcacctgaggtcaggtggagaccagcctggccaacatggtgaaaccctgtctctactaaaaatgcaaaaattagccaggcgtggtggcaggtgcctataatcccagctacttgggaggctgaggcaggagaatcacttgaacccggaggtggaagttgcagtgagctaggattgtgccactgcactccagcctgggcgacagagtgagactcactctcaaaaaaaaaaaaaaagacaacccaaaggaaaaacaaaacataaaacagtgtttgtctccaaagaagttgatcagaatgtttggggaaatttaattttgtgtgtgtgttagatattggcacctcttcctttagtctcatatttagggggatggagagggagggcattctgcactttgctagtggcttacactaacacaaagcctgccagtgacatgctcttctctgtcttatactgagttcccattagaattttaattccaaagagagatgtaatcagaaagcaaattcacagaggaaactcatactagctaacaagtccttttacctgggttaccagtacgtgaggatcattagaagtcttagaggaacttttagcatgaaagagaccagaaaaaacaaaaagaaaacctgaacctaggggcaaaagataatgcaggaaacagaagagaactttaaaggaatcttctaactaaaatactcataaatactcatttataaaaccaatactaggtataatgaagagcaaacaattagagaatgcaaaaggagatttagaacattattgtcaatggaaagcacacagtagaaggatagccaaatagagttggagatgctcccaaaaagtagaggtttaattcaccaaaatggaaaatacaagacacaagtcatagactctgttcttagctagtgttctctagaaaacaacctgaaacaaaaaccttacccactaacactttattggggagtaccatctcaggaaagcaggagggaaagaagagtgagacaaggcagaaaggctggccctctctttgtaataggccttgctgattgcttggttttactggaagtcttcaggaaggttgtgtagagctattgcttctctgtcctttccatccaaagaaggtgtgaagaggtgtttatggtttcctcccatttcctgctcctcccccttttggtcaaagtttgccatacaaacagttaactcacttgaccccttccttcagcggcctcaggagaggaggccaggtcctacagtcctatgggtagatcaggtgtgtactgagtatgtgttgccaaagcttgggggtggtcagagcagtcagtaatccctaatggcagcctctggcctgggaacctctgccttttagggaactattaaaagaaggtcagtcctcaaaggactgacagagtgaaggataggatactactgctttttttttttttttttttttttttttttggagacggagtctcactctgtcccccaggctggagtgcagtggcgcaatctcggctcactgcaacgtccacctccacctcccaggttcaagcagttctcctgcctcagcctcccaagtagctgggattgcaggtgtcctccactacaccccactaatatttttagtagagacggggtttcgccatgttggccaggctggtctcgaactcctgacctcaggtgatccgcccaccttggcctcccaaagtgctgggattacaggtgtgagccaacacgcctggccaggctactgctgcttttaatcataagctcttcttacctatttgatttgctatcatgtgcatgtgttaatttgataaagataaaaaataaaatttaaaaagaaaaaatgaattaccaaaaacactctggaaataactatcaaagatattttagaatgcatttagaaaacagaatgaacttcaaatatgaaaaaatagaatctaattagtttatatcaggaacatcttggactgctagaattgatcctttctcctttcccactctttcttgctcactccttgttagcctacagtaccctggggttgaaatctagtagtcttcttctccttcatacccgttgccaggttctgccaagtctgcctttggattgtcattgctcaggccccccagtctatatctcgctgtggctattgtatgtagttcatagctttagtgtaagtcccttcaaagtttgtggtatccttctaatgaatctccttgtcttccctacctcatatcacctttgtttcctgatgctgagtgttggtcacttcctgtaccaccatatcatttttgttataacagaactttgtgtttgcttatatactctactgggttgaaacatcttttatttctttaataaatacttattgagagattttaaggcagccactgggatacaaagatgaattagatctggacaattacctgccttcaaagagttcatgttctgtaaagacaatacatatgtaagcaaataattgtaattgaatataagtaccataatagagttaagtattaggttggggagggtaggaggaaggaatgattttccccctttttgagtgaattagaaacctctagagaggagtagatgcccaaatacctattaaagattgtgtatgtattagcccaatgagtagaaaggagaaaagctttctaagcagaaagaatactatgtgcaaagaaactggaaggtgaaacagtacgtggtgttttcagcattcgacacacattagattaccacctgcaccaaaccctcttcatctcagctgaattatcagggtcgcctcccaacagggctccctgcctttgcctttgccgagtggtacatttaaaacctaattctgaccacatcacttctctgctcagaactctcagtggagtgtaaaagctaacctccctgcagtggctgtaagctttacaggatttctatcaacgtccctctttccccactgctacctttctcgcttcatctcctgccactctgttccatgcttactccagtctgatcacataggtctccaaggcctccatgttcctagttcttagaatgagctgcttgtatttttgcctgtgggactttgcatttgtgttccctttgtctggagtcttcttccatccagatacacgtatagcttgttgccttagtttctaaaaaattatgatcagtgttaccttgctagaccagccttagaaaatagaaattctctgtctctccagcccaataccccgataccctcctcttattttttctctgtagcataccatctgtttattgttttacttgccaatttattatttgtctcttcctactagaatgtaaactccataagggcagggactttgtctttttaatcatcgttgtttcatcagcagctagaacagaatatctgatgaatgatagatactcaataaatatttgatggcaagagttgaagctgaatagatgaagtgtgcaaggggcatgacttccatgcaaaggtatttggacttgagactgtaaacattggcagtctaggattttaagaagaagataaattaactatcagatttaggttttattttagaaagatcattctggcaggtgcttggagagttcattaggttgaggttaagttaaaataaagcagaactctttaaaaaccaaaaaaaatgttatttagatagcctaggtgagagcaatggctcatttttcttttaatttcccatagtacataatgtggactcccacatatagccttatatgtatcttaatagaatgattatttatattgtggtaaggtccctggcagagttggtaaagctattgagagaatggttcctatcttttttttatagacttatactgcagaagcaggtattcaattacctggttaattcaattaccaggcattttctaaagggcacttcctatatgctcatcatcacttcatttggtgaggaagctatgatgaagacgtttatgattcagtccctggttgacttagggactttacttgttaaatgattaaagaatatataagccaccatgtaaccatggttgtagacaaaatgtgttttgttctgggaaagggatagggaaaatttttctctgttactatatgtatatcatgtgaattttctattttaaagaggtagactacaacagaatacccaacaaaatttataaagcataattaaatattttgtaattcagaagacactctactactttgccagtgttttatttggaacctgagtgacatctatttctttgttttgttttttccttagagacatggtctctctctgttgctcaggatggagtacagtggtgtgatctaggctcactgcatcctcaaactcctgggctcaagtggtcctctcacctcagccccctgagtaggtagtactacaggtgcatgccaccacacctggctatttaaaaaaattttttttgtagagatagggtctcgctatgttgcccaggctggtcttgaactcctggcctcaagcagtcctcccaccccggccttccaaagtgctgggattacaggtgtgagcaatgccacctggcctatttttaaggctattccagtttagcatatggaagatgcaaacttaattgtccatgatgacaaaataataaattaatttagattgtagtgaaaagtttggttgagaaaaagaataattttccatggattgtgtaaatccattggaatagaatatttacattgaatagaacagacagttaactattaattgtaagggccttccatttccaaagaagcaggtagctgaaccagagtagttcttgctgtctgttgttgccagtggaagacatgattcatgaatgtttgaggttctaaatacttgtttaaggagaaatagaggaaagagcttttaagaggttggaaatattaagactattacagggtttgttgcttttcacctaatagactataggtttgaatgactttgttctgaaatatttattttcctgtttaaatattcattgctgtgagatttcaaaactcagcctcaagggaaagaccggactggcttttccctctgagtaattcagaagaggggtgtgtgtgtgtgtgtgtgtgtgtgtgtgtgtgtgttgacaagtgatttggaggcaagtttacaatattcttgttggccaagcctgtaactgcccttaaatttacatataccagcttgtgtcatttattggtattctaagcaaggatttatattgtattgcctggttttttaaaaatttattttattaattgtctgtttataagagctcaagattgtactggtcgtgttcctgaattccaacgcccccttacatgactgcagcacactcatcttttggtcctgattctttagttatacccacgctaaaagaaggatccattgtgaggcctacatttcagtagatttgcactttagaaaacaactagtgtttattctcttagctgcaggttccatataagaaggtaaccctctacttttaggaaacttacatttatagccactgttgccttcctctcatcatctatgctctctttttatttatttatttatttatttatttatttattttgagacaaagtcttactctgttgtccaggctggagtgcagtggcgcgatcttggctcactgcaacctctgcctccgatgttcaagtgattctcgtgcttcagcctcccaggtagctgggattacagacgtgcaccatcacacctggctgtttttgtatttttagtagagatggagtttcaccacgttggccaggctggtcttgaactcctgacctcatgtgatctgcatgcctcagcctcccaaggtgctggaattaccttgggagccatggggcctagcctctatgccctctttaatctcttaactgactctgttcttctaaaggtgtagatgcttcaggacatgtcctggaggcatgctgtaaccataattctctcccattttgccagccaaagcctctaagtcagtgtttctcagaatgtgggacccaaaccatctacaccagtaagtaccagggtcctgttccaacccactgaatcctaatctatggggaaaggatcttgacatgtgcatttttaaatatgttccctgaatgggtgttatacgcaataaaatatggtcatctttgctttcaaagaacaaggtaaaagatgagttggtaggtgtgaggagctgggttgtatggaagtagtttcttactgcatcttactgttgagactgaagcaggaatgggtgtgtctgaactccttacccgaaattagacatttttttcttaaactaatacttcaatggcgattggtttttattacagtaatccttattatataatcattgaatctgtttccatgagcttccttgggatcttggccattcagtaagttccagacaaccaagtgaaaagcgaactcttagaattcaacctgaaggtaaatatttggagactacatggagatttcattgtatagatttttcctctcaacatcacatttacctacaagttgcctaacatcttatggctctgagtgtagttcagatgtattgtaaaagagaaaatgtattacttttacctaacttaccagaaatgtattcaggattattagacacttaacacttttgtctgctctgggtgctcaaaattgtgaaactttcttgaggtgagaaaagcaaaacaattctaccctacagctctcctctaggttatggtagtttaaaaaaaaagttaagaacagttcaatagcttggttgtctttagacttaaaaacaaaacaaaacaaaacaaaaaacgagaatattttagatactgaaggaaggagatttgggatttaagtatttgtgtaagttaagaatctagagtaattttgctttaagtcttgcaaatgagcattgttttgtctttgtatgtgtttatctgatttatttatctggattttcctggtctgttcttctacagagttaatttttttaaaaaaacggatcctagatgattttaaatccagtgttgtcttcttatctttctgagagaacagttatatagctgttattttcctcttgtcacagacagctgggcagaagccactgcttttagtaccagatctgagaatgacaggcctttgcctaggtactctttttttttaaacaaaggcaaatagagtttgaaatctgagcccatctaagcaaatcccaagggatcaaaatgatataatttgtaaaaatacttaaaagtaaaaacattttatttgtattataatcctagaaaattaatttccatttataaatagcactagaaaaactattagtgacattgtcagtggtaataaactggtgagaatatgctctaccaaaataatgaagtgattcttttatgatggtgtgaataaaattaatattgatctgtttgtgtgcatgatccattctgaccatatatgtggtatgggaattgagaagcttttaggatttgcagcctgttgattagaagcaatacaatagcagtttatgtatataagtgggactcaaggtgaccaaactgagaaaattagaatgaagttgaggaataaatgagaagatataaacaaaaatacacccttctctctcaaagattacatagactttagttatcctagaaatatgaagacaattatattttgggtcatttctgtgttctcttacagtactgtgcataggttttaaataatattcagaataattcagtaggaacagaaaatatgctaaagaatcagtaacaaaacagtttcacctgctctctcaattaattttcacacccacctctgaagtaaacaacccatctggtaagtggtataattggaatttaaactcaagtctgacttttaggttcatgctttcttctgttttactacattccatgtaaactggggagaaggcacatggttggacctagaaaaaacactgaaagtcacctgtcggtaggtgatgattgaacctctgagattgctgtgggtaaggcaatagactgttgaatgggttcctgtttgacgactgtaatactatagttgtctgtccatagccacgggttctgcatctgtggattcaagtagctgcggattgaaaaattagggtgggaaattggatgactgtgtctgtactaaacatgtacagacattgtttctttttaggagacagggtctcccattgcccaggttggtctcaaactcctgagctcaagagatcctccctccttggcctcccaaagcattaggattacagctgtgagccactggcctgaccagactcttttttcttgacacttttttcttttcttttcttttttttttttttttttttttttttgagacagggttccactctgtcgcccaggctggaatgcagtgccataatcatagctcgccacagcctctatctcccaagctcaagtgatcctcttgtctcagcctcctgagcaactgggactacaggcacatgctaccatgcccagctaatttttaaaaattttttgtggagacaggatcccactatgttgcctaggttggtctcaaactcctgggctcaagtgatcctccctcctcagcctcccaaagatctggaattacaggcatgagccaccatgcagggccttgtcattattttctaaacactacagcataacaactatttacataacatttacattgtactaggtattataagtaatatagagatgatttaaagtacacaagaggatgtgtgtaagtaggttatatgcaaatactatgccattttatataaagggcttgagtatccaaggattttggcatctgtggtgggcgggggctgggaggttcctggaaccaattacctgcagatatgaagggacaactgtatgtttgaattcagaatgaaaacatttagcatatttcacattgtacaccaaaaggctgtatataatatgtatcgcctctgttactatctgtggtttaaaagagaaagacatcattctcaactcagaaattaatagttacatttgattttcactcacagctggtcaacaactcttaaagcctgtgtttgtaagacagaaggaaattaagtgcataaagcacaagcatgtaaatgttgattctttgctttcctaatgcttccccacttctactttcccatccctgcactccagtttgatatcaacccaagataccaacacttgtttcactctgtgttatcccttgttatgctctctagcccaacaaagcagtttgctgtaatgtgcacacacctgactttctatctcagtcttcctctatttcataaatgtttaacacttcatatttattatgtacgatgtgggattctacattgtacaggactgtctccacccatcataatgagccttttaatctaataggggagttaaaatacatatttacgtttgctaagtatgaggctttagatttcaatgtcttataggggatgcaagctaaatgttataagaatataggaaaggaaggaattacttttaactggaaacagaagaaagtttataaattgctaggttagggaaaagagctattctgtctagccttgtggactaaagagaaagctagtaatttcttttctcagatgagatatacttaagcagcttagcctctggtaatagaaacaaaacatttttatataagtatagaggtaaattcatacctagaaatactcatgtgaactgttatctcatagtttgctgaaggctgttgtacttctcttctgagcatagaactttggaatatggcctggaaatttaatacaaatctgaaaccatttgacatttttaataatgtatacttggggaaatattcagacattgcatgctatatgagagaaaatgttaaatcactcctatcccaatttcattcccttaatatataaacaattgttgttacatttttaacaaaaattttaaaagaaatttctgtaagtaacaaaataatccactaagaatttcttcttgacctcttaagggaggtacataacccctctaggaaaacagagcctctgcctggcttgcatttctgtaaaacgcctagtgcctaggctacaagtggattgcaggaaatgtttttacctttctccccatctcccactgctaattgatgtgtttattcagttatctgagtcagccctgttgagaataacgctgtgagagaattcatactgtgtacttgtgtgccagagtctcattcccagcaggctggggtggagaatggaggctggagtaaaacgaggaggctgaaaggagcagtgtcagagcaggagaaagtcgccttggccttgttaatcctaacttgaaaactctatcttttagcttttaccaattatttagtagaactttcttatggattcctgtgagattatatttatgcctgatgtgggcataagacctttggtgctcttattgtgtttcattcaccagtccacctgaattccaattcaattctttttcatgtctgtcttcaggccagtagattcagcgagggcttctgaagcagtatgtttcatatggctagagagagacagagagatagagcattgaataatttgaaggggaagggagataactattttatatctctcgtcagatgcccagaatagctataaagacatcataaaaactatcctaacctagaaataacgtaaagaagttatatggtgatgggtgacgaagatagactttttccaaaaaaatttaaagttttcataacatattttctaagaactaaagagaggggtttttttttttttctatcttttgagatggagtctcactcactctgttgcccgggctagagtttaatggcagcgatgtcagttcactgcaatgtcctcctcctgagttcaagcgattctcctgcctcagcttccaagatatctgagattaaaggcatttggcaccatgcttggctaatttttgtatttttaatagggatggagtttcaccatgttggccaggctggtattgaactcctgacctcaagtgatctgcccgcctcagcctcacaaggtgctgggattacagaagtgagccaccacacccagccttttttttttttttttttcccttaagagacgtggtctttctgttgcccaggctagggtgatgcaatcatggctcactgcagcctccagctcctgggctcaagcagtcctcctttctcagcctcacaagtagctgggactacacataccaccatgcccagctaattttttaaagtttttctagagacagggtctctttgtgttggccaggctgatcttgaactcctagccgcaggcagtcctcccatctcagcctcccaaagtgctgggattacaagggcatgaaccattatgtccaatagcaggaaaatttttatgtaaagcaatttatttttatttttattattaatttctgttacagaatcttcattcctgcctttaccagtttgcaagggctgccataagaaagtattacataacaatatagcaatgtattttcttaccattctggaggctagaagtgcaagatcagggtgtcagcagggttggtttcttctgatgtcttttttgttggcttgtagatggtcatgctctgtgtcttcacatgggcctccctctgtatgtgtctgtatccacattcccttttcttataaggacaccactccaattggattaaggcccaccctcatgacatcactttaattacctttttaaagaccttatctttaaaaacagtgacattttgaggtactgagggttagaacttcaacatacgggttggagactgagcacaactcagtctatgactctgccccttcccactgataactgtaatcagttcatcactttttatctagactgtggcagccccccacccccaattctctgccttttttctttcaccactattgtgtaaagcagtttttattaccaagtagaaatgattcttggacattggagacagctgaattttgaagttgtttaacttttaaatggaagagagttatgaatttttgtttcaaggtaggtcactaccattctcttaagagtaacacagtaattcagtgtttcagaatattggcttccccttattgatgatatattttttgtcattctctttagtattaaaaacaatatatttgtataggttttattacaaaagtaatatatgtttattattggggcacaaggaaacttttgggggttttggatatatgtgttgactatcttgattgtggtgatgatttcatgagaatataagtgcatatatcaaaacttaccaaattgtatactgtaaataaataagtgctgtttatcatatgacagttatatcataataaaactgcttaatttttttgctgatttgatgactaaagacttggacttactttgatgttaatgtgaattttcgtgacagttagtgaggttgagcatttttattagttgtttgtatttcattttcaatgaattgttcagatacacagtttgcctgtttttctcttgggatgtgtgtgtgtttgtgtgtacatgtgtgtctgtcttgtcaacttggttaacccactctgggactagtgataataacccagcatctctcttaccttttgctaatattttctcctagttgatttttcttttttgtttttcgtattttttagggacagagtctctctctgtggtataggctgtagtggcttgtggtccaaagtgggctctccacctacttttaatttaaaggaaagatttttgcccctttggcatctagtccacttaaatatggttgtgggcctgtctagtaactacacattaacaaaagtgagtgtgtgtgtgtgtgtgtgtgtgtgtgtgtgtgtgtctgtccacatacatatatctatgtgtgtatgtgtaataatattttctccaatcctggagcaataagcattccattttacctatgcagtgagagaatattcagagaattccatatactcactttaaaaatagttacgtaacaaggattcaaagtcactttttctttctcttgttgtttgttttagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacggtacgtggaccatgaggtgaaaaatggaaggatgcatggcaatcatatagaaattgtcgccttaattatacaattagaagactctcggaattaatttagcatttacacctgttctcatttacaccttctctcaacagcattgtatacattgtcctccctcctcctagaaatacttagtctcttggcttttcgagctctcccaattttcctgccaagcactgggtgttctgctcctgcctccttctctgttcaacttttaaatggtgcagtactccatatgtaggtcctggaaccccttttctttttattttatatcctttctctgcataattatactaccaaactcaagcaaaacctaggaatattctttctttctttctttcatctgtacatctaattgattagcaagtcttgacaaccataactctaaaactacttcgtcttcttctctacatcttattactcttccaccaaattgcttgtgtttgaatctcaatatggcccctactaaactgtgtgaccttggaccagttatttaatctctctgcccttggctcactctaaaatgaagataatagtacctacctgaagaggctgttaggaaatttaaaagaatttatcatcatcactgctctagtccaaacctcatcacttatttccggtattactgttgcctaacttatctatcctccacataggactaaggtggtttttttttttttttaatgcaaatgccgatttcctacttaactcttaatagttccctaatgcaattagaatataatctgaactccgtacttggtttactagtctctagccccagcttacctctttgacttcacctcttactactaacttgctaaagtaaaggaaatgtcataaattaataataggtatatatctcatacataccaacatatgggaaattgtattgtctcttgctttgttgtccaggctggagtgcagtggcatgaacatagctagctcactgcaacctcagtctcctgggctcaagtgatcctcctgcctcagcctcccatctagctgggactacaagcacacaccccacgcccagctcattttttaattttttttgtagagacagggtctccttttgttgttgtccaagcttattttgaactcctgtcactctatcctcctaccatggtctcccaaagtgctgggattagaggcatgagccaccatgcccagccttgtgtggtctatttctaaagatagaaatgttctacagtctgcatagaaagacctagctctgtcgttagatttctttttctctttcctatatctggttatgaaaaggagagctttactcagcctttaagccacttgctaaggatggatttaacccataaatgctttcaattttctttcatcaagtattgaaccaccaagaaattcctactttcgatgtttattagttatgtataagcacataattttatacttcagaaataattggctacaatagataatttaagagtctaggcttgataggtaacaaacgagactttcagtagcatttgttctagaatcataaacgtacaggctgatgtattgactgcatttccaaataactttttaatgatcatgaactcacagacctatcagaataactgtttcaattaaagaagtgaaaaagaagaaataaaatatatgtgaggattttccaaggtgttttaattaataaatttctatactaattatcagggtttttttttcatttttattctctgtttcttgttagtttgggtaatttgtgtctttttagcaatttgcttcatataaattgtcaattttgttggtataaagttattcataatttcatataatcgttttaatttttgtagggtctgtggtgatatccctgtttatattcttgatttggcaatttgtgtcttctctctttttttattggtcagtctagctaaggtttattaattttgcagatttttccaggaaaccaactttttttttcattgatttttgttgtttttctattttatttttcattagtttccactctgttattatttctttcttctacttgctttgggtttgatttggtctttattttgccagcctcttgagttgcaagcttaggtgattgattttagattttcttcctttttgtgtttaaaactgtaaacacagaaagtttccctttagctgcataccgtaaaatatgatctatattgtttttatttttttttcgttcgagacattttaaaaatttttcctgtggtttcttctttgctcctgggttgcataggagtatgttgtttcctttccaaatgtttggggatttcccccaaatttctttcttttattgatttataatttaatttctttggcgcttcacatgatctcaattttttttaatttattgagacttgttttatggtttactagacagtctttccaacaaaatattcttaaccaattggttttttcatcaatatgaaatgtccctctttgtctcttttactatttcttggcttatagttaaccaagaaatagtaaaactatttgtctgatattaatgtaatcacttcagccttctcatagttactgtttacatatttttttctgtcattttgtttcaactgctttgtatctgaagtatatctcttatttaacaaaatttaaaaaagaaagggccaggtggggtggctcacgcctgtaatcccaacactttgggaggccgaggcagctggatcatctgaggtcaggagtttcagaccagcctgaccaacatggtgaaaccctgtccttactaaaaatacaaaaattagccgggcgtggtggtgtgcgcctgtaatcccagctactcagaggctgaggtaggagaatcgcttgaactggggaggcggaggttgcagtgaactgagatcatgccactgcactccagcctggcccacagagtgagactccgtcccccactccccgaaaaaagtgcacagctagatcctgcttcttgcttcttcatccagtctgaaaatttctgtctttttattggagcatttggtcaatttgcatcttaatgtaattattaatgtaggtagatttatgtctgtcattttactgtctcatgccttttattgttcctttgttccttctttactgattcctgttaaataatttttgtaccttttacatccatttgtgatattttttctttagttattttttgtttgtgctggtgtttcttgtattttcttagtgctttctcaaggaattacatctttgacttatcacaacttattactaatggttgtgtgtgtgcacatgcatgtgtgtcttattctggttaaatatagcagcttaggtctaatatagcttcattccccacgcgcctttgtgctattgtcatacatattatacctgtatattttagatatataacaatacactattataattattactttaaacaatcttacgttgtttttttttttaagatctccttttttagagcagttttaggttcacagtaaactgagaagatagtacagacttatcccatatactttctgttcccacacatgcatggcctcccccactaacaacattgcacaccagagtggtacacctgttaccattgatgaacctgtattgatacatctttatcacctaaagtctgttagagtttactcttactggtgtacgttctgtgggtttggataaatgtatagcatatagccagcattatagcatcacaaaaagtaatttcactgtcctaaaaatcctctgtggtctgcttgtttatccctctctcctccccacaacccaacccctggcaaccactgatcttttaactatctgcatagtttttcctttttcaggatttcatgtagttgtaatcccacagtatgtagcttttttctgattggcttctttcacttagtaatatgcatttaagtttcctctgtgtcttttcaagtcctaatagttcatttctttttcagcactgaataataacccattggtctgtatgtaccacagtttgtttatccattgaccaatttaagggcatcttggttgcttccagattttggcagttatgaataaagctactgtaaacattcatatgcagggttttttgtggacttagttttgaacttcttggggtaaataccaagggccatgattgctggatcatatgataagagtatgtttaattttataagaaaccaccaaactacattccagagtggctctaccgttttgcatttccaccagcaatgaatgagagttcctgctgctccacatcctcgccagcatttggtgtctggattttggccattctaatagatatgtagttgtatctcattgttgttttagtttgcatttccctgatgacatatgacatggaatatccttccatgtggttatttgctatctttatatcttatttggtgaggtatctggtaaggtctttgtcttacttttttttttttttttttttttttgagacggagtctcgctctgtcgcccaggctggagtgcagtggcgcgatctcggctcactgcaagctccgcctcccgggttcacgccattctcctgcctcagcctcccgcatagctgggactacaggtgcccgccaccacgcccggctaattttttgtgttttttttagtagagacggggtttcactgtgttagccaggatggtctcgatctcctgacctcgtgatccgcccgcctcggcctcccaaagtgctgggattacaggcgtgagccaccgcgcccagcctttgtcttactttttaatcaggttgtttgttttcttattattagattttagaattctttgtatattttggataacagtccgttatcagataagtcttttccaagtattttctcccagtctgtggcttttttcagtttcttgacaggattcattttattttattttttgactatttttagtgatcttcatgtcttcctataggtccaagttattatgcagtgtcatttcctttcagtccaaaggacttcttttagtatttttttttaggcctgctggaaacaaatactgtttttgtttatctgggaatgttgtttttttatgtgttcagttttgaatgatagttttgttagctataggattcttggttgacagtttcttcctccaccccccagccctttaaatatgtcatcccatggaccactcccatgggagtcagctgattgtgatgagaagtcagctgttaaccctggtgttggtccccctgtaggtgatgagttgttcttctcttgctgatttcaagattttctgtttgtctttggctttgagccgtttctctatgatgtgtctaggagtggatctctttgtttttatcatacttgggttctcttgagattttgaaatatatattcatcaaatttgggatgtttttcaccataatttcttcaaatttttttttcctttcttctctcttcctgggcctctgattacacataattttcttttcccccgagatgaagtcttgctctgttgcccaggctggagtgcagtggtgcaatctcggctcagtacaacctctgcctcccaggttcgaccaattctcctgcctcagcctcccaagtagctgggattatgggcatgcaccaccatgcccagctcatttttgtatttttagtagagatggggtttcaccatgttggccaggctggtctcaaacacctgacctcatgatctgcctgcctcggcctcccaaagtgctgggattacaggcatgagccactgcgcccagccaacacataaattaaaatacttggtgttctcccataggggtttttgtttcttaaaaaaattcagtctgaacctaaacaaaatctgaagttctattcatttttcttggatcttttttccttctgttctttagattggataatttctggtggtctctttttcagttcactccttctttgttctgccatcccaaatctgctgttgagcccatctagtgattttttttctttcagttattatacttttcaactctggaatttccatttacatttttctactgagatttcttctcatatttttctttaatttttattattattttttgagatagggtctcactttgtcacccaggctggagtgcagaggtgtaatcacagctcactgcagccttgacctgctgggcgcaagtgatcttcctgcctcagcctcctgagtagctggtactacaggcacatgcaaccaaacccagctaatttttgtatttttttgtagaggcagggtctcgctatgttacccaggctagtcttgaactcctgggctcaaggagttctctcgcctcagctgcctaacatgctgggattacaggtgtgagacaccatgcccagccttaattttaaaaatatatttgtatttactgctttaacgttgtctgctaaatccaacatctgggccttagtctgtttctagttactgcttattttcttgaatctgggtcacttttctgtttctttgcatgcttgtaattttttaatgaaaattggacattttagtaatgcattgtagtgactgtggggtgttatttatttttctgtgatgggcatgtgtgtgtgtgtgtgtgtgtgtgtgtgtgtgttttaagtaatttgcccatacttaaactatgacatgtgactcccacacagtatacggccactagtgtttctgcttattgattttcatttgttgttttattgtttttagcctggctaggaggcacccgtgtcttcctagcttaatggttagcctgtgactagtgcagaggtggtgttcaaacacctgaagcttattgagctttcaccctctgatgatccaggttgattgggaagtgcatggaaagttcagccagttcttaagcctgccttgggttttctttctgttgagacctcttatgtctcccttcctcatccatgtagtttcacagccacccagggatgtgaggagaccatatctggcccttttgtgactcttttctttccaggatctccccttcagatttctagctggtcttccactgcaccctcttcagaccacagcctcaagctagaagaatgtcttctccctgttaggttcccaccaggttggccccttttagctgtcagagctatggattttctaccactccttcaatctcccccttgtcccaagtcagatctgccctctctggcagtgaaaattgctggtttttatggtcccagccctcacctgataaaactaagttttaaggcattaagtttgtgtctggatgctcttgcccctaagtttaagcaatttctcaggacatctatttattgtctgtctgccattgattgatttctagaatcctgaaatggctgtttttgacaactttgtccaactttcttactgtcatttccttttgaggaaacagttcactgacctgttcataccatcatagccagaagtctcttccctgaatcattgcatggcatttttaaattacttactacatatctcctcatcattgcccatttctgtttctcttttttcctttattgctaccattttcagttgtttcagatctccagttgtatatttctaatgacagtgattaagggcaagttctgttccttaatgtaaatatacatatatttacattatatatatagttaagacttgcattcctcatttataccagaaactgttcaccatgaaattttgtatgtcaaccaatttgagttcctaaagagataacccatatgtatagagtataagtttatcgctgccaaaaatagatgaagagaaaatggaaaatcctttgatttgtgcctgtgaacagagatagcacaagttctataatttcaggaagctgttaacaataaaatgagaaatttttaggatgctctggttgaaagatgctttttttttaagtgtacattttattttatttgatcttatttttgagaccgagtctcactgtgtcacccaggctggagtgcagtggcgtgatctcagctcactgcaacctcagcctcccaggttcaagcgattctcctgccttagcctcccgagtagctagggttacaggtgtctgccactatgcccagctaatttctgtatttttagtagagacgaggtttcaccatgttggccaggttggtctcgaactcctgacctcaagtgatccacccacctcagcctcccaaagtgctgggattgcaggtgtgagtcactctgcctggcccaaaagtgtacattttaaatgtgagggtgaattcactgctcataagccatttatttacttttggcggggggagggagagagagagagagagagagtgtgtgtgtgtgtgtgtgtatgtgttgtatatagagagtttgaacagttgagcaatacattgtaaaacctagatttgacaatatttaggttattttattaaacttactatctgcctatatgtctcttaaaatggtctatccagtttgattactcatcaattaaaaacaatggtctagtaattcatgtggccaattaaatctaaaagttagacaggaagcgttgttatttacagatttattaatgatacctcaaatttgtatctcacttttcagtttaaaaattgctttcacaaacaatattttattatggtttataaaatatccctttgggatatattagagtttttacagatggggaattctaagtccgtaatcttcgttctaccactccgactccccatattcaacgtagtgaaagaagatggtgtactgtgtatattcactagtcctcttagcaagcacttagtatcttttcccactcagtttaagtcttatctctgctgaaaagccttcctggacttttctaggcaaagccaaattcgtgtgtccttcatttaggctcaagtagaaccgtaagctgactgctgtttatgtaacatataaattgtgatttttaaattgacttttgtcttcctaagttttaaacttttaaagaaaaagtcatttttcatctttgcattccctgacttgtcacagtgcctgacacttaatagaactcagtaaatgcttcttgggggaaaaaaaaaaaactaggtacaattgtattatggcagttctgaggagagagaagctgaggcgtcttggtgaatacagcattgatctgggccttgtattaatggtaattagaattcgagtaagcatagatggtagtgggaagagttaagaacgtcagttctcaatacaaagttgaagtgatgagaaggatcaaaatgcctcgggataaaagcataggtttctacttgattgaagctttaggtgtttggcagagactagtgggaaataaggtggaataagtgtcagttgagtataaattgggaagagtatttgaatgccaggctgagaaatatggactttattaaagattttgagcaagtaaatgaagtgagcagaattgtgctcggagaagattgatctgtcacagcgtatgcagggtgaatagaggagcaggcagacgattaggaaacagtcttaagtggttatgtagagggggaatgaattcaggagacattatgaaggtagaatatagaggatttgacagctggttggatgagtaagataagaggtagcacaaagattgtgccatccttattgtaataattgtcttgaataaatcattttacctccaatttcagtttcctcatctatcaaatgaagtttatacttgacctgactgtacagggttgtagtgagaataaattaagaaatgctttggaaattacttgtttaaatagttacctaattaccttttttggggggtgggggaagggggtctttgaggtagggtctcactctgtcacccaggctggagtgcagtggcatggtctcagctcattgcagcctctgcctcccaggctcagatggtcctcctgcctcagccgccacgagtagctgggactacaggcgtgtacccccacacccggctaattttttttttattatttgtagagacagggtctccctgtgtcttgctctggctggtctggaactactgggctcaagcaattctcccacctcagcatcccagagtgctgggattacagaagtgagccaccacatccagccgaagtaattatttttaaccatcataagtcttttaagatcagttgtccctatttgtactgtttgttgctgtgagctacagctccatttaagtatatttcgcttatgttggatggtcttagattgttggagagaacaaaaagaaaagaacttgtacaaaaatgagaactgagcattaaaatctgaaatttttatttttaaaatgtgttttagaaatcgattttaaccttgggctagaagcttctgctcttaagatgagagcttattttgatagtcagttggtcccatactgtgcattagcaaaagaggtaagcagttaggggtctaccacctgggcctgcagacacttgatcatctctgggcctgcctgcagagaaaaaaggacctcagttcctgtatctttagatacttttctaaatggcagtgggtataaataaccaaagaatttgaagtagacaagctttagtgaatactcttcagatatgatgtttatatttgtgtacatattctaactacctgttggattgtattattcttaagggtaggaaataattctctctctgtttctgtcacctctattggtatattatggatacaaacacttactagcaagtgctttctagtggtggggaaggcttatagttgttctaaaggcgtataggtggtctaaggtgttagacatacgctattaaaaatactgagttaatacatcagtttaggtaacagaattcatttctccaacattcttccgtataatgtaaatacttttctttttcttagtttgatgtaattagaatcatttacttaggagacatagcatgttattgagtctttcacttaaatataaggttttcctaactggataattaggaaaataaaatacatttatttccccttatacactcttcaaacataatttagagctaccttcttttaaatcaaaatatcagtccttaaataattttttgaaatacatatataggggcaataactacttaatagtaacaacaaaactaatatatttgagtgcctactttgtaccagatattgtttgaagcactttttatgtgttaactccattgagttaccatagccgccatgtgaaataggtatcgttattactcctcttttacagatgaagaaattgaggcttagagagattcaagattacttgtccaagatcacacaactaataaatgtcagtgtgaggatttaaatacaggttatctggccccaagagcctgcattatttcccataaattatattgaacaactgttttatatatacttgtcatgtgcacattactgtgctaggcactaggtgttcttaaaaaggtaaaataaagcccctgccctcaatgaacctatagaagttccagtagaaaaacagtacaggcctggtgcagtggctcatgcctgtaatcccagcactttgggaggccgaggcaggtggatcacctgaggctgggagttcaagaccagcctaaccaacatggtgaaaccctgcctctactaaaaatacaaaattagccaggcgtggtggtgcatgcctgtaatcccagctacttgggaggctgaggcaggagaatcgcttaaactcgggaggcagaggttgcagtgagtcaaaatcgtgccattgtactccagcctgggcaacaagagggaaactcagtctcaaaaaaacaagaaaagaaaaacaaagtacagataagtgctagaaagagagtaatgaagcgggttcattaagagatgcttttagaaggtaggtactacttctcctaaacagtgaacccatagcctgcagtgaagtagaggacattgcaggcagggacaatcctttgcagcagtaattttccctgtgtggtccacagatcactggcagttccctaaattttttcagagtctgggtcgagggagctatgaagtcaatgcaaggtattattttcatagtaataccaatacattcttgctgttttcactatatttgctttgacggtcagtacagaagcaatggtgggtaaaactgctagcaccttagcatgaatcaaggccgtggcaccaaactgtgctgctggcagccatcatattcttcactgtcacagactcacaggaaaacaaaaaaatcacgttcacttaagaatgtccttgatgaagcagtaaaaagtattaattttattaatttcccacattagtatatgatatttttcatattctacatggcaaagtgaaaagtattcataaagcacttgtgttacataccaaaatattttcattgtttcaaggaaaagtactgtgtgattgagttgcaagctgaactagctgcttttttcatggagcaccatttttttcttgtaagaacaattaatggacaaaccataatattcagttttatgcatctggcactcaaatatattagttttgttgttactattaagtagttattgcccctatatatgtatttcaaaaaattatttaaggactgatattttgatttaaaagaaggtagctctaaattatgtttgaagagtgtataaggggaaataaatgtattttattttcctaattatccagttaggaaaaccttatatttaagtgaaagactcaataacatgctatgtctcctaagtaaatgattctaattacatcaaactaagaaaaagaaagaaagtatttacattatacaccattttcttgaaaatgaagtgggcctgccacttcaagggaagaaactgacactatttttttccattggtaaaatgtaagctctcctggtagaaattagaattttgaaaaatttgtgtcctccactatgagctcgacagtttctcagtacttaaagattttttctgatgagatccgtgatgatagtaacaaatgtggtcttgtataatgcaatgtcctcacatttgaaagagctccgtaactcagtaagccgatattttacaaataatgactgaggtttaatgttacaaaatcatgagtaaaagattcatgcaaagtgcatgattgtccagtggattttagtgtaataacatatgaaaagttcactgataaggtttcagattcgacattgcagttaacttttaagaaagtaccacttgtcaagttttgatgtattatcaaagaagactccacagttttctgagaaggctattgaaatacttttcccttttctagctatctgtgaggccagatttttctttgtatacttaagttaaaataacatactgtaatagtaaatccatacattaaaaggagtgccagtcttctaagtaaatttattacgttttggaaaatgtagttaattttctttaaaatatgttatttacattaacacataattggcttattatttaaaattaatttttaaatactttaaaaatttatcagcttcaatttctaatgccataaataacaatggatattacctaaagaaacaaaaagctctctgaatcctcagtcatgtttaagagttaaaagggtttcccacatggaggtggggatgtaaatagaagattcttttctttgtaggccaggcacagtggatcatacctgtaatctcagcacttagggaggctgaggtgggaggatcacttgagtccaggagttagagactagcctgggtaacaaggcaagaccccattgctaaacattaaaaaataaaaattaagaagtttttttaagttgacaagattgtatgtatttatactgttgtacagcatgatgttttgcttacagtatctttagttggaacagaaggctctcttctgaagcaataatgctcaataagagaggctgataaagctaaattatagaggactttgaattcaaggccaaagaatttggaattttatactctaaagagctaagcatcctttgaaatatttgttggtgagttgaaagtagagatttgagcaaatagctgagtggcccactttattactatattagtcagctgtagattttataaccctcctcactggaaagcccctgttgaccattatgctcagaggattttttttttttttttttttttttttgcttttctacacaccccttctctggagtttaagccaatttttctttcacttctctattatcaattggtattgcccattgacttctttatctgataacagttgaaggtgccttgcagattagtgatgcactaaaacgtagccaagaaggtatagcccttaacagtgggatcatttgcccaaatgagtatttctagaacataatgggaagaaggggggccacagtctatcatactatgtattgttgggctatattaccttcagcccacagtgtaggtgtcattagcatgttctgtttccaggctagatgtagaggtcttggactacggaggaatttattcattcagccatccacttttccaagagtggctcttatttttccctcaaagtaataaaaggcagggtacattgagcctacataaaatatatatatcctgtatcaatttacccttaaaaataattacatctgtcctttagctccaaaattttgatgtctatgagtagtttggcagtttccaagctggatccataaggaagctatcacctggtttgagaatgtgagagttgccacagaaaaccaaatttagaattatgcatgggtatttttgaatagagaaaattgccctttggatcatataagactcaagacatcctttcagcacatgttaatattgctaactccatgactgttgcttcttctctttgcatgccttggtttatttacttacctacttactcctaatgcccaagggaaactaaactaaaaaattgctaggcgcgttaatgctgtgctccgctgccccttactgctctcacagcttagggcaaggatgatgaagtagtaaggattatttaggggcaatttttttaacctgtttacatttttcataaatactttatactacctcttgaaaatgagtaaactctgatcagaactgatgaagtttaaagctaaaaaacttttttttttttttgagacagagtcttactctgttacccaggctggagtgcagtggcgtgatctcggctcactgtaagttccgcctcccgggttcacgccattctcttgcctcagcctcctgagtagctgggaccacaggtgcccaccaccacgcctggctaattttttgtatttttagtagagactgggtttcaccatgttagccaggatggtcccgatctcctgaccttgtgatccacctgcctcagcctcccaaagtgctgggattacaggtgtgagccaccgcgcacggcctaaaaagcatttttaaaagcatcttcttttacagctgaggtcagtggtgttaagtgatttgagcaagttacagctagctggttacagagctgggccttaggaagtctgctgtcagtcaagtgcttttttcctgcttctccatgcaaatggtgatttaaaaaaaaaaagacatccatagagagtcttaaccatcttagcttctacttactcttcaacttttaacctaggactctagcttgagcatactaacaaatttctttcattctaaatgaacgttaaaataatcactcaggtataaagttttaaaaaattgaggtgatattctgtgtgcatgtcactatttatatgttacatataattttatacaattcttactcctgtttaaaaaaatgacttgctgtggtttttgtttcacagcgtgacactgataatcagtacatgatcatgttacatatacaaatgatgcctttcataattcctttttgtggcactttgacactctgagaaaatggaatcacatattttcagaagaaatggaattactcgtttattaaaaaaagttagcttacatttgaatgcccaaacaggattagactctcagaattcagcttgtcataacagtgttcaaatgcacagaagaaatgtttaagcatttctctttaaaataaatctaaaagtaattattcttaaatagggagttgctctaagtaaatgtaaattcacttttctgtgtctaaaaaattgttttggtggtgatatttgataaaataattttatattcaattgattataattgtcttatatattattttagcaccatgaagtacattgatttttcagtagctaagcatgtgggctaagattttacttttttgaaaaatattttatcatgttattgcgtttgtactctgtgagaaggaatgcatatgatctaattccaccaagttttaacccatcaggaactccatcgtaaacatttttattcattgatttatttatttttgagacagagtttcattcttgttgcccatgctagagtgtgatggcgtggtttcagctcactgcaatctctgccccccgggttcaagcgattctcctgcctcagcctccaagtagctggaattacaggcgcctgccaccacacctggctaatttctttctatttttagtagagatggggtttcaccacgttggccaggctggtctcgaactcctgacctcaggtgatccacccgccttggcctcccaaagtgctgggattacaggcgtgagccattgcacccggccccattagaaacattttcaaaatgcttagctaggcatggtggcatgcacctgtaatcccagcaacctgggaagcttaggcctgtaaatctcttgagcccaggagtttgagaccagcctgggcaacattgggagaccctgtctccaagaaaattaaaacaaaagtactttaagtgctaacaaatctggttgatgttctaacatggattgtagttcttgttttttgagatactatgcaatggcataatgaaaagtatcctggccaactttgtaaaatattgtaaggaaaaactgaaaattttaaagtgtttttatttttttaaaaaggctatattgtgtttagggagtgtgagcctgtaaatcaggttgcgctggttcagctctcagctccttctgttgactgaatgtgtaaccatgagagaattagaactccaatgctcattttccttatctgtaaaaatgatgataatagttccttccgcctacggttgtttgcaagattagatgagaaaatgaatatcaaatacttagtaggctatgatgtttccatttcaattcgttgaatattaaatatgtcataatcttattttattcaaatttaaatcatttagatttgaaatctgatataaaaagttaataatgtttcacttttgtgcaaattttgattcagtgtgaatctctgcaaatgaaaattttgttaatagttgcctaatttctttttctttttcttttcttttcttttcttttcttttcttttctttttttttttttttttttgagacggagtttcattctgtcacccaggctggactgcagtggcataatctcggctcactgcaacctccacctcccggttcaagcaattctcgtgccaaagcttcccaagtagctgggattacaggtgcccactgccacgcctacctaatttttgtatttttagtagagacagagtttcaccatgttggccaggctggtctcaaactcctaacctcaagtgatccacctgcctcagcctcctaaagtgctgggattacaggtgtgagcctccacacccagcaatagttgcctaatttgaaagctatttgaattgcatggtaattcacatggcagatgtactttgagcagttaatagaaatatctactgacctttgataggcttattcttgaatgacacatttttcagaactatgtcccttacactaaatgttgacttcataatactgtgaaaattacctatttgagtctatggaaagtattcatttacataccttatctgaagatcaccaccccctcccattcgaaataaatggagcccaaccaggagtgattgatatttttgttcttaaaactgtaatgtcttcagagagagtgcagtaggagatgaagctttatatgattggttttttgtatgtaaaataatgagagttacaagttaaactgtttctaattgtgaaatggattaatagtaatgttagatttaaatgtgggtttttttcttcatcaaaccaataatttgaaatgaatgtactttcagtctctttctaagtttcataagagttccaatcacattttgaatacaaaacataaatatttgtttacactcgtgcctgtatataatcattaaaccagttaaacatttttagtgttttaatatttaagggtttagaacctgacatcctaaaatattttcttcttttttttttttttgagacagagtttttgctctgttgcccaggctggagtgcaatggtgcgatctcggctcactgcaacctccatctcctgggttcaagtgattctcctgcctcagtctcccaagtagctgggattacaagcacccgccaccacgcctggctaatttttgtatttttagtggagacgaggtttcaccatgttggccaggctggtctcgaactcttgacctcaggtaatccacccacctcggcctcccaaagtgctaggattacaggcatgagccactgcgccaggcctacttttttcttttttaaaacttgtaattttttttctagcttgcttgtttccttgcttgctttttttgtgtgtgtgtgtgtttgttttttgttttgagacagggtcttgccttgtcgcccaggcaggagtgcagtgatatgatcatagctcactgcagccttgacctctcatgctcaattgatcctcccacctcagcctcccaagtagctgggagtacaggcttacgccatcattcctggctaatttttgtattttttgtagagatagggtttcaccagggttgttcaggctggtctcgaactcctgggcctcctagagtgctggaattaaagccagcctgggtgtgagccattgcacccagccaaaacttttaattatgaaattattttagattcacagtaaatttgcaaaaatatgcagaagatttctgcatacccttcacccagttcccctaatgttagcatcttacatagctatagtagaatgtttgaaactaggcaataagaaatactgaatactgatatagtgctattaggtaaaatataggccttattttaaatttcattttttccagtaatgtctttttctctattctgaatcccatactgtagttagttgccatgtctccttatcacaaatattttaataatcctcaccttatatctgaggtacttctaggctctaaagaacagaaaaaggaaaaaattttgtatttatggacttgccattagatgataaccacatctcatttcctacttcatctgcttattctcccttaaccttttgtgtttgcattggagaatgactataacgtaggcccttcttcacttgaaatataaaagttattttgaaagcaagcaatgtttcctagaatatacatgtcagctcaaaacaagcataggctatgttgccctattttgctgccttgattaaaacatgtacacacagtactataagattttattaaatagttactattagatccagttttgaatacatgagattaattttacttacaccacaaaaatttcaaaagttcagaaactggtgacatcagttagaagattggaagacttttttgaagaacctgacttgctcaagaagacttaaagaacaaattgcttacctaacaacttagaatgaaggaatcacaaagtcccccaagcctccactccacccactcagacttcccaaattttttagctacctgccacctaccccctcaactcttaagtcctgaatagacaaccaatgattactaggtaccaggaaagcccacaacttggaagatagataacaaaaagaaaccaaaacaacaaccaccaccaccacgttacagggagtaggacctttcccccacaattacatttatatgctcagagagagaagaaattgtattaacaggaatgaaatgctagtttgggggatgggggttgagtttcagaaaaggaaaatgagtccttgaaattaaaaacatggcaacaaaatgaaaaactttatctggctgacttgaagatgaaactgaaaaaataaaggtctacatctttttctttttttttgagatggagtcttgctctgtggcctaggctagagtgcaatggtgcgatctcagctcattgcaacctctgcctcctgggttcaagcaattctcctgcttcagcctcccaggtagctgggattacaggcgcgcaccaccacgcccaactaatttttctatttttagtagaaacagggtttcaccatgctggccaggctggtcttgaactcgtgacctcaggtgatccacccacctcagcctcccaaagtgctgggattacaggtgtgagccgctctacctggcctacggtctcttatccacaattccaaaatcccaaaagttctgaaaattatatttttcataagtttacaacacaacctatttctatcctttatagattttgctaaagaaatatcactgtctcagatctcattgtatgtgggtgggatgaggggtgggtattacattatgggttatattctatattaactttctaaaattctaaaaattctgataagcatttggccgcaaaggtttcagataagagattaaggacctatatcccagaaaaatggagcaaaaaggcagagatgggaaatacaagagaagagatgtgaaaattagaggaccggtccagaagatccaataatacagcttcccgaaagaaaatgtgtagcgtgagaatcatcacccgataacacaagaaaacttccaggactgaggacattaattttcatcttgaaagagaccacagaattctccacaaagtaggtgaaaatgaaacaagtccacactgaggcatataactatggacactgttttagaacatcaggtgtatttggatagtcctacaagctgcaagagagaagaaaaaagtcacatacaaggagatgggaatcatgccttcagatttctcagcagcaaggctaaaagctagaagacaattgagagttatcttcaaaattctgaagggatttttttttccaacctataattctgtgaccagccaaactatcattaaactgggatggttaaatagatattttcagccatgaatcagattctcaaaaaatttactgtgctaaactgaatttcctattttgctttttttctctgttagcctcaaagagatgaaaataagaaatgaagacttctattgggggacgggggggaagaggaaaaataaatattgaagaaagtggataatccataaatcaaaatatttctgaattcattaagagattccttagtatctatatcagagtcgtatgtgtttaatcttaatctgatagacttggaaagttatacttaatcttgtgtcactcagaattccctttagattatgacagaacatttgttgacaatgtatagttaaaatatttccattgtatcatagaagagtcagaaaaatcaatcaatttcctagttagaagtattttaaaaatttgaagtcatcaaaaaaagaaaacatttgtagtcctcatttctaggatgagattctgagacttaaaattctagtttgctattaagtgtaattggtgccgacctcctgtgcagtgttgatggctagctcagctgcaccagggaagatgagttgtttgaagggtagatgtataggttttagccatatgattgcatcaggccagcactgccgctagtcctcactctaaactgtcggtgaacggactccatccagcctcttctgttttatgccttgcccagtggatacgttaggtcggataatgaccacaaaagggaaaaccacaaccttggaaagttgtttatatggtcagtaaaggtgctcagcagctagcaagagaaaataatgcagaccagtgctgttgtagactgagatttttcttagatcaattttaactgtccacttttcacaaagataagacttaaaaacttttatttccctttttctctctgatttatatatttcagcaattagtagtctgtattgggataaatttaaagtgagaatgtcccagttgtgagataagatctcatttaagtacgttaatatagtatgaccaatattttctattcctatttctactctgtacagaaaaccacttttaagtccctgtatcagtttagtagttctttggcttttttcctaattaaatgtcagcatccctttgctggttttcttttctctccctttcctttccctttctctgcatagcctgacctatttctctttcctcaaggtatagaacctagccaggcacagtggctcatgcctataattctagcactttgggaggctgaggcaggcagatcgcttgagctcaggagttcaaaccagcctggcaacatggcaaaaccccatttctacaaaaaatataaaaattagtcatgtgtagtggctcgcacctgtagtcccagctatttgggaggctaaggcaggaggatcagttgaacccagaaggtggaggttgcagcgagctgagattgccacactgcactccagcctgggcgacagagggagacccttactcaaaaaaatttaaaaaggtatagaacccatgtcacctctagtgtagccttccgtgtctcttacccatgcctgtctccactcccggagactcttgctgcatgagatgagagtcctaagaaggtaagagaggggtggggttcgtatgggttctcgtttctaatgagaagaagagaggatgggtacagtgctagaaaggaagtgatttcacatatgaaattgggctgcctagttttgaattcctagtctgctgcttactgtgtgaccttggacaactaactgaacatctctgcacttagcatcttcctctgtcagttggagataatggtagtacctgtttcacagagttattgtgagggttaaagaaaataatatatgtaaagtacaatataatggctaagaacatgcactccaggccaggcgctgtggctcacgcctgtaatcccagcactttgggaggcctagagttagaagtcaggatcctcgtgaccctttgccaggggaaccgtgactggtgggggccccccagggtgcttctggtatcttgtttcttgatctaatttggtggttacatgggtgtacgtttcattgtgaatattcagctctatgcttataatttatgtatttttatctatgtatgttaaacttcaatttaaaaattgcattagatcagaagtcttgagaatttaggaaatgataggtcacttttttctacatggcagatcgacttagaattaaagatttcatacttaaaaacaagggggacgggtgttcactacaagctgcaaaattaaccagtcttgcttctgatcttaaattgtgtcttcagagaagcaaagaactatgaagagctacagataagcaccttgggcaacatactttgaagtaatcattagttttcatttatcctgccacttcacatacactgtgacagattacatgggctacatataaagttatatgtaaaagtgtaatttggagtttgtggaatcagtctttttaactttcctcagagtgatacattgtcatcttgcagaccagatctggtggttttaaagtttgattgaagataaagtttcatgtgatccaactgtgagatgttaagaggcaagtttgaaggtgcttgaatgagcattagttgtaattgatgcttgttgctttgactgcgtgttggtttgcttgatgctgttttagtaacttagtgagtttcatctttaaatgggatttgtgttacttagtctgcattgtgccaagactgataattgaaaaccgtacactttcacagaacattgcttcatagctcttcccttttctgctatttttatatcacatgaatcattgcacatttaagccatctgcaaggcctgaatggaatgagataaaaagctgccatcacttaaattgacacttgaaaagctgttattcatttggagtttattcctgattatcctttatattttaaagtttcaaacttcatttcaagatggttgccaacatctctgagccagaagtatctctgattcacagcttcttttagcctgaaagtcaaagggaggggatgcatcctgtcacctagaagaatctgttggggactcacttctatctcatttgagagaataagaacagcaagttccactcctgttttaaaagtatgttggtttaatcagctcagcaagccatcgggtttggcatgcacttcatagggaatagtaaaaacacaaggctcttcgattgccagatgaatacttcaaaattgcatgcctagaatgtgtcacacctgttagatacttatcaaaaattttctcaacataacttttttgaggatttagtgaaaaaaataattagataaatgcatgctgggatgttgcaaaagagattcatgattaaaaatgcatattcagccgggtgtgatggtgcgtacctgtagtgccagccattcgggaggctgaggtgggaggatcacttgaacccaggaggttgaggctgcagtgagttttgatctcgctattatacttcagcctgggggacagagtgagacactgtctcaattgaaaaaaataataataaaataaaaataaataaatgcatgtccaccctttgcaagaggcctggagtgggatcgcgccctctgtggagtgggtcgccacctctgtcacggtcctcaaaccctgccaccgccctggcctaggagcctgccccaccgcagcggccggcaacgcagcaatctgccggcggtggtcgcggcccccgggccctctcacggcaaccagctgcgggcctcccggggcaaaagcccatgggccaccaccatggccctcaagatggtgaagggcatcatcgactgcatgttcgacaagaacctgcaggacttggtccgcggcttctaaaaccacaaggaggatgagattgaagaagaatggggatagtgaccaccaagcatctgtcttcattgaaggatgcccatgcagcccttgggcagtggaagccttagaaagtcttctacctgaatgactgcctgactgcctgcctgcctccctgcgtggacagcaaaggctggcctgaaggagagcagctgtctgataccgcaccactcccaataccagaggctatgtcgggcatgaggtgccaggagggcagggaggttaaggaatttgcctgcaggcacccagtcaccctcagcccatgtgcctctccgtgggaacctgagttcttgccttattgttacacttttccagaagtggtgtgacttcgcctgcctctggcctaatgagatcatttttgttcatctccatcccctttcccttggttttcagcatatcagaagctctccctaactgctttggtgacaatgtgtaactaacttatgtactcttcagattcttttgagttgaaggcatagctgattggcctggattttattttactgagcgtgattcaccagattggaaatgtggtttgcttcctgggaggactttttctgcacaggcaggatctcccagtgcccgtccctgcccgcttcagcgcatgtcactgagcagcctgttctggcatcctgaggacgggccacggggtctgtccagcagaggaccatgcattgtagtctagggtgtggttttcaggggggtgtgcctgtcttcactgggaagcccctgagcctggatttcttcctttggaattggtgtgagttgatagtgccttccttacaggcatgggcccattcaagcgggtattggtggtggaaacatttttagagtagtgtggggccgtccttgaaagttccaggcttccttgtgggccctgctattggccaatcagtgattccatgcaggacacgtggtgtctgggggccctggctttctcatcagaagaccatctttatggcccggaaggtcattattcaggtgttcacttctgattccggatgttctctgcagctgctggagtttcctgattggagaacagcaaatgactgttcaatgaccattctagtggtcaccccctccacgctgtgcccccccaaactcgcttttgaaaagcagctaccctgtagacctcatgttgtaggtttttcccacccaccacacccaaaatgcagactcttggcgtgtgctttttctgcagcagtatagtttcaaaaaaaagtttttattttgtaatatattttcacttaaaacttgagtgtggcatcatggaaacaaggcttagcaatgattttaaaagccacgtggaaaggcagcgtgattgagtggaaatcagatgaagtttgggagatctgagtccaggtgctccgactggcttaatggggtggcccacggagagctccctgttctgtctcctcctgtgtaacatgggaacatgggatgagttgcctccctccttgtggaatggtgctgaggatgctgcagcaaaaacgtggttttctggaagcaccagagtgctcaaagaggttgtttagttcactgttttccggtcctcaggctgtgacctcttagtgggttgtaaattcaatttaccgggttatggtagttaagaaaaaggaaaacaaactagaaaataacagagtgcaggcacatacagtagctgtcctgtcttgaaactttgatttctgcatgtgattcttgtgtgcatgtgtgagcgtattgggttaccatgcacaacccattaaaatgagtgcaaaaagtaaaaaattaaaaaataaataaataaataaatgcatacccacactcatttatactctttaactgtgggtatgtgcaaatcttgcatttttatgctaattagcagatgagtcagggtctctaaagccttttccaacagttagattctctcaatgcagtttgctctgggctgcagaaggttgggttcccctgtactaaagttagctggaattgcataagttagggaggagagtacagatttgtttcagagtaagaagcttcttggccaggcacggtggctcacgcctgtaatcccaacactttggaaggccaaggcgggcggatcacaaggtcaggagatcaagaccatcctagctaacagggtgaaaccccgtctctaccaaaaatacaaaaaattagacgggcgtggtggcaggcacctatcgtcccagctactcgggaggctgaggcaggagaatggcgtgaacccgggaagtggagcttgcagtgacccgagattgcaccactgcactcgagcctgggcgacagagcgagactctgtctccaaaaaaaagaagcttcttcagttgttgctaggtctttcctcttcataaataatatcattataatactttggcaacatagtagtagtaactctagagctaatagagggaatgaaatataaaaatatttccttatttcatttccttgagagagcctgagatcatagaccaaaaaatgaagtgacctccataactaagtacaacagactctattttcaaaatagaaatatcttaaaaatagaaagttctaagagtctaagaatgaaggaactatttttgtatcttcagatcctaatgtatctccatgtgatcttgggcaagtcacttagtacttccgtgttcgttagctcccattttgttagcatactataaatactcaaaacaccaacattttgtttgtagacggtagcatttagaacattaatagcatctttgtgttttgttgttgctgctgttgttgttgcttttgtctttgaagggactactgtgatttttgcttaaacataccctgtttggggatgattgctgtggggggataactttaattattttaaagtaattgtgtatatttttcattctttatttctttgcttagcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttggggtaagtctctgaagtctttttatggattttacaattaaagtagattttaatcccccagatgtgttattagtcattattactttaggattaaactacaaatagattgaaagaacctgaggtaaatcagtcttttcatcagtctttagaagcctttttctgtcatccagtctgctctagacatagtcttgcaggtggctgcacacataaggtggcgatatgacccagcttgctgtgactgaggggtttcttgtgatgtgagactttcagtgctgaaaccaggatggtcaccctactcacctaccaaactcagtaaacataccaataatatgcttagtttcatctgcaagaacaaacatgcacattcttttagagcaatgattcctaaacttgtttgcacactggaaattacctgggaagcttaaaaaatattgatgcctatgcctgacattctagggttgtgatttaattggcctggagtgtggcttgggctttggtatgtttacaaaatccccagctgatactaatgtgcacataagtttgggaaccattgcttattcatcctgtcgccttctttgttttttctttaccttccatataagtccagctcaatactgccttcctctcctcttatctccctcaactccaagaccaaagaaactaggttcagggatgcgttattgccactctctacttagctttgtaatgtctaaaaagattcacaatgtagagaatacaggtttagaggtggcttattgaagtggaaagagtatagattttggagtcaaagagcctgggttcaaattctattcgcatgtgaactttggaattcatgtaacctttttgaatttaaatatcatatttataaacatagagacagtaatgtctacctttcagagtgttataaattaaatgaaataacatttgtgaaaacagtacctcagtgttttgtttttataatacgttgttgctcatactgcacagtgtcaagaccaatatctaaaatcattgtagaggattggtttgctacctctgatgtattctttcaactgtttatttcctcctgaatcaccatcatgaaaaaaagttaaattgcaaagatttgagttgttgggaagttagtgaatggctgctaaggatcttaattttttctgagcctgcttgttattgctttttgaatttgaccaaactcttaacccagagataatcaatagtttttttgttttttttttttgtttgtttgttttcttttttaaattccactaggatagctgcctggtactttattagaaaagcagatgctcttctttaagtcttggttgtggccacttcacggtgacaagacactggggcaaaattctgtcatttatagctgactacttggatgtattttccgcactaaagagaaggccagagttgagatttaatgatgttcttgaagtatttgaagagcttttacacagaaaatggtaaccagatattttccattttttctgagaagagagcaacagaaaataaagggcagcataaaggacttgggttacgcagaagaaacttctcgggagcatgagttattaggttctctactgaattattagagcttatataaaatcttagtctctggaggtctgtgagaatggagtacattctcatctgccagaagtgtgttttctcttgagtcagagaaatagtgtccattgcagatctgcctaggccagttagtgacttcttgaaatgtattatgcccttctcataaggcataaagtgcaaaagaaataattttttccttaccagagatacctagttgctttattttcttccacattgtgactctctgttacttagaagaacagtaacgttggtaaagagcaggcatccatgctccatttcattagcttcataaacttgacaaatagcttcttttagcctcattcgtcttaaccataaaaggagtgtgatccttactccagaaggatattataagaatgcattagaaaatataaaacaaaacaaactccaaagcaccatacaaatcttagttttataggataagcataaatgccctcccatctaaaataaaacattttcctttttccgtgattcttctattaaaccaaaccaagatgtcttactgtagaaaacttgggttattaatacaagttttttgataaagatagtaggtgattcagtccaatggaacagcatgatttctgttttgctctttccatttttcagttttttttcacatttcccaaagtctggtttgaaacccaagtgaagtagataatcaggtatgactccaatactcagagggaaatataagccaaaaagatatctggaaattttctgcatataccttcaattcatttcatccaagcattgattaaaacagttttgtctctttttatatatactttccccctaaataatcattgtgttttgtgtaaccctctagtcagctatttagctacctaacagtagagtttaggcttcgtgtctttagtttttgtttgcttttctgaatgttaaaatgtttaaagaattaccaaagagagtggttatttaaaatattcttgatgttattgtagaaatattaaagtggtgaatagcatgtagcctatagaagtggtaacacagttatatattgattcggatagttgttcacaatctattgctaagttaaaaaataaaagcaatatatgctttggcaggctgaggcaggcagatcacatgaagtcaggagttcgagaccagcctggccaacacggtgaaaccccctctctactaaaaatacaaaaattagctggacgtggtggcaggcacctgtaatcacagctactcaagaggctgaggcaggagaatagcttgaatccaggaggcagaggttacagagagccaagatcgtgccactggactccagcctgggtgacagttcaagactccatctttttttttttttaaagcaaattatagaatgcatctgatgtctatagttacttatctctacatgcctgagggaaagcctggaatgctgtgtactaaagcattacgatgataggattgcagattatctttattttctgttttcccttttccttttgtttatattttctgctttttatatagtgaatatactttgcttgtgtaaaaaaaaggagggtaacagccttctatagtatattattctacttactaggatttgctttttaaatctgagactgttctaaaaactaagagatgtagttaggaaaattccaggttcttgtccacatgaagtatctaatgggctaacactgtgaataactttggacaacagcttccacacacacaggtggataaactgtcagctcagtgacgaggaaaaatcagaaactggtattggaacttactaacaaatacaaacatagaagttaaataagtagtttactgaagaagaaaaataaactattcccatttcagaagataacaaaatatgtggataaaaacctgaccataagtaaacgtttttatttttatctctgcagcagtttggcaaaatcctagatgtagaaataatctttaatgaacgtggctctaaggtaagctccatttcagtgtcaagtgtgcttgatttctttttgagttttatgttattttaaatagcaagtattcagaaaacataagctgttttcaagcctgcataaaagtatcctaattatccaccttggtttagattatctctaaaaataagctaccacatggccaaactttattctgatacttatatgggggtggaagggtgatgaagtaagaagcagagaaggttgagggaagagtgggacgtaaagaacacaggatgtaggagatgacagtgctttatgagccttaaattcggcctcagctttctccgtttaaaggaaaagtgcaaagactaaataaagtgaaattctatgagaattctattctgaattctatcagaacaattcaaccaaaatccaacttcaaaacagcatacttagaacaaatttaatgttttgattattcagttaacttgcagtctcttttgaaaattgtgacaagacttaaacagagtgagcaataactgaggaattcagtatgaactgatttccttaagttctacccacataggcaatcctcaggatgtagagtcacctaaatcacaaatacagtgagttagttttttttgcataagaatgaaagtagtaagtgtgtacttttacgtgtgtattttcctctaaatgtgttctatataagaactgaaatttttaattaaaatttatttcccctattaggctgggcgcagtggctcacgcctgtaatcccagcactttgggaggctgaggcgggcggatcacctgaggtcaggagttcgagaccagcctggccaacatggtgaaactctgtctctgctaaaaatacaaaaattagccaggcctggtggcacacgcctgtaatcccagctactcgggaggctgaggcaggagaatcacttgaacccaggaggcagaggttacagtgagccgagattgcgccactgcactccagcctgggtgacagagcaagactgtctcaaaaaaaaaaaaaaaattatttcccctatttactattttaaattcccaatctgtatgatttagaatttccatgcattaaaagaaacagcaatgtttttaagaacaagggaatggcaaagacttacagtggtgttgtgaaaaaaaaaaaaagtatttgatgaactgaatatttgcacatgttacttgagagttttctcactgcttattaaatgaaatacatcctactgaaaccatcagccatagccaagcctataaatatttaccttgctgttgctactttcatttgttaggttagagcaattttttagttaattttcatttggtcatctctgctgaactttgaaaatagcttttggctatggttaaatctcttaaacatgtaatttgagggaaagctaaataaagccaataaatgagctaatatttacctctccaatttcatactccaaattcaccatactttgggaattgataacagagtttatatacctcctgtccccatctgtacacttaaaaatgtatgtgctgttctaatgctacttattattattcccttcctttgtagaatgtatcaacactaaaagtgtttaatcctgactataacaattatttgttaactattaaaggggtaattatactctaagcttccagttttcagttaaaacaaaaatgattaatatgcctatacagaactttctccagcacttggtaagtattttttaaagtgaagtctattcagactgcaaccagtaaactatttatgcttataatttttctcacgatggatttctgttcctttgttgcattgtttgtgtttattttatgtgatcttttttagctacaaggtgggaaaatgacagtggtttagagataagaagcacatgaatgtaaaataaatatgtggagatttttggccactctgtaaactactatctgaagtagttttaaatatttttagttgttaagtgtatgtacttaaaatattcttaactagaatctaacaactagaaggccaatgtagtttcatcaggcattgaggacttactccttaccaagaaaataatttgtttgaattattgtgaagcaaaggaaattgatctttcttaaggcttctttcattgactttaaggatttgcctgctaccaattctttttcttttcttttcttttcttttttttttttttttttttgaggcagattctcgctctgttgcccaggctaaagttgcattggcacagtcttgactcactgcaacctccgcctcctgggttcaagcaattcttgtgcctcagcttcccgagtagctgggataacaggcgcacactaccacccctagctaatttttggtatttttagtacagacagagtttcaccatgttggccaggctggtctcaaactcctggtctcaagtgatctgcctgccttggcttcccacagtgctgggattacaggtgtgagccactgcatcctggccccacatttttttaaatttacctgatccaattacttctctcatgtaactcatttgaaagtaatgacatgagctttctctttgagaaatctaaaagcataggctgcttctgtcagcttgatgctgtgtcctcactgccccatttttctttgggctgctaaagggtgcacagactgtgtactaattggtaaatgttttaaaaacaaagcatagaattcagaattgccctgaatctgccttcaaggactgatacaaaaccttgtttttgtcctttgaagctttcttaactgctacctaaagttatttgctggaatgggtgcccttggaactgttctgaggctcctaatagagatttattttggaatcaaacccatggatgcctcctctgggatccacctaagagaaattaatgagcactttttgttttgtgaattaagtttagtttcttaatccttttatatgtttggggttgactgtaaaattacagcgtattttgaaaataaccagagaaaaggaggctttatatagtcctattgtttagctaagagttcctctaacttttaaacagagtgcttttctgtacagaaattagctttattgaatttttttagagcagtaatggaaaaactagtcacaaaataactctaagatagcaatacttaatgtaaaacagggtttaatcaaattgttccaaagcaaaaagcaactccataccatatcttattttgtataataagaccatcacccagggttttaggatatacccatttgaaaacataagtaaacggtgttccactgccatgctcatgccctccttgtctgccagtattcttctttttccagcttgcctttaaagtagaattactctatagtagttttttcttagttgttgactagttttttccttttttccttcttttgccttcatattctagatttggcttacttagattatagaatgaatatatatcatatttgtgcacacacgtgcatacatatatatttaaattatttcatgtgaattttagtctttttactccctaatcctttataaaaacatagaatcacctgtatctaagtttctttgattaactgaaacagagatagactaggcttttaaaaatgtactattaagatatatgatggaaagtggtattcctgccaaaaaattaactaatttattcatatagaacctagaaaattattatatgagtttatgtagctttgttaattctccagatttcaccagtaatgacagattattaacacaaataataagataatgcctagagtgaccatatttcctggcttatccaggctagcctcaatttacacctgttatcttagcataattattaataaatgacccctttctctctcagaatgtcccagtttgaatgataaactatttactctccttatatatgctttgggtaacatcttaaaaaagcagtctttgaaaaggaaaacatgatgcttaatgaaaagtataaagaaaaaaatacatagtttattaaagagaaatgtgcactagtgatattctcatgtatccttctagtcttattttctcatatagaaccttaaaacataacccaaaatggtcacctagttcagccccctgtattcttgaccttgcattctctgctagaaacttttagtgattaagaacttgttttattcaaaagttattccattgtgggtcagactttctaccatcttactcaccatcatccaaccacataacaatttttggtgataattatcaagcttattaaataaagaaatacacagattgtaacatttacattttctataagtttttgccaaaatactttggtatatcctctattgaatggatatgtattaaaatattgaatatgctgaagttgttcagctcttcagatagtgctcattattaagtctactaaaggactacaaatattatacagcccagcaataattatttagatttctagcaattttttttcttttttaaaaattgatagatattagatgtacatattttcagggtatatgtgataatctgatacattcatataatcaaatcagagtaattgggatagccatcaccttaaatatttatcttttctttatgctaggaacattctaattattctagcaaatgtttacttaatgtgttctcattacttctctcaggtagatttctggaataatggggatctaggtttaggttgggcttaagtttaggctgtagttaggggagataaaacttctattcccattccttagacacaagtaatttgctgtaatgttttccctattatcatggcttttaatttcatgcaaagggaaattatttatttctttcaaaatattatcaaaatacttttttggaagtcacagtaagtaggccttttgactttcagtaaaacttaataggtaatgtcaaagtgaaatggtttttattatatttaaaacagaattaacagtgcatgtgtttctgaagggcttagtttgttttttttttttcttttgttaccattatgggctttagttttatattttttttatttatttttaaatttctgtgttctggccatacccaggagatctgtctgcttttgatttctcccttaaaagttacatggtaaattttctttctcattcttctgagatcgaaaaattcaaaaattatacaaattttaataatatttttacaatgttcattctattgctagttatttattgcagtctgaggccagactaaaaaggtgacagttacttggctcctatatgtcctcgatgatgtaaaggcaggctgtgaaattgctgtcacactttgtagaagttttaactacaaccatacacctaataaatacaccattcttcaatttccagaagtcagctaagatacctggtaaatcactaatgtaacactggtgtgtttaaatgtttaatatagaagggctctgaggactgcaaacttagaggagtataaagtgtagagacctgcattgcccagcacagtggtcacatttagcacttgaaatttggagagtttaaacggaggtgtgcctgtaagggtaaaatggacaccagatttcagaattagcacaaaaaaagaatgttaagcatctcactaataatgttttaatattaataccatattgaaatgttaataatatgtgtttatattgggttaaataaaatacattgttaaaattaatctcacctgtttctactttttaaatgtggttattagaaaattttaaattatatatgtggtttgtattatatttctgtctgcagtgctagtgtagacaaacatgtcaaaatcattttttaattaaaaattaaagtttacttttttaaaatctgattttatgaatagaagtttagataacaaaaattctccatctgtttacatagctgaaatatttcctcttgttcagaatttgagattaaatctgtttgttacagattatataatctatttgttacatatattataccggtgtagactggttcagtgtttgataggttgtatgatcatttggaagctgttctaaggaaaatactttagatttagacataattttactgacttttttttccaaagcaagagatcagaatgaccaacttaatgtcaattcaatttctaagagtgaagtgacaaaacatgagttcatgtaagcagacttttctactgataacttttaaacctggataatctgtgaacatctttagcactgtttctggcaccttttctaaaatgctaaattttattgaagaaatagtatattctaaaaatattttaagatctgagttcatgttactgaaactaaattgtgaatgtgatagataaggaagcatgtttgggttgatggaaaatcacctgtttaaagtttaaacatgagagaaaagtatttaagaacagtacttcaaaaattctagtcatacctctcactttcctaatcatggactttaattctaagaggtatgtattaattccctatgacttctgaacagattaccacaagtcgggtggcttaaaaccacacatttattatcttacagctctggaggtcagaagtccaaaatggctctcacaaggctaaaatcaacgtgttgggttcttcaggaggctctaagggatcatctgttttctccccttttctatcttctagaggctgcccacatttcttggactatagctcccttctgtcttcagagccagcaatggccagtcaagtctttctcaggctgctttactctgattcggactctcctgtgtccgcttttcacttataagcacagtacagtggccacgttggaacactgtattacattgggcccaactggataatccaggataatctctctatctcaagatcattaacttaatcgcatctgcaaaatcccttttgccgtgtaaggtaacatattcactggctctggggattaggatgtggacaactttgggaagccattatttggcctattgcaaagtctgtttatcttcaaagcaaagaaagaaatcttcttacctttatgtttcatattaaagagtcccaaaacatcaacaaggctttcttcctcctatcaccccagggaaaagatgcttataaagattgctttatttttatgtttttggtatcttgattcgcatttcctttggtgtataagcatctttctttataaaacacttttaaaacatttgaaagtgaaattttgttccagaatgttagtcattattgagaaaatcttatccaagcagacatgaatgttaaactttgacatttgctgactgtgaaattgcagtgctcatcataccaccttccattcttttggatgcagttattgtatcactaatgttctttcaacacatttcagaaaagaaggttatggaagatacttagcaattagatttgaaaaaagatagaaggattttaggactaatatagtttagtaaatagaatactgaactgagatttgaaaaggcttagaattttctcaccattagctggatatccttgggtacttaatctcagttcgactcagtttctttaccttcaaaatgaaaccaatatgtctattctttttacttcatggttatatttaagaagaaaaactagtatgtatatttgtatgtgggtgtgtagatatagtcataatgctaatatcaaaaacctaggtcttagttttcatataacttaatagtaatccaactattaatttacaatgtattaatttaacctaagtcataaaatatatgactgtaaggaccagttgaaatacagccaaaatgcccttaaagtgtgatattaaaactcatcactctgtgacctttctttaaaagtttgactttcctattggaggactcactaggattagagaactggcagcttgtcttcagcaggtgctagtgtagatgacaaatggtataactaattattaatgtgcccttttataccttgtggtgtcaaagtggctataaatgttgatatcaaaatttcatttataaaaatatgttcctgttgatattttcaacaaacttacacattctttaggagagtattaactgaaattaccagtagtatttcattccaagcaacatacgttttaaaatctctatcagcttagcattttgctttcaagggtatttgtgatgtccaaattgtgggtagagatcatccattggaattctccaaaacaccacccacccacataatcacttagaatgctgagttatcagatccttcaaaacaatggagttgcttttataaaattttattaagcaacgcgcattgtttaccgtgtcagttaagaacatgttttatatagagagaattgtgctcatgttattaagcagctaggcagaacttcagttaaaattaaagggttctgggttatcctacagtggaatattcaaaaaacgctagcaggacaatgaagttattggcaaatgaagactttgtagaaaatcctaagactttaccactttgcagatataagcagcatggaaattatttgtaaaattatagctgcagagtagaacgataaggacagagcacctagaatgaagtgaatatgatgttttaggaaagtcatataagtatatagtaaatgctcctggtgttaaaattggtagtacgtgaacatcggagtgaaggtagtcaactccctggtctcctgatttgtctacttaatgagttaaagctccactccatttttatagtatcttgcaaggaacaaacaaattaatcctaagtcattataccagctgcattgctgttttctgatatcctttttctactgaatagtgtacaactgatgtcactaatgtagatctcattcccattgcctgttgactgttccttttttctctatatatagaaagttactactacctttaatagcaggtataaacatcaataaatgaataatttaggcaaatttgggttagcagttttctgaaattcagttgaacatatttttactctaagtgtcaatctggtcatttaaaaagggcattgaagaaaagttataattgaccactgcttagtgatatttttatttgcttagaagagcatgaatgctctcctctcccacacccagtacatagaaaattgtacaccgactatgccctaagttatcctgttcccaaaggaattaatagtgataaaagcaacaggcaacgtggggctaaaatgattagacctactttaaaaaaaatctcattatgcaatgttgaacctgaatgtcagatttcatgtagcagttactggaaaataatagatttgggatgtcagagagtcaatttaattaagtcttttttagtattacataaaggggcatgtatattaaattaataacatgaattgagagagaaaggtagggcattaaaaaatcttcagatttttggttgaatagtttgacccgagtaactctgtaccttaattttggtctggcctcatatgctttatgttttattttattattgttacattgctgttaattattattattattacagttctttattcttttattggatttaatttccctttacaaatatgcatggaccaaaaatgtgactttgggagattattgctgagttgttgctgatgtcagtttcatactatgatattttttctctatttaccaagagatcagtatttcaatataacgatgtgcatgttttccccccttctcccgctgcatgcagggattcgggttcgtaactttcgagaatagtgctgatgcagacagggccagggagaaattacacggcaccgtggtagagggccgtaaaatcgaggtgcatgtctttaataattcaatttctggtttatatttttatttctcttttttcgtgttgcctcacttagttcacatttggaaccctgtcttatgtgtgcgtgtgcacatgtatgtgtgtttgtatctctgtcttcttcaccttcttgcactaaaatgtataaaagtaacacttctatctgcctccctcctcatttattggttgtttgggggttttaattttgactgtgtgtgtgtgcgtgtgtgtgtgtttgtttttcatttatgtttttccttcaaaatgttgatctttctgctctcttgatttttttcctttgcttcagtttgcaatactctgaattcctgtgatcaggcctaagcaaaactaatgttaaattgtctaaaaactatccagtttataacactgtgttctataatgaatcaaggggccagccaatatcctctctcttgggaggccagttcgcctctttgtgcacatgataagcacgaaatagaagattctagagattgtggggagggaggaaataatccaaaactcgtgtagtttttaaatatatctaataccaagaattttggtatctaaatttttatggataaaattcttaaacagagggtatgatggctggctggcgaatgtactgtgattatgaccaagtctaccgcctggtattcaccagccctttttgataacacatcgaaggttaactggctcctttcccctttcccaattttttaaagtattaaatgtaaaagccaccattttgagtaagatgtctgcatattttgctttttttcccctcctttccaatggtttagcatttagggcccttcacttgactcactctttccatggtaactatacacaatgctggcgatggtgcccgttggcggtaagtgaacaaaagcactagagaagaagcttttaaaaatgtaattacaaaacaattaaataagaaagaaaaagtccatctgccatctcacattaacactacaaaatgtgatttgacttgttgttcctcttccttttcctttcccccttttattttcaatgctgttgagtaatgccgcctggattttggatgtacatattgttttgtagcggtctgagctgtttgattactgacttcatggtgatttttttccccttgcacatcttactcagagttactgaactccagtttggctggttttattaatgcacttcctgcccctacatccttccctacttttcctgtttcccaaacccccgtttgtagctctgactgttctttctttgcccgttacacccttcctgactttctcttttctttttccctaccttactctctttttccggatccttgttcctgtccctttccctattcttcctttcccatcccttcagttacacgcagctgttggtctcttttgctgactggtggtttctgattggttctggccatttttccttttaagtgcttggttgctttctgctccagcagctggtttcagctcttgctccattctaatccttgtctgtgagaaccttgcttttcagtttctcccctctttccaaaattgattgttttttctttcttttatttgtgtgtgtgtgttttttaactgcatgctctcagtctcatcattgttgtatcccattctttctttttaaatgtgaaacgtttatattatttggtgggcgaagctagagtaaatggagtttcaagctctttcctcatatgggggattatcactgtacaaatcttaaaagacataggaagaggttttttttttagttctaattctacctaaaattggtcttttcataacaaaaatttattaccatacaaattgaacacaatgtaaatttgaagaggcaaaaataagacatttatattttatgcttcttttttcaattggcatgttttatgacctgacaacacagtataagtcaagttctatggtggagctttaccctccttgcaagagctttgagactggttctgtcactgggctgcagtatgctgacatcttagttccattcatcttttcttcagcagcagcatctttgtaacacctacttactctagcactgagaatgctttaaaatatgcagttctgtaatgagggtggagagtaccataaaacaaaataaataaacactttattttctcaattcttttaagtgcctactttaaaggctttcttaaaagctttgttcttaaattgatagaccatgtagtctagaaaattcagaatggtcctgaaggctgtcagcaggggaatcttaggtttctatatttgtttacttacctcagacagtaaaaatctctgacagacatatttaaaatgctgaacattaggacaggtgaaatcagatttattttatcacctttccatcaatctatttcataacccatgtggcaagcctctgttttattaacagacttcaaagtgaattgctaatatagtttcctatttacttttttctgtgttttccttagtgcagagatttctctgttaaaaagatgtccaaagatcttgcaaatgtattttctttggagtactgatatttggaaaccaagaaactcactttactcttgttatcctcatttgataagaactttaattaaaatactatatattaatattttatattgctgtgttaattatttaaatcactgctctcagaaatttacattttaaactaaatactctgttattggatgtgcaactttatgttccctaatgtggtccacttcttccctgcccttttttctccttgttatttttaggtgaataatgctacagcacgtgtaatgaccaataagaagatggtcacaccatatgcaaatggtaagaaattataatcttcgaaagagtgtttattcttgtgtaaatatatgaagtttttataaacttctaagaatgtctttatttccgtcttaagacagtttgatttgtgttgaagtagtctctttacctgggagagtattttatttttacagaataactttgtcattacaattgagctaagtttttagttattaaggtgttatgttctaagtaatgttcatcttttacacagtgcaaacatgctatctagttgcctattaacccaaattggatcccacctgagcaccttctttttcagctgctgtagctctttctaatatgttagacttgtccgtaatacccctggatgcccactgactcttacttttagttctgactttcattcatctgagcataagtggaataaattaggaggatattttaatcacttttataattctggacctgttgctctccttagccctagagataacagccatgggtatggttgtgtgtgtatcattttctgtttcatgattacatattatatagtaaggtttataagtttttctcattgagaaggaaattttctatgaataatttgttacatcagttaccaaatttaatctagactcatggtctctgaatgagatggaatataaatttaatctgtagcccagtggtggttttgcagactgttctgcagagccagtttgggagagaaaaaggaaaccaaatggattgaattctgaggtctcagctgtactttagtctgagcaattagggttctgcataagcttttactaatatctagaataaaggggggagtttctgctggagtttttttttttttttttttgagacggagtctcgctttgtcacccaggctggagtgcactggcgcaatcaaggctcactgcaagctctgcttcccaggttcacgccattctcctgccctcagcctcccgagtagctgggactacaggcgcccgccaccacacctggctaattttttgtatttttagtagagatggggtttcaccgtgttagccaggatggtctcaacctcctgacctcgtgatccgcccaccgtggcctcccaaagtgctgggattacaggcgtgagccaccatgcctggctctgctgtttttttaaaaagtttgaacccactgctagagtatggctgtatgtgctaataatgtcttaaatcaaggagaaatgtatccgtattgactatatcccataaagtcttcaataaatatatttagcccagcttttcacatagatgatacaaatttatcagcataatttgcatttttccttactccttttatcggtatgataccactgcctcccactttacctcttattttcttttcactgctcttacaaaaacaagtctctacaattttgataaaaactcaaagtaaacaaaatagaaaggagaggcaaagaatgtcaaattttctttacatctaagggaaatattgtgacagaaagagcctctgactggaattcagaaaacagacgttctccttctaggtttgactctttatttactccgtgacagtggaccagttttttaacctaattctgttttcatatttataaattgagaccacagatttttggcaccaggattttttaagaaattattgaaactcaaccctcccagcttattattaggaaatgagacccagaaaagtatagtattgacctcagattgcagatgtggtatctattttaccttcctctttgggttttgtgaaggtcaaagggcatctgtgaaaatacattgtaaattttctaaaactaaatatattcaaagtattactaacaacatgtcaatatacatccattatattgatttttgtttttgttttgaggcagagtctctctgtcacctaggctggagtacagtggtgcgatctcagctcactgcaacctccacttcccgggttcaagcgatactcgtgcctcagcctccagagtagctgggattacaggtgtgtgccaccacatccggctaatttttgtatttttagtagagacgaggttttgccatgttggccaggctggtctcgagctcctagactcaggtgatccctccgcctcagcctcccaaagtgctgggattacaggcttgagctacggtgcctgcccattatgtggatttaaagggaatgctcaggcaatagtggcattggtaggaaagaaaaaggttattttttaaaatattattctaaattaatattcaggtttagtaggcaagaaaccttctgctattgtgttaaaggtcctaagaagaatttgttgggttcctcctaatgaattctcagtcagcattctcatttaggttggttggaatctcttaatttgtgcagaaatgttgcacagtatttgtgtaatttgatgttgcagaatatttgtgttcttacaattcaagtaggatttgaacctagattttgccagaattttatgtggaatattgaagagacattgcattttatgagcacataaaatgatgaataagagattggattgaatcagagtgaataggttttcacttgaataatgtcttgcttacagtcatttaaatctggtaatttcaataattcttttgaaaaggccaattgtggctggacgcagtggctcaagcctgtaatccccagcactctgggaggctgaggcgggtggatcacctgaggttaggagttcaagaccagcctggccaacatggtgaaaccccatctctactaaaagtataaaactagccaggcatggtggcacgtgcctgtagtcccagctacttgggaggctgaggcatgagaatcacttgaacccaggagccgaggttgtggtgagccgaaactgcgccactgcactccagcctgggtgacagagcaagactctgtctcaaaaaaaaaaaaaaaaaaaaagaggaggccaattctggcctttttcttttcattcgtatatttatagaatagtgtggcacaatgctagggtcttaatataaaaagacaaatgagtcagaaaatatataatatagagtatttttgcttatatgtaaaattcagttaatattgattaaagttttcatgtggaattctacttttattcactcgcagtgagcaatcgtatattattcctttttaaaaaatacttgccatattcctataaatataaaaaagggaaagaagaaataaagttgacattaaacataatgttatttggaaactcttaatatttataaatatttaagctaatgttccacagtattctggtgttctttagctaagaagtctgattaacttaaaggtgattattacacattaaagcctcagaaaacatgcactgaagttgggaatgtaccttgaattttactatttcatgtctttccttttttagttggtgaaccccagtaaaatcccaatggtaaatccgagtaaaagtggatttcagtttacctggaataccagcattgtatagccaaacatggagtcaaagatctaggttgaatttgagttcagcccatggatacctttattaaaacaactagagtaataaacagggttgagaaaatgcatcacagcatggttcagagtgacatatagtcggccttctttttttaaatgaaggataggtcatccagggtaattctgtgagaacactttaccaaactctaggatttatttctatttattttttctcctctcattccctctccatcttcctcctcccaacatcatgacacctgccaagccccccagccccagcccctcattatctcttcactgtgtcctagttctactactgttactctctcatataaaccccaagctggaattccaaagagaagttgataataggcaaaaatagccccagagatggctgaagccaacttgacatgcactgatcatccctttcctcaaacagtcttaaatgcttaccttccattttgtgtgtttcaggttggaaattaagcccagtagttggagctgtatatggtccggagttatatgcaggtagtatttaagtaaatgtttccacttgtgctatttaattgtaatagcatctgctgtttttcaatttgtgactcctttttaatcttcttgcatttttaaattttttaaaaatccaatcagcatccagctttcaagcagatgtgtccctaggcaatgatgcagcagtgcccctatcaggaagagggggtatcaacacttacattcctttaatcagtaagtagcctatgttggcctggcatggattttgactgttgtgagtgaactatcatgtactgtttttttttttcctagtacagtacataactgaaatggaaatttcttgagagggatattaaatactatcccagtgccctgtcctgcttaacctgtgctagaattttcctgaccaaatattaagattgcacaaagcagaaatagttggaaaaggtagagggggtaagggcatatgaagaatattttagtctgtacttgacgataaagaaaacaaaagaagcaagtatgtgtagagcatattatacatttcctctgcgagtcagccacaggttctccagcagaggatcacttagaagtacttccagtattattgattattcccagctctcttgatctctctaagtcattttgacctgagccattttactccagcaagaggtataattaaacaggattcagtggacatggaatcaatgtctctgcatgctttccagaggacagcacacttaaaataggctcttagaaattgtctgcctctttaaaggatatgaggcccctagaaattgtctgcctctttaaaggacagggtaggagttgtttccctcaccttacatttgtggattaaaatgttttaaataaaagaatgaaattgactaatgaaatgaaatgtctaaagactattatgtgccttagaggttggtaccatgtaaaaatataaaaagaatgttcttttgagtaataattattatgtggacatagtaacattgggaagcaaggttaataactgaccggttgaagagtttgtgtcaatctgatttagactgcccacagtaattaaaagtctgtctcttattatggcagtcattctcagagcttcttgacctgtttctcagcagcttgcattgtaaagctgaaattgagaaggaacagagaagctcactcaagatttgtgatgaatgaggcatggaatcttttgcttttgcatgttgggtctctctttccatttcttccccactgagagacccagggtagaacgtttattgaatgcatgccaccttttccaaaaaggtgtggttcgtatctttccatcttttctataattggttcatagcaagttgtgactgtgcaccttctattgaatgcaagttgaaatttctgtcatattttgggtctccctttagttcctggcttcccttaccctactgcagccaccacggcagccgctttcagaggagcccatttgaggggcagagggcggacagtatatggtgcagtccgagcggtacctccaacagccatccccgcctatccagggtaagcgttagattccaaaatcagtatgtttctaaaataagcagttggaccaaaaaagaataccatggccctttcataacttctgggatgttgccgtgtcacagagtaggcattcagtgaatatttgcaaattaacagattagatgacaaaaaacaaaatataccatcatcagaatgtgacaaactgtcaattcattataagtcttcattttggccaccttaagccctcatggtaatggcttaagacagtagccagaaccgtcttgtgtttactagcagtgtgttggcatgaagttcactcagaagcgcacgaatatggattaacattactgcagagaaccaaaagaggagctcaagattgtagtacaagcctgcatctgctgtgttcacctccttatcaccaccccgtgttggggcagaggctgtcacatgtgtcctcccctttggtttcactgcctgggtggtgagcagcagagctagttacccacaatggatttgctttctttgtaggaaacggattaaaagaggttaattctaagatgaaccaagtccaattgaatcaagggagaaagggagaagtaggaagaattaaactgcagttggcttctgaatgatggtaaaacagcgactgtagctgagcatccttcaccgtttgatttttttatggagggtgtctcatgcagtggaatgattccatagcaacaaataaatcctttgctactgaatggggaaaaggagtgaagatggcaggttttgtttttaggggtttctcagtgtcagcctaaaatgcaaatttttatagagtggtctttcatgagtcagttgtaccaaggacttcctcatcaaagatgtgacatttctcttcaccttttctctgccagataatgtcaatatgacatatttttttttgtattcttacggaggaataagtagcagcagagaagcttgttggctgctacttagttaaaatataaagggaaggaacctcctttgtatgtccttttctgacagcaaaattggcttagccttgaggtgtactaatttagcattcattcattcattcattcatagaccaaatggatgtaccattagaagttctccattccacagagttaaaacatttttattagacaaggtatgttgaagtgggcaggctccaaaagacactggaagggaactgcttcagaaattaacttttgtttggagtttgtagacatttaaatcacatgcattccatcatctccatcttatgccattacttacttttattttaatccttttttctctcaacttgacctttgaccttcaacctctgacatctctttaaagaagtgaatatgcagtattatttcatcaagaaatactcaaatgaaacattaaaaggaaccttttggaagttttacacactaggaaaattgtttgtgaaatgtcttccgttgtaatccaagagaatttactgtcatatttgcaaagagagactactcaccagaaacatgggacttccttattttgtaacattgctgaattactttataaagtggttgaatttagtcctgttcaatgtagtcgtttcagtatattgaccaaacttgagaacccattctctaccaagtctgtgtcaggtatatatttgctcaaagatattttatctttatgtctaatcatatcaatttctgtgcattacattgaacactgatttcccatgttttctttttattaactaaaccacctgtttacatggaagatggcaaggaataagtccagtatttcatgggaatggcctagaattgcttttcagcttagtaaactaatttcatcattaatcattacgtttctagcctccttgtggcatttgatacagggaatattgggattcttctagaacgtagatgaatattcccaataagttatttgacttagggtaaaatgtattcgtgtttttaatgccaacccttctttatagaaggcttatttgtaaatctttgcctatatccccttactaagatctttgaagtttaattaatcaccacttggtctcagtgctttccattttatcagccttctcattttgaacaagttgtttttttccttaaaatgcagctgagaggcagattactttctaatatcagactttaactgcaactggagactatgaaaatgaatgggacttagctaaatgaacatcagagatgagtttgatttgccttttgtgtgatacaagggcatagcatatttggggcattccaaaatgtgaccatgctatcctgtaaatacaaccaaatgtcattggaaatagaattaagaaacattccacctacctataagaaataagttatttcatattcaagttaaaaatatgatttgatgactttacttgtcagcttgtttattgtaacagagaaggtagtggtgaaaatttccagcttgtttagttgaataaccaataaacagatcatctaaattaaaacaatctgatcttgacttcacagagatgaagaagaaagttttatcttttatctctactgctattccatgtcctttggtcccaaaataatgttttggggaaagtctgtataagtctgtatgcacaaaggtacctcagaaggttggaaatctatacttaagaatatagtgttgcttaggttttgttttttttttttttttaaagtcatgcattgtctgtttgctacaaattcattatctaaacaggaaaataaacccttctattcttaaccagctaccttctcagatgtattcttttaaataagacagggtgatctttggtcaagcccagaacttcagttatcaattgtatttttcagaattccatgaatactcttatagtcaaaaaagaacccttaaaatcttccagttactccttcccactctggattatattgttactatctgggatccccactgcacctttcaattcttggaccttggaccaatcaccttaacctttagctcattatctctgcttgtgaaagcaatgcattgtgggtatttttggttgtgttttttttttaattacatttctctgtttactttggtcagaattgattgacttgtttttctgaggtgttgcattggttcttaaaatgctgaataataatactttgcatgcttgtgtgatcagccaaatcttatcgcatgtctaatgtgcagggtaaaaagcaggtgatgtatggatatcagaaaaacatttacatattattacaatactgaaaacaaaatacttaaacgtaatgtaaaaacatactttgcatacaggccctgccctagtggaattctttgggttcagtttttcatgttaaactcctcttcacccctaccctactttgtaagctctttaaaaagaaacttcctcctagggcaagcttatttttaaaaatactccatatacaaaaagttatttccaagccagcagattttggatagatataataggctcttctaggagtgctttttattgtgtgaatcctactttaattaccaaatatccaggttgcgcattctagttttgcacacctttccctctcctcgcatgtcctggagctgtgtaaccttcgtgtgcactttcacattttctcaccaacttgccgaggccccaagcccaggttatgtattcatacatcacctgcctgtgtagagcgcatgtgcatgctgccgtcctcaataaccggaatgtgtttctgttcttttgttttttttgtttttgtttttgtgtggattttctgcagtgtggtttaccaggacggattttacggtgctgacctctatgtaagtacacacactggggccttctcgaccccatcccctgacaagccagcctttttttttctgtttctttggtttggtttggtttttttccttttaatttatttaatttttattttctttttccttgtggatatatatatatatatatttatatatttaagaatgcaagcatgcttctctgccactgcgcttgcccctgggtgcaaaaactaagcctttgggtttcctgatcattgcaagggtcagtctactggacatattcttttcccttccctatacccacagatgttctgtggatcattaatttacttgtgagatgatcagcaggtttaaagtcttttattattgtcgtgtcatttgcatacataaataacaggactagcttaaccttaaaccagctctttcccttttctgcttttcttctcatttcacatccctctttagatcattagagctgtgatttagaggttaataagctttctgaactgtacattttcctattttacctactttgagagaacatgaccttgtgatagccaaataaggaaccgatgccagcaaagagtgtgtagtaatgagaaaacgccagatatttagttcttaaaagccattggaggaaatgagtagcataatcagcaacccagactcttcttacagctatttgactatcatagatttgctgactctactagccatagtaatatggactccattatttaaactgtctagctatcactaaagttccatgattggtttgtcacatattatttaaaatgtggacaaagtgatataattgacaaagtacaagtttttgagttttgaagtcttttatcatgacctctccagatggactttttctgaatgcaagcttgatttagtcgctcaagtcatcaagggaaaatttttataagaaaaacttgtcagcatgaaatgattctgtggggataggttaaaattgtctagaaatactttctccacccttactttccaaaatcaataagaggtcctttttagtgaactgtttccacagtctaccagagattcacaagcaacctaaaaaagttaatgcactttcagaatgcactcagaggttttgcgttttgcaggaagtagagatgggatgatacagttcttcgaaatacaggtgactcacctgtactacttagcataggcctgtaaggtatgccttaatttaataactacttgaaggaacctcagctatgatttggtccaacctcctaacttacagatatatttctcagagacttacccagaactacataaattattaatagtcaggcataaaacccaaccaatccatatttcattacctctctttgtactttaattaaaatccacctctttcctcaaaatattttcaacaagtaatgaaagatatcttttttcctatgttcacagtgaagcttgagaactggggaatctcctacttttacaccagattacatatttctaaatacacagacttacatatgatgttagcatgtacattctcccatatacattagtgtccatattctcatgaaactcatctttgttatttaacttgttttcttgaaatctgatctattagaacaagattttccatttgagttatttcttaaatcaagtttttttctctaatgtgtttcttatttgaggatttatttttcttaaatacaacctatttatgtcttattaagacttgcctactttgggccgggcacagtggctcaggcctgtaatcccagcactttgggaggccgaggcgggcagatcatgaggtcaggagatggagaccatcctggctaacatggtgaaaccctgtctctactaaaaatacaaaaaattagccaggcgtggtggcgggcgcctgtagtcccagctactcgggaggctgatgtaggagaatggcatgaacctgggaggcagagcttacagtgagctgagatcgtgccactacagtccagcctgggtgacagagtgagactccgtctcaaaaaaaaaaaaagacttgcctactttggccaggcatcatcgctcacgtgtgtaatcgcagcactttgggaggccgaggcagggggatcacttgaagtcaggagtacgagaccagcctggccaagatggcgaaaccccatctctactaaaaatacaaaaattagccaggcgtggtggcacacgcttgtagtttcagctacttgggaggccaaggcaggagaatcacttgaaccctggaggcagaggttgcagtgagccgagattgcaccactgcactccagcctggctgacagagctagacttcgtctcaaaaaaaaaaaaaaaaaaaaaaaaaaaaagacttgtctacttcaaacttgttaagtcaaccaacccaattttttaatagttatcttacttccttactttacaatgtaagattttattgagacagatgatttttctgttcctgttaataaaatactcttggttttttttttttaatctactaactggattaccttgctgagctaaacacaagtaattcagtgatcttgctgaaataattttttttgaccagtggccccttgttaatgaaagtaattaatagtaatgttattatttcttagttcttatcttaaagcagagttacttagagaaaaaaaggttggtcactagtgctgaaataatatccatgcccctacatgaaaagcaagaatactttatgaggtaactactgagttaggcctaatacaactgttgcttttaaaactgtgtgttctgtattccacatgtgagggagcaaaggatacttcttcaaaaacacacagacaacaaaacactatcatttttgccttgagtttgttctgcttctctccatacatttcccatctgtggaaatctgtcagcatacatttagttcttatttcctccgaaaggcatattagaaatagaaggaatagagagtttagtatgaaaagtgcaccgaatcggagcttgaagagaagacacaagggaaaagattttaaattgctggttatgcttaagttaaatgaatttaggctattaattgtgcaaggtttttgtaatccctttcacagtcccattcttagacagtgattcctgctagccatttactttctgtttcttttatggcacattcctctctggagaactgatctagcaattctgttcctagtttgtaaaaagacctaccgtgataggatttgggagtgtggcagctagattatgtatccagccctccctcttcttttttggccagtagaaaaggcatagttcgccctaattcactttttaaatgggttaacaaactgctcctaaatcacctcctgtgaaaagcatgcttgcatccaaaggaaagaaaaggctggtgggccccttagtgggctttttgtatgattgttttccttccacagctgtgttttttgaactgctcttcctgtgttctgttatagaatagtcttacaggaaccaatcattagcgctaaaatacctcaggtaggagtgccagtgtgacctgccaatcaatcagattgtggattgcagtgaaaaaattgaattatactaaccattccagctccacgttagagatgggaacagaggcttttttggacaatcaagacttgtgagcgtgtgatctaagccctgctacctcagcagtgcccacagtcacattccgtacataatggcacttcctctaaaattaagtgctcctgtcctcttgacacatatcccagccaggtgtgtaatatgcactgtcccatcactgccacctcttttaatctgtcagtcacatgtacctgtggtatttaaactgtttttttatatttagatcttagcagttggggacattttcttactactataaatttagaaaagagaaaaaagaggaagtagaactgtacaaataggatttctgaatcccacattgggccctgtagtgagataccagttgtaattggactgtgctgctacataagtttgaagttgccttaaaaatctagacatatgggactcaaacattgagacatgcatttcccttggcctcttctcctttcacctaagaagatcagtgagttcatttggataatagcatacttgttagaaggattgctgatagctggatgctaggagaaagaaaatagtcgatggcttttcacaatccagtttatttatgtggctacccagcaagattttggaaatgaactaatttggggagatgtggaataataatgtttgaaaggtttgattattgaaaatcgtctctcatctaccatagaaataataggtggaagacatcaggttgatcatagcaattttttcccttaaccccaattttaaacaataataagataaaatttaaatactttaaaatttttttcataagtacttttcaaaggagacagagctcaatcaaaagcagtgacggtatcaccattattgtaagtttgtgtgttactcacatttaatcagtgatgccattttgccacaaaagaactctataatatctcctagaaccatggttcttagcaggggtggggaggtggtgaggaaaaagagggagttagattcatccaaggataaataaagtgattcctggaggcccagcattaaacccacgctagttggaatagatctctgctctgctgtagtgattttcagcatcacacctgccattccttacccaccccctgccgccatcccccaaccctctgctctattgatctatacactacatgtaggtaacaagctttcattttgtctgctggtcttgaaatacacactctcctcctcagtgtcacataatgtcattgtcttccgggtagaaagaaggtgtcttgacatcacatgctcaccaaagtcctgttttaatgtaaacctaaaacaaaaatataataaaattaaaagctaggttaaaatcaagacaaggcaaaagtctgccagtgtgagattaaactaataaatatgcagataaaggtcagatataggagggattatattctattgtattttgctctagtttaaaacccagctacagaactgtgccgaaagatcatgtggtcaacgtggcaacatcataaagttaatttgatgataaaattggctcagagcagagtagaaaagccctaggagatgacattgagccatgaaaaactgagactttaacaactgcagaaaacactggaaaggatcttaaagccaacttttcaaaggcattttcctttgaagaagctggaacttgaagtcagagataggttacagatatgtgaaaaagtaaaattcctaaacacaggaaatattttagcagaatgctgtggattagaatatacggttgttgacagagggcgagcatacatgtgagtgctgtgggtcaggactgaattatattgccagtgtcaggcaggttgaataggggagcgatgaagcactgggcagccccactggggacaccaggtatcattcagaatgaattgcaaaggaataagaataattctttttaaaggggcatgtgtgtatctgaatcaagcttagccaagccaaatttatccagctatcagagttccaaaaagccgtccgtgtgtgccctcctacattagggtgtgctgtggccatgctaatccccattttttgttttatttcaaatcacacacagatagaatctgcaaactgcttcagatcaaacaggtctgattgtgtgtaaatacatatgtcctttttaatttttattattaatggttgcttcagttttgcatcagtgcatggttaaaagcaatacacatcagctatttcatgacttcatatctccaaatgaattatttctcctctttttttgtttgtttgtttgtgcagtcagctgaagaaatgttaacatctcactctaaatctctcagtggagtctctgttcccttctctgatataacagatgggttactgcttgttataattattaacattgtggtgtgggccagggctagggtgggcaagattgactatttctttgggctggggaggggccagtcgttagggtatggaatgttaactcaagtggtgactgactgtttccgtaataccaggtcgttgtggctgcacgctctagtaattgaggctgtgtacttcaccgagcttgtggtagagcctagggcaaaccgctgtcccaagagaatgctgggatagatagagttagccaatacgagtctgaacgtggtgattttgctggttgtttagctccagatgttggcatgcttagtttttaatgtgattaataaatgtggcgccatatccctccccacgcctgaaccctgtctcttctacctccttcccacccttgttctttttgaaaaacttaagaaacagtaatgaaaaccttggtgtttcaaactgcactttgttctcatgttttataaaagcctttagatttgctagtaagagtgaaagctgaaaaaacggtttctcagcctgaaatttctatgcactttgaaatctggaatagaaataaatatatctgaattttctttttctcacattttgtgatatgttttgttgaataaagcagcaaaaatactttcgagtaagtgtatgtgtgtgtgtgcgtgtgtgtgtgtaagagagagagagaggaatacatccatgatacacaattaatttttctacttttggagtagtcattagtgaattaccaagttagtttagtaggatattgcctatctatcctaaaatagttcatcttttaaaggtttctctgtaatgccattattataaagtaatcaggagaataatcatgttaaagtcatctgctttaaaaaaaactcttcatgtgttttttcttagtgctgatattcttgagccttttgttttcagtaaagtatttgccaaccctgttctgttttcttccacttgaaaagcagagaacttcatcatgtttaaacttcaaagtcagacttgacttatcaaagaaggaaaccgctacagatagattctctccatctccttctggattggaaggaagattcttttccatagtctgatccatttgaattgttttgattagcagtaacattactcctaaaccaccaaggttcctatggcttcctgtaggcctaggaaaatgaggggaaattggttctgtcagcaacctcacttagaacctgttttttaagaatacagcttaaagccatgatttgatagaatactcagagatcgtacctccagtacctcactcagtcttcctgagagtcaggtgtgaaacctacccttggttgagtacttttgaacctcagtatccctttgcaagaatttatacctctgccgtatggcataagacttcagtttttaatttttttacctaggtaaacatgaattgggctttaactgcttttgttgccttaactttaaaatttttttaatgttactttgatggttggagtaatactaaagagtaaaatgctgaattacccttgtttgcaaagaagttttactaaatagccctgctgtaactttacactagcaaacaaattctaaactaatggaaccatctctagttataatgaaaaattactagggttcattttagtgttaaaattccaactgtaattaacatttgctttgtttaacaaatgcttaaaaaaaaaaaaggtaaagaaatactttagttagtttaattatgttgtggccaggatttacagctttgcccagatcctggctagaattccaaggaaccatgttgatcagaaacggcccccaagggtgcttcctgccatgttcccattcattaccatttcattgtcagtgtttggtaatattaattagagtcttcatatatctctggaagaattcgtaattaagaaggaaatgtttactttctaagtcactcatttgaaaaacaaaggaggaataatgtataaccactgaaagccagtcagggatttttttaagtacatttgaaactaccctgacttcaagcagcataaacttgaagagcaggaataaatttccctcacaatgcagtttcttcatttagagaaagcataaattatataaggaagaagcaaaaggctttagaagctcataagaaattataggtatttctaaaataaggggtaacaaataaaagaagcaagctaggacttgccatgcaagatggttaagaagaacaggggtccccttagaaaatagttgttctcaatcccaagaaatgatacagaagtaaatttgaaatttcttttgtagatttagaaaaatcgaacatttgaaaaaataggaagtagaaagcacagggcagaaaccttcagatatccatgagaaatgagcacattttatccacagaaataaaatgtttatgctattgttcactactgaaatgatgttcagttgggccagttgaacatagttgtttttgatagtgaaaggccaataataaaaatttgcatctgaattacgtttaggtaaaatagatgaattctatttcataaataataaaaagtagagtttgccacttttaaaaatatcctgtctcatgtggcaagcatttgttgttgtgattgtctcttgaaatgctttctgaaagagtgcatgattcaccctgatagtgaaaaccttttgtatatttgagttatctaaactgagttgaaatagaaggatgtgatggtttgaaattctttaggactgagaggatatttggactattggaagaaaagctcagagtctactgtaagattaatatgtaagaatctcaaaaccttttagggaaggaaaatgcagttaagtgctagaagcagggttcctgatctatttgaatccagccaaagaatcctcagaaatttgtaattgatttgctcaagtatgaaatgtagatctgagttggcaaactttccgtaaagggccaagtggtaaatatttttggctttgtaggacattggtctctgtcacaagtactttcaaaaacaggtggcaagctgcattggctcacaggccagagtttgctgacccctgatctacattgtttttccttctaaatattacctgattatcttagcttcttggcaaacatgctaggccggatggagcagaggtttctgttacatgctgtagtctcttattaatgaatcaatccaagaacacgttagagaatctgaagtcaacacatacagatttcatatattttaactttataatttatatttcttgtcagagtgctcccaacttgctgtaaatattttcgcttttgaaagttccaacaaagactgtgaagtaagacagattcaaaatcatatcttcattccttgtatttaacaggtactaccaaactttacttttaatactatcacaaattggaaagcaaatccttgcatatcgtagggcttaattttttattggaggaataataacatgcagactgatgcagtttgaaacattttcttcccatgtgtgtgtctatgtttgtgtcagtccctgtgtctacatgtgtgtacgtctgtgtgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacgggtatgtacagagacagtggtgagctttgggatgcatgagagctgttccatcccaaaatgtcacccattttcctcccttcaccatttccacagcagctcttagcacatcgggcatcttgccagcctgggctttctgcagacctcttgatggcctctgtcatgcctaaagcacaaggcaccgactctgtcctccactccctctttcttgttctcatctcttctttgactttgactccagtccctctcttcctcatctccaactcctttcttttccattttatggaagtacttcagatttttttcagttattgcatttgggagtagaaatagaaaggttttttcctattccttgtaattccagtttccttatgataatccaagaccaagtgactcacaagtcttaaagcacagtaatccctttaatttttttagatcatacacttttctttatctgtctgattgtgtttcttctttccagttatggcagggtgtacacagccgacccctaccatgcccttgcccctgccgctagctatggagttggcgctgtggtaagtatataatataccattgctttataaaaccatttcattccttcttttacccgtagactacagaagatctagggaggtagtaaattcagcctttcatccaccatcaaggtattaaagccacatagatctacctggaagtttcatgtcaccctctttatttgtgtgttattataatgtgagccacatggcctagttaagggcagcagaaaggaatgatcattgataatatgccccgagtagtggcatgatttgcgagagaaataggggaactggtgaatgttttctattggttcaaatgttgagtgcatacctgtggcatagtttcattgataggtgttggcaaaggagcatggagcataaggctgtagtattcacagtaagcttttcaaaaacttaagtttcaaatgcaaatctaaaggatgtctctgctcttcctaagccttctggtagatagtactagaaattcctaagtgaatgctttataggatattttattattgattattgataacaattgtggcaaaatatggtgttgttgatagaagtatcgaagaagtccatagaactagcataatttcttctgaccaaccacctcactgcagtattattgtgttggcttggatgcctccagtttcagtgattaggactcacaggctgcaacaaagacaggccattccacagtgacacctctgccagggctttctctctaatccaaaatgcaactgggcaactacctctggacatgggtagagttgtttgaaaaggagacagaatgaaatgtaaaatgtaagacctaaaggaatatgagaaagctacttctcacaccaaatttctactgatgaagatttgtggaaggaagtaatagggggccctgagggaatatatgtttataaatgaagtagagcattacaatataacggcagtggtagaagtgcctgaggttgtatttcgtcctaaaatgatataagtcctatgctaaaagaatgacctgagaaagatgcattcctgggaaacttctaattgaaagagataagccattagataaagtcatttgataaacataaaggaataaagcctagttaaaaccccagctagatatgtaaatgtgaatatgtcaagaaacagcctagttggtgtgcttcgtagatgatagaggaaacagactttattaaagactggctcaggtttagatgtggcaccatctcaaacatgggctgtgaccacacatggcagggatcgtgtcagaagtaacgtgcactgccgatgggtcatatgtgagaaggagaaactggtgatctgttttccaccaggattataaggctgtatcaaggtaaacaaaaacctgtgcttttaaaaatcaaactctttgcggaacttgttttcaactgtgtattgtttcccttctgtgctaattcatgtaaataatgaaataaaatgtcgtcatactctccttgagaatatcaggtcagcaataaatgtgttgggctctggtctgagcaccttagaagcagaagttggtttcctgacttcactgcacaaggcaatgcttgatcagttgctttgaggcttcgaagcaggctgtttctagatccctctctggacatttttcttcactgttaatgcttctctcatcaaccttttaattatttttatctctttaattactgcaggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctctt

SEQ ID NO: 37620 - DNA, 51032 bp, Homo sapiens
gagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccagtgagccggggtaccgagctggggggcgggagctgtcccggggacaggcctgggtgaggctgccgggacgcagggcccggctggggctacggccgaggccacacctggggctgtctcgggctgtccaccctgggggcggtgggctgccatcccccaatctgtcaggcccgggttgcccgagggtccccggccccagctgaagcttgagctgcttctctggagttctgcccccacggtgctgggaccaaaacagccgacttgacagcccgagggtgggaaggggagtgtgtgtcacctcgagagctgtgagtgcgttgacttggcgcagtggtcagccgagtttctcctgtcacccaccttcctccccacccacctcgctttcctcttagaccagtttggatggggttgtttactgatttagcctttaggtttacattctgctcagcccctggctcctcggaaatcagcaactttcaattaagggaagtggagagtgcatgtgtttgggtgacttcatacacagttcttcctgtaatgaattcggaaatcagacacaatgactggtatttgaaaggtgggatgacttcattttaataaagagaattcaccaacagcatttcaatttacattattttgtcttttgtaacaaataattggggtgtatttttggatttcaggcagatgaggcttttgttttccttccctacttagctgctcttgaacaaatctggtacacagggaagctaagacacttagccacaaccacatagcaagtaaggcatggtagagttgttggtggaattcagaatgctattgcttgtcttaaaactccctcctccccattagggtctgagtgaaactgtagctgaatgagtcaaatacagggtgtttcttgtgcttgaaaatcatcttggagccttataaacaggagatcagcagcagctttacttggaaagaatggtggtcatcatccttgttgtttattattgttttgtgagcttggcgtactctgttaataggtagaactagttagtcctgaattacaattatattctatattttaaagagtgtcactttgctttcgtttttaaacttttaaaaatttttcttttttgtagagatgaagtcttgctatgttggccaggctggtctcaaacccctgggcacaagcacttctcccactttagcctcccaaagtgctgggattacaggcgtgagccactgtgcctagcctaatttttttgatttaaaatatttttaatttattttttcgagacagagtctacttctgtcacccaggcagaatgcagtgatctgagtgaagtggtacaatcctagctcactataaccttgaattcctgatcagcttgctgagtagcaaggactacaaggatgcatctaccgtgccaggctaatttttaaattttttgtagggatggggtctcactatgttgcccaggctcactttgcttttaaatctaaatgtatattgtagaatttgagaagtagaaagtttctgatcaaaagggattgagactctggaagtgaaaggaagaatatgtggcctgttaaaatccagaagtaaaaaaaattaatatgaccactggttagaaagtatagtactgtttgttccagtttccttttgtgaaggagctgtaatacaggttagatcagaaaattctagttcaaggctgaaattttcttgttgaagctaaatctaattttaatatctatttgcgaaatattcattcaacatgtatccatctatccatcttcgtgtgtattttatatatatataaaaccagaatactcccaaaggtagatccgacatacagttttaaatttaaatttaaatttttattttgagacagggtctcactctgtcacccaggctggtatgcagtggcatgatctcagctcactgcagcctcaacctccctggctcaagcagtcctcctgcctcagccctacaagtagctgggactacaggtgtgcaccaccacgcccggctaatttttatattttttgtagagatggagtttcaccatgttgtccagtctggtcttgaactcctgtgctcaagtgatccacccaccttggcctccgaataggccaggattacaggcatgaatcatcatgcctggccttcaacatatatttatttgagtatgtagtaagtataagaactggcatggatctttcaacagggaacctgcagagttcataaccaaaatataaagttgaaagggattggtgctatagaagacatataaataacatgcaggtattctgggaagagagagattgtttttaattgagaaggcattatggcatttgagttatgtctggaaagaggatggaaagatttggaccttcgaaggtaaagaggagaagagcattccaggagggaataaaatgaacaggcatcatagtggggaagcatagagtatatctagaagagtaatttaatttggctagagtggtggattccagaaagtagtgggaaaaaaggattgaaaggtaaattgtggcccaaacatgaaggatgttaaatgctaagctaaggggcttggatttagttatttaggaaagtgcgaattgaattcaaagggagagactggaatcagagataccagttagggctgtgaaaatgaaaagaaaggaaaggataggagaggtttccttggtgatagaattggtaagatttagctattgattgggcattgggcctcaggggatcatttaagtcaactgttagtaatattaatagctaacatttgagtacatactgtgttccaggcagtatgaaaagtgctttacatacattatcttattttataacaactctgaagcaccagtatcatttccatgttatgtattaggaaacaaactaagaaaggttaaatagttgccctgctaacaaatgacaatatctgaatttgaaactaggtctcttatgaccagcaatttgtctttttattactttttattaatattacagttctgggctgtgctcagtggctcacacctgtaatcccagcactttaggaggccaaagagggaggattacttgaggccaggagtttgacactagcctggacaacatagtgagaccccatctctacaaaaaaaaagttaaaaattagccagacatggtagcatgtgcctgtagtcctagctactcaggaggctgaggctggagaatctcttgagcccaggagttggaggctgcagtgagctgtgattatgccactgtactgcagcctgggtggcagatcaatactttgtctctaaataaataaattaaaaataaataaatcaataacagtgctatagcagttaacacttcaggtttacaagtatgcaaataacttgttttttcactctccagaggacactctgtgggggaaatacctgaagccgtggtgctttctcttctcgtggtgtgttcatctcctctgccagattgttagctcctttgagtcaagggacatgacttattcatctttatatttccagtacttatctcagtcccaaacatatgaaagattcattgatccactatgcaacaaatattcctggagcacctgctgtgtgctggggtgaagcagaacaagagataaaatccctcccctgattgtgtgtatatgtgtgtttctgtgtgcggggggagtatgtatacacacatacgtacatacacatataaataatgtcaagtaataataaatgctatgaagaaaaagcagggtaagtgggtagagagtcagggaagagggagggtgggtgcattattttagttgatcaaggaaggcatctctgaggagctgacatttgagtgagtagacatgtgaatgaaatgagcaagagctgtgtgagtagctgggaaaggcattctaggtagagggcaagagcaaggactttgatgtgttcaaagaagagcaaggaggctagtttggctggagtaccgttagaaaagggaggcagaataggaaaagaggccagagaggtaaccagggatcacattatataggatcttgatgcataataaattgtatcaaattgatttgaatgaatgaggcatttctaccattttggaactcttcctgcctctttccccttgtactgtgtagtacataccatatcctatgaccctaggcagtgtgagttgagattcttccaggccggacacggtgactcacgcctgtaatcccagcactttgggaggctgaggcaggcggatcacaaggtcaggagtttgagaccagcctggccaatatggtgaaaccctgtctttactaaaaatacaaaaaaattagccaggcgtgatggtgcacgcctgtaatcccagctacttgggaggctgaggcaggagaattgcttgaatccgggaggcggaggttgcggtgagccgagattgcgccactgcactctggcctggatgacagagcgagactcagtctcaaaaaaaaaagaaaaaagaaagaaattcttcctttggaattgtttggtgagaaatgggaaatctgaaattgatgggatgacgttgcatctactcagttatcaagctagtgcctatccccaaacctctccaagaggccagcacacccaaatatacccttagaatatgagctctcagacatatatattacccacacacccatacagccctgcaaggacttgtacccattaaaagtctgagagcatagttattcttttttctaaactgttcagccacagatgtggggttggaattgctgagcacatcagcctgagataaggcagctcactgcgtgggttgttacaggtacagctaaggttgactgcctggtacaagtggtgattatcagtatgtgttgggtacagaagaaaaatatttgacttactgtggaacaaagtgtctgggcaagtattgctgaggcagatatagctgaaaacctattagcctcaaagttaactctgaagggattaaagaacagcatttctgactgggcgaggtgtctcacgcctgtaatcccagcactttgggaggccgaggcgatcggatcacctgaggtcaggcattcgagaccagcctggccaacatggcgaaaccctgcctctactaaaaatcaaaaagtaagccgggtgtgatggcaggcgactgtagtcctagctgctcgggaggctgaggtaggagaatcgcctgaactggggaggtgcaggttgcagtaaaccaagaccaagatcgctccactgcactccagcctgggcaacagagcgagattccatctcaggaaaaaaaaaaaaaaaagaacagcatttctgttctttatgttgctaattgatgtgatcttgtttactaacaaaataagaagagtggaggtctcactctgtcacccaggctggaatgcagtgtgcaatcgtagtccactgtaacctcaaactcttgggctttagcgatcctcttacttgagtctcccaaatagctaggactacaggcatatgccactgcgcctggcaagttgtaaaagttttttagagacgggggtctcgctgtgttgcccaggctggtcttgaattcctgacctcaaaccatcctcccacctcagtctcccaaagcaagaagagttgaacatttaaaattgattattatgaaatccttggggttccactttcaaagttattttcatgtttgccccttattttttatgtttctttgctatcctcttaagtattcatcagctcaacatctgtatttcaacagcatattcatagtgtctctgattatggtcttgccccattctagtttatactgatggtgctatcagcactatgtctaaagtcctgtttttattatactgctcacttcctcaagagcctaaagtggctctctgttgtctattgaatcagatggttttttttgtttttgtttttttttgtttttttttgagccaagtctcactctgtcgcccaggctggagtgccatggcgcaatcttggctcactgtaacatccacctcctgggttcaagcagttctcctgcctcagcctcccgagttgctgggattacaggacctgccaccacgcccagctaatttttgtatttttatagagacagggtttcaccatgttagccaggctggtctcgaactcctgacctcagatgatccacctgcctcggcctccgaaagtgctgggattacaggcatgagccaccgtgcctggcctgaatcagatcttaatatttcaccttgctttcactccctgcgatcttaacccaaattagccatattttctactcttccttactctttgctaggaaggctattttctttatgtttctcaactctatctttcagtttatattttgctcatttggttcctcctttttttttttagagaaagagagtttcgctgttgttaacagcccaggctgcaatgcagtggtgcgatctcggctcaccacaacctctgcctcccaggttcaagcgatcctccagcctcagcctcccgagtagctgggattacaggcgtgtaccaccacgcccggctaattttgtatttttagtagacacagggtttctccatgttggtcaggctagtcttgaactcctgacctcaggtgatccgcccgccttggcctcccaaagtgctgggattacaagcatgagtcactgcgtccgccctttggttcctcctttttttagtatcttttctctccctacctcattggctatctaaattatacaaatcctctcagttgtgcataagtcctgctgatagcaattaagtttttctttgcttgttttttttttttttttttgagacggagtcttgctctgtttcccaggctggagtgcagtggggcgatcaggctcattgcaacttccgcctcccagattcaagcaattctcctgcctcagcctccccagtagctgggattacaggcgtgcaccacatgcccgactaatttttgtatttttagtagagacagggtttcaccatgttggccaggctggtcttgaactcctgacctcaggtgatctgcctgccttgccctcccagagtgctgggattacaggcgcccagccttcctttgcttttgaaagacaaagtgaagtcagaaagatcatggactctccggggtcagcagatctgtgactgaatccctccccttccatgtattaacctcgagcaggttattttccctgccgtgtgtaaccccatttataaaatgagtgaaattattaaaaggggatgtttgaggctgggcacagtggctcacacctgtaatcccagcacttggggaggctgaggcgagtggatctcttgagctcagaaatttgagaccagcctgggcaacttggcgaaaccctggctctaccaaaaatacaaaaattagctgggtgtggtggcacacacctgtagtcccagctacttgggaggctgagatgggcaaatcgctgatcgcttgagcctgggaagcagaggtagcagtgagccgagatcacgtcactgcactccagtctgggtgacagagtgagaccctgtctcaaaaaaaaaaaggggggatgtttgaaagtgtctggtatactgcctgcctggcacatagcaggcgttcaataaatggtgacattattattatttttattattttgagatggagtcttgctctgtcactcaggctggagtacagtggcgcaatctcagctcactgcaacctctgcctcccggggttaagcaattctcatgcctcagcctcctgagtagctgggattacaggctcatgccaccacgcccagctaatttttgtatttttagtagagacagggtttcaccatgttgaccaagctggtctcgaactcctgacgtcaggcgatttgcccactgcagcctcccaaagtgctgggattataggtgtgagccaccacgaccagccccagtggtgacattattaatacttgttgaatcccttgccctgcaatagtttaatagttaggtaggcaggctcaggagtcatattgccaggatttgaatcctagatctgcttcttactagctgtgtaaacacattgctttacctatttctcagtttccttattgttaaaatggagttaataatacctatttcatagggttgtgatgattaaatgagataattcatctacagtccctgctacatagtaagtgcttaagaaatgttagctctcattttggtgtatttcctttgaatttataatacaagcaattttccctcacagtttagcacgcacttatattatatattctttaattaattcaagctttttgatattgtcaccccaagcagagagatcactgttagttttgtggagaccatgcattatacatttgtctttagtcacagtgcctggaacaacaatgcatatatagttggcattcaatatgtacttaattgattttattactgctaagtacatttttcttggtcttgagtttgataataatagctatctttaattgagtgcttttatgtgccattgttctaaatttagcttcgtatcatctcatttcatcctcacaacaaccatatgaagattctcttattctcatttttaaggcaaagaaactaaggcatagaggagtggagccttttactcaagatcactttgcttggaagtagcgggaccacgacaagcataggcataagcagtggttttttgttttttgttgttttgagaaagggtcttgctctgtcacccaggatgtgccagtagtacagtggtaccgtcataggtcactgcaaccttgaactcaagggatccccccacctccaccttccgagtagctaggactacaggcacgcaccaccacgtccaagtaattttttaattttttgtagagacgggctcactttgttgcccaggctggtgtcaaactcctgggttcaagtgatcctcccaccttggcctcccaaagtgctggggttacaaacttgaaccaccatgcctggccatataggcggtcttaattcagagctatgctcttaaccattgcatattctgaaactggtatggttaaaggaaaattatacctttgatatttagtatccattttcactttagtctagaactttactgttatggtacagtggctattttttaaagtcaggttgatggacacggtgactcacacctgtaattccagcactttgggagggcagggtgggcagatcgcctcaggtcaggagttcgagaccagcctcgctaacatggtgaaaccctgtttactaaaaatatacaaattagcccggcatggtggtgggcacctgtaatcccagctacttgggaagctgagacaggagaatcacttgaacccaggaggtggaggttgcagtgagctgagaccgtgccattgcactccaacctgggcaaagagagcaaagctctgtctcaaaaaaatgaaacattttttaaaaaaggtaattttcattgtagtgatataaaaacagaatgtaaacctaattttcagagtaaaacactgagatgacttcattttcataatcaccacataggctatcattttctcatttggtgtaaataatgtttttttgttgttgaatttgtttaaaatactgacttagagcattcgatcctgtcaaatgaagagaaatctttttcccacctctgatgatagttactttcaatataatttgactttgatttgactttgctttggatgaaggttcatttggagattcagattctgccgatatcagcttaaagtacaaaaagaattttcagtttagagtagttcctagtgtggatgttagctgtaatgtataacaaattgatttgcttcatactcttttaaaagttttagccaggatatgcttttttaaaatgagaggtcagcgataggagaaattgagtcctagttgtttgttttttgtttttgtttttgtttttttgagatggagtcgcgctctgttgccgaggctggagtgcagtggcacgatctcagcttactgcaacctccgctcccgggttcaagcaattcttctgcctcagccttctgagtagctgagactataggcatgtgccatcatgcctggctaatttttgtatttttagtagagatggggtttctccatgttggccagccttgtctcaaaactcctgacctcaggtgatccacccaccttggcctaccatagtgctgggattacaggtgtgagccaccacgcccagctgagtcctagttttaaaaagaacaaaattgcttacacagaactgaaggacttgtctttacctttggcctagtcatctggtttctaggattatgtaacatttcataggaaatacccaattattttccttcaaaaagttgtagcacatcagtctaacataaaaccttcatttagtagaatgcttggaaaaggagttttctcattaaccaagttagccagaagattcaactcatcctggtaaaaatatttccaaaaagcatcacttggccaagcgtggtggctcatgcctataatcccagcactttgggaggctgaggcaggcagatcatctgaggtcgggagtttgagaccaggctgaccaacatggagaaaccccatctctactaaaaatagaaaaaattagccgggcatggtggcacatgcctataatctcagctactcgggaggctgaggcaggagaatcgcttgaacctgggaggcagaggttgcggtgagctgagatcacaccattgcactccagcctgggcaacaagagcgaaactctgtctcaaaaaaaaaaaagtgtcactttactttttaaatttttattcatttgtctatttattttgagacagagtcttgctctgttgcttaggctggagtgcagtggcatgatcatagctcactgcagcctcaaacttctgggcttgagcgatcctcttctctcagcctcttgagtagccaggactacaagcatgcgccaccatgcttggctaatttttaaattttttgtagaggcagttttcactatgttgcccaggctggtcttgaacccctgacctcaagtgatctgcccaccttggcctcccaaattgttgggattgtaggtgtgagccactgtgcctggcctcacttttctttttgatattttaagtatgctcaagggcaaataaatgtatctgtaaacacgttattcctttgtgtgctttaggtttactgaaagatacatctcttagatgtaaaatacatgagtcattgagttactagttttgaacaaatccctgatgttggtgattatagagggcaatatacaaaaagtcctgcttctctgggttccagtaaactacgacactgttgtccttatgatttgagttttagggtatctgatacctgagtcttgctggaaactttaaagaaaatatcttaatatttaggaatttagaaagtgttaaggcttagattaattctggtgcttagctagcaaatgaccctataatattcccaacacccccacttcctcaacccctccctatctttccaccccccaaatttaggtcatcccaacaaaggaaatcagaaaagtctagatgaagaagagttctccactgagaatatgcagagaacagctgattattaattgattttttcatattctataaaattcccatagctctgtagcttatttaataaattttgatagatgattaataacttgatactttggcatacttctaaagtttctaaggaatgctctactttttaaagacactcaataagaaaagacctatttccttgactttttttgtcagatctacgtttacatgttatcatatattcaaccattttctggatgggtgtgtgtgtgttgggaggagttatacatacacaaaaatgagtagaatgcagtccctgccttctagagggatatagtcagtccagtcctgtttgtaccttgcatttatgaagttaagaaagtcacaggtggaacctttctaagccaaactttcgggttgcaaaagtactccttggttacacagcataattctttgactggagctatttcactgttattgaattttggaattgagcagtggtgggagtacttagagatcatttagttcttacatagttgtaaggatttaatgagataaaataaaaaccttacacaaatagtttaagtattcagtaaatgtcagtgaaatctgaatatcatctataattggtgaaaaagagacccagtcaaatgaaatgacttgcttagtgccctgcatctagttagtcgtcaagtctggcttagatttcaggcctcattattcctagcttatattcttcattcatatcttctgcctcaaagagcttgccagaatggaaaagggaggctaactcaattaatcagtaattgattatgtatcacctgggtgcctggcactctgctgaactctagtgagtacagaggagtgttcccataggtgccagggagctggagaagggagcaggttagaggaaggacatcagcctatctggagcagagacctattaacttaggtatcagataagtagggtggggctaagtggaacactgggaaatctaggcctgccctgtgtgactacattctttttcctgtaagagtcagccttttgagagactgtaatgtggcacattccactgcagttagccctgggtttaaattctggttgtaatgacactctgttcaaaacctaccagtgatttcccacttcattaaaattcaaagtcctcataattgtttgcaaggccctatacaatctgggtccctactacctccttggccacctctctgctgtctcttgctcactctgctctagccaccctggcctccatcacatcaagtacccttgctttggggactttgtactgattactctcttctcctagaatgcttctccccaagatagctgtgtggcttgatctttcactttggatctcagctcagtgtcaccttatcagagaggtctctctgaccactctatataactagtatcctctgcccaccactgtcacttcagctcttaactgaatttatttctttttatactctgaccactctgtataactagtatcctctgcccaccgctgtcacctcagcttttacctgaatttatttctctttataccatttttcactacctgatatgtttattgtctatctcttttccttagaagactctcgaaggcaagtgtcttctaggacatggaatagtgtagagtagatactctactctgaatgaatgaatgaatgaatgagttctgtaactctcaggagcctcattgtgctcatatgcaacaatggaataataatacttacttaaaggattgttggagtcaaataagttaatgcttgtcaagcccagtgtctagtacctcatagtagatgctcagtaaatgaaaattcatgccctctttcataaattatttttatggctgtccagttaatagctttagttgtatcctgattcccatttgacttagataagaaggacataccacatgttagtgatgaagaaaagtggttgtcacacataatgctatcttagcagaatgcagtaattatagtgcttataattggaaccatggaaccactgagctatagtggttcctcacttagtagaatagatatcttttagagaagtcttgtcaaaaggcaaaatttgaattaagtgaatcctatatttctgttataaaactggaatcacatttttgttaggaaaatatggtctcaaaataagatgaaatcataatctgaagtgctaccagcctatatatacttgactcgggaaatgtttgctttgtatccccaacaatgcagtaattttggctagggagaaataacgtgtacttactactaaggactgagttgttccatttctgtttaggaatagaagcacccagcaataagttagaagatttttgcctaatcgttgcttcttatcagatttagggactactggccgggtgcagtggctcaaccctgcaatcccagcactttgggaggccgaggcgggtggattacctgaggtcaggagtttgagaccagcctgaccaacatggtgaaaccccatctctactaaaaatacaaaaattagccaggcgtggtggcacacgcctgtaatcccagctactcgggaggctgaggcaggagaattggttgagcctgggagtcggaggttgcagtgagccgagatcatgccactgcactccagcctggccgacagagtgagactctgtatcaaaaaaaaaaaagatttagggactattagcatgtcattggtattgtaaggtaactggtactcaatacattttagcttacttttttactgatcttggtgaccaaattagggacaagattatgactgtgtcccccaaatattgttattttaaagagtaccattaccaaaaagtaaatttggaacaattaatttttaaatttcaaaattctaataagtgaaggttctttcttgttggacatgggagcattatatgtatactgtttctataatattcacaaattatacaatatacattggtctcctcattttcttccactgaactagtcatttagcaggctggtgtttcacaagtgaaactggcattaatccagagaggatagaaagggctctcacaaagaaagctgaatggctggaagagccttatacttattgtgttatgtgatttcttgaagttctgttgaaacttgatggtaagtgtgttacttctgggcaatgagtactctattcatatgttctgtactccagctacttgtaatagaagacagtgaatgctcttggaaaacaagcaagcaaacaagaaatcatataactaacttccaacctctatgaatgaataaatctcccccaccctccccagtaaccagaaaaagaaaatagaaagcaaggcataaaataaatgaagggctctattgttgcagaaatcagtaagggacaggagtgttcagagtcccaggcaggctggcgttagagtgttcctccttattgatagatgatcagttcctctggacctctgctttcttggtctaggataggagttaaacatccaggattcaaacatgaccattcctagtcttagcaaatatctaggaaaaggtagagaaggctgaacaaaaccatatgtttgactgtattatggtatagacagcacagttgaaagaacatagccattggaatctgatgtactgggcattgaatttttgctctgctacttattaattgtgtatgcttgtataagatacttaatctctctaaatacacttccttacctgcaaaatggaagtatatctactaaggccaggcgtggtggctcacgactgtaatcccaggactttgggaggccgaggcgagtggatcacaaggtcaggaaatccagaccatcctggctaacatggtgaaaacccgtctctactaataatacaaaaaaattaatcgggcgtggtggcaggcgcctgtagtcccagctactcaggaggctgaggcaggagaatggcatgaacccaggaggcggagcttgcgtgagctgagatcgtgccactgcactccagcctgggtgacagagtgagactccatctcaaaaaaaaaaaataaataaataaaaaagtacatctactggagattgctgttgtgaaaattaataacagagtgtatacaaagctcttagtatatagtgcctggcacttagaggtgctcaattggtggtaacccattattagtaataagtatacattgtctttccaaaaatgtttgctatagaaaaattattgtatttgacttgattttttttttattgttgcaaattgatatctggcctagaggcccttctaaaggtgttgaaatttttaaccattgcaataggagatctaggaaaactagcaaattttagggggatgataaaactaccaccttctactttgtgacacagttactctataggagaaaggtgaaccttgtaattagtttttggaggaatgtgtgtgtcaaggttttgatcatagcatggtctctattagttgcatgtattaatacttattctgaatgggaagagaccaggaatcttagaagtagggtactcatgatgaatgtatttttcttttaaataaatctttttcttcctatctccccagctgctcagataaagaatttgatgagccagctaggaactaagcaggactcaagcaagctacaggaaaatctgtgagtaacttcctgacaaggttgggttttgtgagggccatttgaggacacagtgtccttgccagacagcagcttaggtttcaggtctgggaagtcagaatgagaggcagtgggtcatgagataagagctggatctaaaagaggggcggggcaacaaagtatattaatggattgtaatttccgttgcctttcaaagtctttgaactctggttctttctcctcttgggcagtttagcagaacaatttagggaagtagaaaagggaattcgtaccactattaaactatattctgctcacaactctgcctaaatgagcttccttgttggcgtaggactcctcatgatctagtctaactggatttccagctacagtcagccttccatatccataggttctgcacctgtgggttcaaccaaccacagatagaaaatattcagaaaaaaaaaggaaggtctctactgaagatgtacagacttttttccttgtcattactgaaacaatatagtagaacaattatttacatagtatttacattgtattgtgtctggagttagttccttctggtgggttcttggtcttgctgacttcaacaatgaagccgtggaccttcgtggtgagtgttacagctctttaaggtggtgcggacccaaagagtgagcagcagcaagatttactgtgaagagcaaaacaacaaagcttccacagcgtggaagaggatctgagcaggttgctgctgctggctggcgtggccagcttttattcccttatttgtccccacccatgtcctgctgattggtccattttacagagcactgattggtccattttacaaacctctagctagccacagattgctgattggtgcattttacaatcctagctacagagtgctgattggtgcattttacaatcctcctgtgagacagaaaatttctcagagtcctcacccaacccagaagtccagctggcttcacctctaagtattaagtaatgtaatctagagatgatttaaagtatatggaagggggtgctgggtgcagtgactcatgcctgtaatcccagcactttgggaggctgaggcgggcagatcacctgaggtcaggagttcaagaccagcctggccaacatgatgaaaccctgtctctactaataatacaaaaatcagctggatgtgtggcaggcacctgtaatcccagctactcaggaggctgaggcaggaaaatagcttgaacccaggaggcggaggttgcggtgagccaagatcgcaccattgcactccagcctaggcaacaagagtgaaactctgtctcaaaaaaataaaaataaaaataaaaaataaagtatatgggccgggtgtggtggctcacacctgtaatcccagcgctttgggaggctgaggtgggcagatcacccgaggtcgggagttcaagaccagcctgaccaacatggtgaaactccatctctactaaaaatacaaaaattagctgggcatggtggcgcgtgcctgtaatcccggctacttgggaggctgaggtaggagaatcacttgaacctgggaggcggaggttgcagtgagctgagattgtgccattgcactccagcctgggtgacaagagcgaaactccgtctcaaaataaataaataaataaagtatatggaaggatatgcataggttctaggcaaatgttacacaattttatattaaggacttggcaggaggcctggaaccaatcccccgtggatactgagggactactgcatatgtaatcagaatggcccaaggggagcctgagggagagaatagtagactgatagtagggactcctgattctttttatcacatccttttctgctccatttctgcttttagtgctattcttcatctttaaaatgttctgagcaagccgggagcagtggctcacgcctgtaatcccagcactctgggaggccgaggtgggtgggtcacgaggtcaggagatcgagaccatcctggctaacacggtgaaaccctgtctctactaaaaatacaaaaaattagccaggcgtggtggcacgtgcctgtagtcccagctacttgggaggctgaggcaggggaatcgcttgaacctgggaggcggaggttgcagtgagctgagatcacatcactgcactccagcctaggtgacagagcaagactctgtctcaaaaaaataaaatacaaaaattagctgtgcgtggtggcttgcgcctgtagtcacagctgcttgggaggctgaggcaggagaatcacttgaacccgggaggcgaaggttggagtgagccaagatcgcgccacagcactccggcctggcgacagagcaagactccatctcaaaaaatatatatatataatataaatatagtatataaatatatataaaatataaatatagtatataaatatatctataatatatataaaatataaatatagtatataaatataaaatatatagtatataaatatataatatatatctatatatgtatatatctatatatgtgtatctatatatgtatatacatatatatgtatctatatatgtatatacatatatatgtatctatatatatgtatatacatatatatgtatctatatatatgtagatacatatatatgtatctatatatatgtagatacatatatatgtatctatatatatgtagatacatatatatgtatctatatatatgtagatacatatatatgtatatatatatcaagcaatattttttgtttcctaccctagacagtgtgaggtaagagaatgactattattgtgagctttttccagggaaatgtgaaatatctctggatattttctactgcctgggatgttcaagccactgattgggtacctcttgcttttgactccttttttttaaatcctggaggcccatttgcagtacagaaaaaccattaataattagtgtggtgtgttagcccatttgggctactataacaaaataccataaactgagtagtttataaacaacaactttatttccatgatctaatcaccctccaaaggaccccatctcctaatattatcacctcgggaattaggatttcaacatatgaattttgcagggacactaacattcagatcatagcatgtggtttcactgtcgtctcagaaagcctttgtagaaatggctggatagtagaggaaaccacaaatgaaaagagtactttttgtatttctactactttaagttccacttaatatactacatattctttcctcttcaattccccttcctccctactccttttgtatttttaacaggtaaggcttctttgttttggagggaagagccagaaactcaggtataaagagcaggtaggaagccaaggataaggctagaaaagagccagctttttaaagcaagagcatgggattagatgtttggaggttgttccctagggtaggtaggaagctacgcttttaatgcacatttcatctaactgtctgtgcctagattctagtcagtggactgtggcagtcaactcctggacaataagagagttcagtatgtttaaactacttgatttaggtgtgggcggcaattgttctttttatatttttatcagaactgctgatatgcttttcttctcttcccaaagagttaaaattcccgatctgtgctttcttcagcaggctattgaagcagattctttctgctcagtgaagataccttgaagtgggtttgcctgggtaatatttctggaattttgttgtgaacctgggcatctagggactcatttcttcaaatggcccttcattccctacgttatgagacactctgagaacaaagtggttctgtgtataaccctctcaagaagtgacaacatcctgaaacatatcttttctctcttaggcaacagttacaacactccacaaatcagctcgccaaggaaacaaatgaattgctgaaagaattagggtccttgccccttcccttatctacttcagaacaggttggtattttctgttttgtttattaataggaaaggactttgtgttagtagaaaggcagtgtgtagaacaaaaaaaaaataagttggcctttggtgctagatagatagacctcctctgcacctcagtttcttatccatcaagtgggggatatgtgactgttggggcaatagaaagaatgtacacaccagatgtggcaaagtgtctgcgtctggtaggtaatcaatatgtggtggctgctgctattattaacattattaatatattaataaaatggagttaactgaagagaaatctcaacatttgcatctctttggggtttggctagcagttttatgtttgtaggcttcctcctttctcctagttttttttttttttaattattattatttttattgttgttgtcgttttggagacagggtctccctctgtcacctacggtagagcgcagtgttgaaatcatagctcactgcagcctcccacttctgggctcaagcagtcccctcccctcagcctcctgagtagctgcaactacaggcatgtgccaccacacccagctaattttaacaatttttttgtacagacatggtcttgctttgtttcccatgctggtattgaacttgtgacttcaagcaatcctcccacctcagcctcccaaagtgttgggattacaggcgtgagccccatgcccagggttcctagtttgttttgtatccattatctttacattttaatgaaacatctttctttcatgttttgcagttaccttcatgttctgtcatgagttattcacaggtctcactcaggttaaggaactgctcagggaaaaagggttctcttttcaagtcattttcttcagtggccatttaaatcctttagaaacacacaatttttactgagattcattgttcccttaatatgccacattcctgaagtcagatgtgcccctccttcattgtggcttgacttgtcattcatgatctacctcaggtctccagtaaaaaaaactttctccgtctaccttcctattatgatcctgttttgcttttagcttctataccattcgtgggggcacttaacttgtattgctttttaaattttattttatttttgagatagggtattactctgtcacccaggctgagtgcagtggcaatcatagctcactgcaaccttgaactcctgggctcaagggatcctcccaactcagcctcctgagtagctggaaccacaagtgcgcaccaccacacgcagctaaatttttaaattttttgtagagatgaggtcttgctatgttttccaggctagtctcaaactcctgggctcaagtgatcctcctttcttggccttgcaaagtactgggattatagacatgagccactgtgcctgacctttatatcgttttttatgattgaacgttttaaatgataatgtcctatatctgatggctctgaagacaaagcctttcaacttccctgtcgtgggttgtttttcaaagtatgggttgtggctagtggaacatgaagtcattttagtgtattgagatcagcattttaaaaaacttagagtagaagtatcagagtctatattatgtaataatggtaaatattgttatatggaactgttgtttcatacatacatatgtgtatgtatggatggatcatgatgtcaaattcttttttttttttaatttgagacagagtcttgctctgtcgcccaggctggagtgcagtgggataatcttggcttactgcaacctccgcctcccaggttcaagcgattctcctgcctcagcttcccaagttgctgggattgcaggcacccactaccacgctcggctaatttttgtatttttagtagagatggggttttgccatgttggccaggctggtttcaaactcctgacctcaggtgatctgcccagctagacctcccaaagtgctgggattacaggcctgagccaccacacctggcccatgttgtcaaattcttattgtaaatctctgtcaaaaaaaaattgaaaatcactagtttaacctgataaactgttccatgtagcatatctggagttttggcccccacttgcagaagagagaggaggacaagatgctttgtcatcctgctacaaagtagttaccctttggttgtctatatacgggctgtttattctaattattactcatgctgatgtttcagttatgggccatttcccccttgccatccaatatctccaaactgctgccaagttacccatttcttcctcctaaccatgcacttagggaatacacacttgtagacagttttcatagtaacaaaaaaggagttgaagggtctaatgcagagtagtgaaagtatttaagagttaagtagtagcctaagcaaaatataaatagaaaatcaaatctgctaccaaaacaaaattcatcaaacatcttctaaaaccaaatagaagttatttttggattatgcatgctgttgttcctttccattatcttggatcattaagaacacgaactagatctacaaacatactctctctggtgaaatataattccttgattcccctcctcttgttatgctctgtatccttttgtctttctactcttttctcatctaattaatcttagccccatcacccgtcttttcattactatcttatacatcaaaccatactcctactttcagtttttttccatacttatatactatcatcaatgatctagttacccagtccagtggcttttgaggttttttgttcgtttgtttgagacagggtctcactcagttatccgggctgaggcgcagtggagtggcgcagtcgtggctcgctgtatcactgtagcctcaacctcccaggctcaagtgatcctcccaccttagcttctcgagtagctaggaccacaggcatgtgccaccacaccaagctactttttaaatgttttatagagacagagtcttgctatgttgcccaggctggtctcaaactcctgggctcaagcaatcctctctcctcagcctcccaaagtgctggaattacaggcatgaactgccataccaggccctttgtaaagagttttttttttttttttgggacagagtttcgctcttgttgcccaggctggactgcgcaaatggtgcaatctcggctcaccacaacttccacctcccaggttcaagcaattctcctgcctcagcctcccgagtagctgggattataggcatgtgccaccatgcccagctaattttgtatttttagtagagatggggtttctccatgttggtcaggctggtcttgaactcccgacctcaggtgatctgccagccttggcctcccaaagtgctgggattacaggcatgagccaccgcacctggccataaagagtttttattcactttttttttttgagacacagtttcactgtgtcacccaggctggagtgcagtggcgtgatctgcactccaaccagatcagtggcatgatctgcactccagtgagcaaaggctcactgcaacctttgtctcccaggttcgagcaattctcctgcctcagactcccaagtagcagggactacagacgcacaccaccacgctaatttttgtattattagcagagacagggttttgccacgttggccaggttggtcttgaattcctgacctcaagtgatccgcctgcctcggccttccaaagttctgggattgcaggtgtgagctaccatgcctggcctattcactttttttctgtttcctttgatcctcttgcctatcccgtctgccctgaaactttcttcttgccatgattctctttcattgtgtcccccaactctggagatccccaggttgagtcagcctccttcccggacttcatatcctcctaagagtgggcatgccccaaggttgtgccattgatcctcgaattatttcactgtatgctttctccttaggagtcacctgcttttatgacctccctttcacctttatgatcatgacctcagatctttttccaatctaaccccttcacctctaagtgcgtggcccatatcttcaattcatgttctgacatctcctcctgaaataaactaccttcatataaaacttgtcttatactgagtttctcatgtttctcccaaaccccttaactaagttcattgacaatacttaacatcacagaaaagtttgtgccttttgacctaatattctcactcatgctaattagccctaaggggaaaaaaaattctgaaggtaaacacacacacacacacacacacacacacacacagagtctatatactctggagccaaatttcctggatttaaatccatctttgtcacttactgtgtgatcctgggcaaattacatagcctctgtggtgctttggttttctgatgtgtaaagttgggactataataatgcctaatttataggtcattgtatagataaatgaattattatgtaaagcacttacagtagtactggtacaatttaagcactatataaatattagccattacattggggcttactttataatatttaataactgtgaaaaatctagaaggattatttacataaaatttaggtcaacttgatggaatatatgtaagcgattaaagatcatggccgggcacagtggttcacacctgtaatcccagaactttgggaggctgaggcgggtggattgcttgagtacaggagtttgagacccagcccgggcaacatctctacaaaaattagccaggcacggtggctcatgcctataatcccagcactttgggaggccgaggtgggcggatcacctgaggtcaggagtttgagaccagcctgaccaacatggcaaaaccccatctctactaaaaatacaaaaattagccaggcgtgatggtggccacctataatcccaactactcgggagactgaggcaggagaattgcttgaacccaggaggcggaggttgcagtgagctgagattgtgccattgcactccagccggggtgacagagcgagactccctctcaaaaaaaaaaaaaaaaaaaatcgcgccactgcactgcagcctgggtgacagagcgagactccatctcaaaaaaagaaaaaaaaaaaaactcgtgccactgcactccagactggacgacagagcgagactccgtctcaaaaaaaaaaaaaaaaaaaaaaaattagccaggcatcgtggtacacatctgtagtcccagctactcaggtggctgaggtgagaggatcatttgagtctgggaggttggggctgcagtgagctgagatcacaccactgcaccccagcttgggtgacagagcaagaccctgtctcaaaaaaaaaaaaaacaaaaacataattgtgaagagtatggtaacatggaaaatgtttatgatgtatttaaaagttatgataatatttttgcacggtaaggttagggaatgatgtcctccccgttattgttataattttgtttatgcaaaaataaaaatctcagaagaaaagggttgctcatctaaatttgcttttagtattaccatcactcttccaggtttgaaatttcagtcattcttgactttatctctctttccccaccaccagtcaaaatgtttcttaaattcatttctttatgattttattactgatactgtgtcctcctaaccttaaacctagactattgaattagtgttctgtttgacttgtttcttttttccattccacctttgtgtaaacggtgacccaggtctcatcacagactaatttttctaagttactattttgtacccatgatgtttcttgctcaaaaatcttcattgctctttgttctttagaggttgaaccccaaactcattagcttgtttttttttttgtttttttttttgagacagaacctggctcttttgctcagtctggagtgcagtggcgcgatctcagctcactgcaacctccaccttccaggtttaagcagttctcctgcctcagcctcccaagtggcaaaggactacaggcgcacgccaccacgcctggctaattttttgtatttttagtagagacatggtttcaccatgttagccagatggtctccatctcctggcctcgtgatctgcctgcctcatcctcccaatagcttggcgttttgttttgttttttgagacggagtttcacatgtgttgcccaggctggagtgcaatggcacgatctcagctcactgcaacctccacctcctggttcaagcaattctcctgcctcagcctctcaagtagctgggattacaggtgcctgccaccatgtctaggtaattttttctatttttagtagtgatggggtttcaccatgttggccaggacggtcttgaataattcctgccctcaagtgatccacccaccttgccttccaaagtgctgggattacaggcatgcgctactgcgcccggcctagcttggcatttaaaacctgctgtggttggcccctttcttaactttccaattttgtattttagctactctcattactaaacgtgtagttccaaccaaacagtctgtctagagatcctcttcaagttctgccaccatgcctttgctcacactattctcttgcttggatttgccttaccccttctttctgcttattcatgccttcctcttacttcactgtccaccttctcttgaggcctttcttggccgcttgagttcttactgattattcctgccctctgaactcctgtagtaccaattggatatagcagttatttataataactttgttacttgtctgtctatatcctttatttacaaatagacagctgtttgaggtcaggggtgagtttttacttctgtgttcatagaacaggacaatgctgtcagtatgtggtgtgtgtgtgtgtgtgtgtgtgtgtgtgtgtgtgtgtgtgtgttttgttttgttttttcagacagagtttcactctattgctgaggctggagtacatggcatgatttcaactcactgcagcctcaaccttccagggtcaaatgatcctcctgccccagcctctgagtagctgatgtgtaccaccacgcccggctaatttttttattttttgtagagataggattttgtcatgttgctcaggctggtcttgaactcctaggctcaagtgatcctcctgcctcagcctcccaaaatactaggactataggcataagccactgtgctcaacctcagcatatgttttttgagacatagaagtaacaagcttagtagaggtagtctgtagataaatgaagtacttaccaagtctcaaagattttaaaccactaaaagcctgtgaaatgcttctatagtttacagggaagctgtgaattcaatatagatgaatagggttttaacattttagctaaaacccatctctgtttggattcaactggagtccagaggtatttattctcttttatattctccagggcaccaaaattctgaattgcagttctttggagattactttagaagttaaatacaggctgggcacagtgactcacgcctgtaatcccagcactttgggaggccgaggcgggcagatcacctgaggtgaggagttctacaatagcccggccaacatggcgaaaccccatctgtactaaaaatacaataaaaaattagccaggtatggtggtgggtgcctgtaatcccagctcctcaggaggctgaggcacaagaatcgcttgaacacgggcggcagaggttggcagtgagctgagatcatgccactgcgctccagcctgggcgacagagcaagactccgtctcaataaaaagaaaaaaaaaaaaagaagaagaagttaaatgcaacccagttccaggtttgtcagaatgaaagaagaaaaattctgacttggtctatagtattaaccagggacttgagctagcaaagagcaaatttattaatttaaagaagagactatttcataataattttcctagttggaaatctttaaggggtataattttacttttaagggaaattaaaaccaaatgattctgggttaatatgaaatctcaagttcttgcttgatttccttagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgtaagttgattcccaaaagaagacctttgcaatatcagaatgttcttttccaagtttgtgggtttttttctttttctctttgaccaataaacatgtaagttagctgctgtgaaaatggcaggttggtgtaacctatgtaaaaaacatatatgcatgtgatcaaagcctagaaaggaatctgaatgaaggttaagagatataggaggaagaactatgtctaattttctttttcattttgatatattggttttaacgttaaaaacttgaaaataaaaataatgaatctgtttcctggaatataacaggctagtttatttggactagccctctgtttttgaaaaggattttcaaatactggattttaaaaatccaacttctcaaaagtatcaaagattatgaaaatattaaggtaaagcctgagaggtcagcagaatactgaaactgcttttgcattgaatgtctttactgaaggcaaacttgaacttcagttttgatatcctcatggcatggggaggataaaagtcaaagccaaaggtccatgcaagagagagaatataaaagaaggtacaactcaaattaaactgggccctaagagactatatccttagaacattaagtcaaaagtaagctcttctatcccccggcagattacagaaagattgcattagcactgaactgagcagatggaggaggagggcaggagggaggagaaatctagacaaggttaccacaaagtaaccttcttcaggcagattttctgctcaaattcatcctacctgaatggttcagtggtcctggactgggagagccacctatgtgtgggatagaagcaaacacaaattccttctgtagaaagacacctttatcctagccctgaaataatactctcaaataatttttctagggcagtaagtaccagtcactaaaaataaccatgtgtgcaaagaaacaaattactctgaacaagaattagtagaaacaacaatgaagtgaaatatacctacaaagactttttatattagaattataagacaactatacttattgtgtttaaagacataaaaggctgaaaacctctgcaggaaactacacaaagatttgaaaaagtgtcaaaagaatttctaaaatggaaagatataatatagaaatttaaaaacttagtggatgggtggtttaactaaaaaattggttagaatatattatccagcatgtagcatagggggttaagaggttaaatacggaagaaagattatgaaaaatggagaatggagagaaaagatctaacgtagttttaactggagttatagagtgagaatagggcaaacatagaacagaggtgatatttgaagaaataatgagtgataatattctagaactgattaaaaacactagcctgcagtttcaagaagcctaacaaatcccaagcaggataaataaaatctctaatctagatacatcaaagacaaacttcagaccagagacaaagagaaaaatcataaagatagctagagaaacattagaataccttcaaagatacaatagttagattgacagttgacttctcaacaacagtggaagccagtagagtgctatcttgaatgttgatgaaggacaataactgcctacctaggattctaaacccagtgaaaatatatgtcagaatgagggctaattaaagacattttcaatcaaaagagagttttctgtcagcacatcttattgaaggaaattctaaataatgtatttcagatggaaggaaagtgatctcagatggaaagtctgaaaagcagaaagaaatgaagaacaaaaaaagtggtaaagatgtgaaaagactagtcacagggagaagacattgctatatatatttaatagcaaaggactagcatttagaatatataaagaattcggccaggcgtggtggctcacacctgtaatcccagcactttgggaggccaaggtgggcagatcacgaggtcaggagttcaagaccagcctggccaacatggtgaaaccctgtctctactaaaaatacaaaattagctgggcgtggtagcgcgtgcctgtaatcccagctactctggaggctgaggcaggagaatcgcttgaaccagggagacagaggttgcagtgagctgagattgtgcccctgtgctccagcctgggcgacacaacaagattgtatctcaaaaaacaaaaaacaaaacaaaaaaaaccccagaattcccatgaatcaatatgaaaaagaaagatacaactcaatagaacaaaagttgtcaaactttttaatctcaggaacccattacactcttaaaaatcattaaattctgtggccgggcgcagtggctcatgcctgtaatcccagcactttgggaggccgaggcgggtggatcacctgaggtcaggagttcaagaccagcctggccaacatggagaaaccctgtctctattaaaaaatacaaaattagccgcgcatggtggcgcatgcctgtaatcccagctacttgggaggctgaggcaggagaatcacttgaacctgggaggtggaggttgcagtgagccgagattgcaccattgcactccagcctgggcaaaaagagtgaaattccgtctcaaaaaaaaatatcattaagttatcttcttgaatcttaaaaaaaaaaaaaattactaaggacctgtattagtctgttctcactctgctataaagaactgcccgaagctgggcgtggtggctcacgcctgtaatcccagcactttgggaggctgaggcgggcagatcacagggtcaggagttcaagaccagcctggccaacatggtgaaaccccatcgctactaaaaatataaaaaattagccgggcatggtggcaggtgcctataatcccagctactcaggacgctgaggcaggagactcgcttcaacccgggaggcggagattgccatgagctgagaccgcaccgctgcactccagcctgggcaacagagtgagactccatctcaaaaaaaaaaaaaggaagaaagaactgccagagactgggtaatttactttaatttatattgaagtatttaatttatataggaaaggggttttgttgactcacatttccacatgtctgggaggcctcaggaaacttacagtcatggtagaagacacctcttcacaggaccgcaggagagagaatgagtgcggagagaaggggaaagccccttataaaaccatcagatgttgtgagaactcagtcactatcacgagaacaacaaggggaaaactgtccccatgcttcagttttgtccatctggtctcgcccttgacacgtggggattattacaattcaaggtgagatttgggtggggacacagagccaaaccatatcagaccccaaagaagttttgtttatatgagtcatatctattgatgtatactgtattagaaattaaaactgagaaaaattttagatgtttgtttattcatttacaaataatacacttattacatattaacatgaatataaattagattttttatgcacatggggaaagaaggaattaaattagatttttcattttaaaaaattgtgtttccaagaaaaaaaattagtgggcagagtagcattattttcatttttgcaaattttttttattttaatgtctggcttaccagaaggcagctagattttcatagctgcttttgttttttaacctccatactaaagatgtaaatgatttatataacaccattacagtattagaatattctgaatttgactatttacttacttttaccagtgaatgttatactttcatatgttttcatgttactaattattatgcttttcattcagcttgaagaactccctttagcacttcttgtgaggcaggtgtagtggtgatgaactctctcagcttttttcgtctaggattatatctgcttctgtattcagtctattatgatagattgttctggttgaagtatctgaagaaaatccaagctagcagaaatatacaattggaaaaggaatatttttataaccttgttgatactcttctttgatactacatcaaaacttgacaaaagttagttgcattgtacaatctaaaaccattataatgacttcatactctgttacattaacatctgttggtctatattatactttgattggatcttttatccatgcatgatttttatagcatcatgtatttatcatttggatagtattggttccctgagttatgcagctcttccaaatgtcgatacatttcattttacaatataaaaaaatacatatttccatcagtttcaccagaaaagtatttaaatattgggaaactcttacaatggtagatacaagtcttccgaaattttatttttatttttacttgaaagctacatttttgtcattggcaacaaacaccctctgttgttttccttgaagtgacaggctcatacttcttttcaacaagttgtctgccaaatacccatctgaaaagtttatatgtatacgtttatgaaagttttaaagcttttaaataagtttttagtaagttcttataaaactatattgaataagtaaaaatggtattccctaaaaaaagtggctagttcagcctgcagttccattacacaagtgcttttcctagagacagacattgtatttctttatgcagcagaagtactttatgtgcacttcccatttcacaatacagaatagtagaaagatatgtattgaggggtcaaggtttaattaataatttgtatggcttcaagaatacattggcttttaaaatacggtgagtgtgtggtgatgaagaatacaataatactagtgcaattcggtgccactgccttcagccattttatctatctgtattagtccattttcacactgctataaagatactacctgagactggatactttataaataaaagaggtttaattgactcacagttctgcgtggctggataggcctcaggaaacttacaaccatggtagaaagctaaggggaggcaaggcatgtcttacatggtggcaggagaaagagaaagagagtgcaggggaaataccagacacttaccaaacaaccggatctcatgagaactccctcactaacacgtgaacactaacacccccatgatccaatcacttcccaccaggtccctcccttcgcacgttgggattacaattcgagacgagatttgagtggggacatagagccaaaccatatcactaccattgcctttttttaatttttaatttttgtgggcacatggtaggtgtatatatttatgaggtacatgagatactttcatatagtcatgtaatgtgtaataattacaccatggtaaatggggtgtctatcccctcaagcatttatcctttatgttacagacaattcaattatactcttttagttatttttgaatatataattaaattattattgacgatagtcacccatttgtgctatcaaatactaggtcctattcattcttcctattttttgtgcccattaaccatccccacttccccgccaccagtcccccaccattgcttttgctccgtcctgttgatatttacactcatggagcaaataaacacgttagtattattttgagtaatggtcaaacaaatgaaaaggtactcagcttctttagtaatggtgaaattacagattaaaataacaatgaaatactatttcatgcccaccaggagggcagaagtttaaaattctgtgaacactgggagttgtcattatggatatgatgcaacaggaacttttttatctggccggtggtataagttagaacaactactttggaaaacattttggctgtatcttcagaacacatgcagaccttgtgatccagcaattctaccctagagaaacctgtatgtgttataccaggatgtatgtacaagaatgtgcatagcagcattgtttgtagtagtcaaaaattggaaacatccagatgtctgtcaactgtagaatggataaattgtgttatgttcatatactataatatcatacagcaaagaaaatgattgaaccacagttacattcagtatcagagatggatctggcataatctggaatgattcaaaaaaagcactaaagaatataaacagtataattccatttatgtaaagttcaaaaacaggcaaaatgatattgaataagaatatagctcactattcttaaaatgcaagaaaatgattttcacaaagtcaagataatagatactttaaaagggagggatggagttgtgattggagaagggcacatgagtaggcttttaggactctggcaatgttatttcttgatctggggaaaaagataaagtaaaaagaaaaaaacaaaccaaaaacccacagtgttcctctgagtggatagaaatttgaaattcttttcattttgcttgtcctgtattgctattataaaaagggtaagctttttaaaaatgaaaatacattgatttttaccatttttgctttgttttttatttatttatttatttatttatttatttatttatttatttattctgagagggagtctcactctgtcactcaggctgtagtgcagtggcacgatcttggctcactgcaacctctgccttctaggttcaagcaattctcctgccttagcctctcgagtagctgggattacaggcacccaccaccatgcctggctaatttttgtattttagtagagacggggtttcaccatgttggccaggctggtcacaaactcctgacctcaaagtgatctgcccacctcggcctctcaaagtgctgggattgggattacaggcatgagccaccgcacccagcctgtttttaaattataaaagtaatacatccattagactgattttttaataataatgatatttattcttacagcttgattataaagcatactttttcctcatcaaacagtaacacctgaaagattcgattgctagtctttcaccaaatgccaaaaatcctggtgaattctcttttaaagtagcactatatgcttgcctaactttcttaattcaatagtattagataaattaccattggaaagactatttttcaaaaacgttattatatgccaaagaggagactatgataaatcagagttattgtaagaattaaacaaaataatatacagaataatagttcccaataagttctgttaaatcaaaatctgccacgatttgaagcagccttcttgaaaataaaggttagtgggctgggcgctgtggctcacgcctgtaatcccaacactttgggaggccgaggcaggcggatcacgaggtcaggagtttgagagcagcctggccaatatggtgaaaccccgtctctactaaaaatacaaaaattagctgggcgtggtggcgtgcacctgtagtcccagctactcaggaggctgaggcagaagaatcgcttgaacctgggaggcagaggtggtagtgcagccgagatcgtgccactcgatccagcctcgggaccagagtaagattccatctcaaaaaaaaaaaaagaaaagaaaagaaaggttagtttatgtgtgtttatgccaaatcccatctctccagagtttaatatatattgataatagattgattagcaacgttctcaaagatctcatatactcttttttttttttttttttgagatggagtcttgctctgttgtccaggctggagtgcagtggcgcaatctcagcttactgcagcctccgcctccctgattcaattctcctaccttagcctcctgagtagctgggactacaggtgcccgccaccacgtccagctaattttttttgtatttttagtagagacggggtttcaccatattggccaggctggtcttgaactcctgaccttgtgatctgcccacctcagcctcccaaagtgctgggattacaggcgtgagccactgcgcccggccagatctcatatacttttgaccacacatcagtaaaaatcaaaaaaaccttaggagaaaaaaaggtaacaccatttacattagactgatttttgaagtgaatctgctttagtgcctactgtgctatgtccatttaaaaaatttttacatgttctgaaattttgtattcttgcaagtttatctacctccccctaaattttaaaatattttattgttgttatttttatttttagccctttctcctacgcatattattctccaccctgttcagtatggtttctgttcaggactcaaactggaatgcagattttcttcaaccactttacacccacttcttagttgagacagattgccagagtcctatgtaatcttacagattctgtgggtgtcaaaggatgttgcttctttatactgtgctaaggaagcccttgttttgtgtgtctgtgatgtgtttctggatgacagcagcaataataccatctactttctaggcagaagagaggcaaagagaggagcagctggtctcatttgacaggtaatagaattattcatacaacctgctggatagttgagatgggaatctatctcgttatattttaattttaaaaatcaatgaaaaaatagagggcaaaaataagggggcacctggagtggataacataatccacagaataaaattaaaaaggcaaaaccatgggcttttccaagctctttgagttattggaaggagtaatttcaaggtgaataaaaacttccaagaaaccattgatgtctatgtgttaagcagagagcttgactccctaggaataagtatgaacctacatgtctacagattaggaagtctaagtcatcttacctctaatgcagatttaaacccatcagagttcttgggtctctactcatttataaaatggaagcaactcatccttctaggagtattaagagggaaaccagacaatttgtatctgaatgatgttcttaacttctccaaactaatcacatggaagtgtatttgtggtattagttcagaacttgatatgttttagcatagatacacatccatccctccccactacactatgagcacctcaaaggcttggggactctgtcttacttagttttgtatctctagcacgaagaggacgttatttaaacattgtaggggtgaagtatgatttatgatactgatgggaaaacacataataatggaaaatttcaaagtgttttatatctagtataataagtaatatgttttccttttaaatgcttgaaaataaagaggcgttggggcatggtggctcaagcctgtaatcccagcactttgggaggccgaggcgggtggatcacctgaggtcaggagttcgagaccagcctggccaacatggtgaaaccccatctctactaaaatacaaaaatgagctgagtgtagaggcaggtgcctataatccccactactctcgaggctgaggcaggagaatctcttgaacccggggggcggagtgaagtaagcgccacttcactccggcctggatgaaagagcgaaactccgtctcaaaaaaaaaaaaaaaagccaggcatggtggctcaagcctgtaatcacagcactttggcaggttgaggcaggaggatagcttaaagccaggagtttgagaccagcctgggcaacaaagcaagacccccatttctaaaaagaattttttaaaaagtgttataacatttcactagctttctgttaagagggttttttatggattgttttttaatagagatgagggttttgctatgttagccaggttggtcttgaactcctggcctcaagcagtcctcctgcctcggcctcccaaagtgctaggattacaggcatgagccaccgcgcctggcctgttaagaggtatttaacccaaagcataaccccaaggaaattttggaaaactaggagatgtgattctgttgaactaactggcaaagcactgataggtcacttagcttgctcttctccacccacttagtactgaaggtactaatgcagcttgcactttgagagtgccctggaagatgatggtgcaacataattcaatgagttcaaatctctggctactttccttgtctggcaagccccagtgagattacagagtatacccctaaatggaaacagccaggagtcccatccgtcataattctgccacatgtcagctttgcccatggaagctgagtctttgttttcctgatatcatcagctctttgcttctggatatgaagaatgtggccctccaagactttattgatagcagaggactggagccctggtaatgtctttgcataggttctgctggcagtagagatgttggagatatgtcttgttatgcctttgagaggagaaatcacctagtgtgcctgtttccctgcagccatgaggagtggaaccagatgcagagccaggaggatgaggtggccatcactgagcaggatttggaacttattaaagaaagagaaacggcaattcggcagctggaggtgagagccacgtcatgttttttgtttgactcagtgtgtctgcaggtatctgaactccttagttcactttaattctcttagtgattatgaaaaggcataaaatgtgtcattgtgtgatttgtattttttctgtctcagtgtaatcatggtgggtttgaactaccggttttttttgtttttttttttatcttggatggaatttcgctcttgttgcccaggctggagtgcagtggtgtgatcttggctcactgcaacctctgcctcctgggttcgagcgattctcctgcctcagactctcgagtagctgggattacaggcatgtgccaccacgcccagctaattttgtatttttagtagagacggggtttctccatgttggtcaggctggtcttgaactcacgacctcaggtgatccaccctcatcggcctcccaaagtgctgggattacaggcgtgagtcaccgctcctggcatgaactactgttataatggcattggccttggtgcccaggagtactcaaatcctttcctcaatcaccacatcttatacggatcaccacatcttatttctcctggagaaatgtacatggagaacagaacaaggcagacagatattttattgctcattagaactttgacctcaaatctcaatgccaacctccgggttaggcaggactccatggagagcccctttgcttagtctgaagagcccagaataaaggcaggccaaaagtcttgctccatttttgtatatcctaaagtctaatcccaagttgtacatcttatcccttcagtgagtcagagaaataggaacagtttttgaggtggaggttgagggagaagtctgtaggcctttcttacctaactgagctttcaactttaattttgcacagtgactaataaaatatccttttttttttttttccgagactaagtcttgctctgtcgcccaggcaggagtgcaatgacactatctcagcttactgcagcctccctctcctgggttcaagtgattctcctgcctcagcctcctgaatagccgagactaccagtacgcaccaccacactcggctaatttttgtatttttagtagagacagggttttgccattttggccaggctggtcttgaacttctgacctcaagtgatctgcctgcttcagcctcccaaagtgctgggattactggcatgaaccactgtgcccagctaaaatatccttaaacctgagttttctccagtttagttttctccgaaggtagaaggctgccattgctgggatcaggggaggagaaaaggagagagggaaattttgagctcttccttggcctccatctgtagcagtggttctgaactgtgagtgcacatgaggatcacctggagaagatttttttttaatgccccagctctcatccaccactaattacctgatgggataatgtgaaattcctgtttattatatgttaaaaatgggcaaatatccattattttatatggttcaaactaataaatcataatttctgggcgtgaggccctgggcatgggtatttttttaaaaagttcccccaggtgattataatatgcagccagggttgagacccactgccctaaaggccatcaatgtctgtttttatctatttattatttattttttgagtcagagtcttactctgtcacccaggcaggagtgcagtggcgcgttcttggctcactgcaacctccacttcctgggttcaagcgattctcctgcctcagcctcctgagtagcaaagattataggtgcccgccaccactcctggctaatttttgtatttttagtagagacgaggttttgccattttggccaggctggtcttgtctgtttttagatgggatagtttatccttaagttatgattattttattgccttcaaaaatgtcatatctttactctttttcacctactgctactactaattgaattaattgtctaacattagaaatatggctaagtgcaatggctcatgcctgtaatcccggcaagttggaggctgaggcaggatgattgcttgagcccaggaattcaagacagcctgggcagtgtagcaagaccttacctctacaaaaaataaaaaattaaccgggtgctgtaacatgtacctgtggtcccagctactcaggagcctgaggcagaagatcacttgagcccaggagatcaaggctgcagtgagccatgatcgtgccactgcaatccagcctgggcaacagagcaagactctgtctcaaataataataataatccttccttcaaagaaaaattactagccgggcgcggtggctcatgcctgtaatcccagcactttgggaggctgaggcgagtggctcacctgaggtctggagttcaagaccagcctgaccaacatggtaaaaccccgtgtctactaaaaacacaaaaaattagccgggtgtggtggtgcatgcctgtaattccagctactggggaggctgaggcaggagaagtgcttgaacctgggaggcggaggttgcagtgagcaattgcactccagcctggcaacagagcgagactctgtctcaaaaaaaaaaaaaaaaatacagttggccctcgatatatttaggtttcacatcctcagactcaagcaaccgtggagtgaaaatatttaaaaaaaactaaaaaataatacaacaataaaaaataatacaaatgtaaaaaccaatacagtgtaacagtattttatataacacattgtattagttcagtacattactaatacaatgtaagtgctatgtaaaatagtaatgtagtataaaatagtaatgtaacattatataagtaatatagagatgatttagaatataggagagaatgggcacaagttatatgcaaatactatgccattttatatcagtgacttagagggagggagtcctggaaccaatcccccacggataccaagggacgaatgtaccgttatagcaaagtggagtgagacatatggagctaaggaaagaaatgtaatggatgccagggtataatggatcatttcatattcaacagaggaaagtccaaattccttagcctaggttcaattttcgtatctagtaatttccaaactctgacatacacattctatgttatggcaaagctaggttatttgctctttaactgagttgcctttctgttcatatgacctctcctttgctttaaggcacaactcatgtcttacctcttctgcagagtcttccttttctccacacctttctataccattaattcagccatttcctatatagtactcttccttcttatttattttattgtgcacttattccccacgtccaccccagttagctgtattcacagcaactagcagactaccccaactatggtagactcttagcaagtgattgaaatgctgacaagacttgctttagcagatagtccactatagtagactcttagcaagtgattgaaatgcttgccaggttatgattccaataacccttcaaacctggaagggaattgccctcaaatttccatagggtcatgccccatatgagcacccctttaataagacaggtttccattgtctttcttctgcctgatcatgagtcagaaaaactcaaatataggccagacgtggtggttcacacctgtaatcccagcactttgggaggccgaggcaggcggatcagttgaggtcaggaattcgagaccagcctggccaatgtggtgaaactctgtctctactaaaaatacaaaaattagggccgggcacagtacaagctcacgcctgtaatcccagcactttgggaggccaaagtgggtggatcacctgaggtcaggagttcgagaccagcctgaccaacatggtgaaaccccatctctactaaatataaagaattagccaggcatggtggtacatcctgtaatcccaggtacctgggaggctgaggcaggagaattgcttgaacccaggaggcggaagttgcagtgagccgagattgcaccattgcactccagcctagcaacaagagtgaaactctacctcagaaaaaaaaaatagccgggcgtggtggtgcacgactgtaatcccatctactggggaggatgaggcaggagaatcactcaaacccaggggatggaggttgcagggagttgagattgtgccactgcactccagcctggatgacagagcaagactctgtctcaaaaaaaacaagtaataaataaaaataaataaaaagaaagaagggacggaggctgggcgcggtggatcatgcctgtaatcccagcattttgggaggccgaggcaggcggatcaggaaggaagggagggagggagggatagagagagaagggagggagggagggaggccaggcacagtgactcatgcctgtaatcccagcactttgggaggccaaggcagtggatcacgatgtcaggagttcaagaccagcctggccaacatggtgaaaccccgtctctactaaaaataaaaaattatccgggcgtggtggcatgggcctgtaatcccagctactcaggaggctgaggcaggtgaattgcttgaatccgggaggtggaggttgcagtgagacgagattgtgccactgcactccagcctgggtgacagagcaagactctgtctcaaaaaaaaaagaaagagaaaggaaggaaagagagaggagaaagaaggaagggagggagggaaaaaaggaaggaaggggagggaggaaggaaaggaaagggaagggagagagagagaaggaaggaaagagagggagggaggaaggaaggaaggaaagaaggaaggaaagaaaaggaagaaaaaagaaagggagggagagaaggagggagggagggagaaagacccaaatataggggattttgccaatgttaaattcttccactgctgttaggaaaacaagctgcagttcagcccactgagctgatttgtgtttaccttctttgatcagagcagtaaataggttgtagtccattcactttggaactgctatccacagaccatcagctttttgtcagtcagttgggagttaccatagggcattgtccagtgatgacagaatccagcaactcctcacacagttccagagtcaatcccaggggaaaagaggctccttacttgtagctcctccttgcattcctcagatagcatgatcttgtataaacatttaaattctgtagtccaaagtcccagtggttgtcatcgggaggcactcaacaggcttttgtcacaaggcctagcagtctccacatagggctatcacaccaagaatttgtctatatcagcactccagccttctgctgtactgtttggacttgggcgctcttactggttctcatgtagcatgtcccattaatgttgcttgaagagtgagtttatgtgccttctgttttacaatattgggtaggcagcaatagattattttctgtttatggagaaagcatgctttgtagagccttaaaaacacacgtgttaatagctaaaactttaggtacgtgagggaaacaaatcttctaacatgttgcttaatgttagttaattgttttttgtcttccttaggctgacattttggatgtcaatcagatatttaaagatttggccatgatgatccatgaccagggtgatctgattggtatgtattattgatacctttaacctcaaggtgagttgatagtatttggcatgcatctgtaatcccagctactcagaaggctgaggctgaagcaccatctaggagtttgaagccaacctgggcaacataatgagaatttgtctcttaaaaaagaaagaaagaaagaaaaaggagttaggctaggcgtggtggctcaggcctgtaatcccagcactttgggaagcccaagcgggcagatcatgaggtcaggagatggagaccatcctggctcacacggtgaaacccgtctctactaaaaatacaaaaaattagctacgcctggtggcatgcacctgtagtcccagctactcgggaggctgaggcaggagaatcccttgaacccaggaggtggaggttgcagtgagccgagattgcgccactgtattccagcctgggtgacagaatgagacttcgtctcaattaaaaaaaaaaaaaaaatggagttagtcatatcagctatagagttaaagtatgtttaggaatgccgttttaaaaattaccaaatttatttttcgtagcaatttttttatgttatcaaatgtagaagttaaatgaggcctcatgaatactcagtcccattgacttctttgtacatctttgtttagagaaatagctctcagcttcccagcttttatctcaacaaacttgcaaaattatggggttagtaaccctttttttttttttgagacggagttttgctgttgttgcccaggctggagtgcgatggtgcgatcttggctcaccacaacctccgcctcctgggttcaaacaattctgctgcctcagcctcccgagtagctgggattacaagcatgtgccaccacgcccgctaattttgtagttttagtagagacggggtttctccatgttggtcaggctggtcttgaactctcgacctcaggtgatctgcccgccttggcctcccaggtggtgggattacaggcgtgagccaccacgcctggccagtaactcttttttttaaagctttctatgtggaaataatttcgagtttattaaaagttgcaaaaataggctgggcatggttgctcacgcttgtaatcccagcactttgggaggctgaggtgggaggatcacttgaagccaggagttcaagactagcctaggcaacatagtaagaccctgtctttaccaaaaaattagccaggcatagtaacatgcacctgtagtcctagctactcaggaggctgaggtgggaagatcacttgaacccaggagttggaggctacggtgaactattattgtaccactgcactccagtctaggtgacagagtgagatcccgtctcttaaaaaaaaaaaaaaaaaaaaggtagcaaaaataaaaatattataaggaccttctttataccctttacccagatttacctcttgttaacattctaccccatttgctttattatgtattctttctctctttctctatgtgtatctacataattttttatgaatcatttatgggtaagttaaatacttcatagcccccaaaaattcattgttttttctccaaagaaaaggctagtctcttaccaaggtagtaactcgatttcatggctggatagtttggatagtggtagtgaaaccaggacatgtaacatcagaaatctgttcaatttgcagtcttaaaacatctgagtgtgttaaaacatcctctgtccttccttttgcagatagcatagaagccaatgtggaaagctcagaggtgcacgtcgaaagagccactgaacagttacagcgagctgcttactatcaggtaaaagcgggtaccaaagaaagtcactctgtgttgcagactttttaggccatcagagtacattgacatattgagaacagctacagcctttgcttaggtttaagctaaaggaaagtagtcataattgcagtcccagttccatttttattattttcctttgcagatagatctacaaaaaataatcacaccttgaataaacttatcagaaggctagtaactgcaaagctaaccctatacactaatatgatacctaaatctgctatgaggctgttttatatcccgaacagctgaatgtatttcaattaggatagtaagaagtacagttaaagtagaagacttcatagattctttatgttgagtgttgccatagaggatggacatagaatcaacttcgactgctatttatatatgaataaataaggataatcattctggaactgttcctgtaaagtgaaatccttctacatgttagttgaaactctggtttttttacttatccaagtctttatctcagtgtacaaataatgtgaatgaagtctttctcacttcccttcaatttggtgttgcatggctttttagaaataaatagcatttcatgtccttcgcccactttttgatggggttgtttgtttttttcttgtaaatttgtttgagttcattgtagattctggatgttagccctttgtcagatgagcaggttgcgaaaatcttctcccattttataggttgcctgttcactctgatggtagtttcttttgctgtgcagaagctctttagtttaattagatcccatttgtcagttttggcttttgttgccattgcttttggtgttttagacatgaagtccttgcccatcctatgtcctgaatggtaatcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacagtgatagactggattaagaaaatgtggcacatatacaccatggaatactatgcagccataaaaaacgatgagttcgtgtcctttgtagggacatggatgaaattggaaatcatcattctcagtaaactattgcaagaacaaaaaaccaaacactgcatattctcactcataggtgggaattgaacaatgagaacacatggacacaggaaggggaacatcacactctggggactgttgtggggtggggggagggatagcattgggagatatacctaatgctagatgacgagttagtgggtgcagcacaccagcatggcacatgtatacatatgtaactaacctgcacattgtgcacatgtaccctaaaacttaacgtataattaaaaaaaaaaaaaagaagaaatagcatttcagttgttttccgtgttcctgggatagctgtattttacctgggagtgctcgtaaagaaattcgtatttaataatagtgtttcctttaaaaactaggtgattaatttagtgtccaacagtaaaggaataattaagtaaattatatacatccactcattgttgcatatgggaattaagagatgtttctgaagagtttaaacagaaaaatgtttatactaaacattaagtgaggaaaaacatcaaacatcatacaatgtgatccagttatgtcaaataatatacatagataacaaatcagaaagaaatacaaaaatgttgacggtattatctatgggtgatttttttttctccctccgcttgctgtatttttttttttacaatgaacataacagttttatacgtattataaaatgttattaaaatacacatgcacaaataacttattttattgcaaataatgcctggcagcacaggtatagttcctttgcaaaattgtatgtggggacttggaattaaaactttgaaacctatactactcggctgggtgcggtggcccacgcctgtaatcccagccctttgggaagccgaggcaggtagatcacttgaggtcaggagttcgagatcagcctggccaacactggtgaaaccccgtctctactaaaaatacaaaaactagctgggcatagtggcacacgcctgtaattccagctgctcaggaggctgagacattagaatcacttgaacctggaaggtggaggtttcagttagccaagatcgcaccacggcactccagcctgggtgacggagtgagactctgtctcaagaaaaaaaaaaacaccaaacaaacaaaaaacacttgcactactacctagtgctgctgacttaagatttctgggaaagtctgtgcataattttgcatggatagagttaatctttaattacaaggaggcagatttatgaagcattcttagagtcttacacatacaaattttacttgtttcatgagtatcttgtttacatatttctttcctcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgt

SEQ ID NO: 37621 - DNA, 88100 bp, Homo sapiens
atggagttccccgtgcgggcaggcgagcccgcgcttctcccgtcccggggtggatccggcctcctctgtcctcctccagggccagctctgggggccggcgcgtggggcaggtgcgcggggcccgggagccccgcgcctttcggggggcggggagggggtgggacgaggggctagggctggggctgcggcccggccggccgaggcggcgcagggagcgaggccggcgcgcagggccaggccatgagccgcggccccgccgggtaggtggctgtgggcggggcagcggcccggacccgcaaccgtgcccagacccgcgcccgcgccggggctcccatagaccccggggccggggccggggccggggccgggcagggtccgccgagctgtcgcgccctcccgccgccggcccgggcgtctggacgcgagcctcggccagggggcgtccggggaggcccgggagggtcccgggctggtgggcagggccgggggcggcggcgtgggggcggcaggggccgcggcgggctcgggcgggctcgggcgggccgggccgagccgccgagaggggatttggaacaaacaacggcggccatgttgagagcgcgtcggggccgctaaacttcccggcctgcgcccgcctcaccggccgcctcccctctcccggccgcaggatgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtccagcgtgcggccgcagagcaagaggcccaggaaggatcctccgagcgctgtggggagcggcaacgccggtggctcggggccccgcggaaaaggtagggcggcccgtccccttgggagaccccagcccctctccggggtgtgccgcgggggagaggaacccctcgccccagccgggctccaccctagctcacccatcccgcggcctacactgaggctctcaatttgggtggcacttatggggcatgtgtcccctctctccttcgaagaggctgcgactttctatatttaaactctttgaagaggcagtgagtatccttttttgggggggagtcgaagagatcccttaaagctgtttcctttccaaaggatcactgatggttttctatggttttgtgtttcaaacagcggacaatagttcggaaacgggaagagaaaaaaatacctgctgtatctctttcccagacatcaggcggtggaaatgcaccaagggagcaggcttttgaaactcattggggggaagatgggtaagaagcggagaaaggatccttggggtctgacttggacccattgtcctctccttcaagtgctcctgggttgagagtaggaagggcatagagatggggccctttgagttgcaactggggtttacttctgtgccaaagaaaggaaagagtggtgaaaacgattgacatgaacaagcagcagcttgtagtgttcgcccttgtattctgaggtgatggagaatgttgctacttagctggggtctcttaccaagatagtaagaaaacggcatgttagtttcgttctccatgtgccagtgcttcattgttgtctgctcttatttctatttcagtcttgtgcttttccttacgcaggtgaatgactctgattctttttgtttccgaccatgttcgcagcactttgtataaatagcaaatataacatcagcttccagtgagtttcacgtgaaaaaaaaatctttcacttccttccttgggaaatgctcgtttacatttagtgaatggtcctggtagttttgacaaggaaatatattacgaactaatggagaacctgctttggagatctgtgccacatgtgttccattaagcccacttctcctgccgcattctcaaccgaagaaggctggcctccggaatcatggccttactcattggtaaagaattctgatataagtatacttatttaaagatgtaaatagaaggtaacttagcatgtttcagaatttaaaacttgcctcatatgaatttattttgatgtgaaagttgctgatcaatttggaaaacatgagtggctttgcttgttactagttttttattgctagttacaggtatgtctaagctcatataagctccatggttccttcaaaggtttgttgttcatggttcagaagccctggaccttgaatccagccggcattcgtcccccatgtccctggcctccaaccttgctctgccccttcaccctcttggagatgcttttctgtcgggtgtcctcacctgtgaggcaaggaatgagagcagctacttcaccccgttgaagtgcggctgctaaaatgaaatagtgcattggtgtgaaagcactctcagacgtgtacgtggctacttgtatgtataagtgaagtgctgctgagacgttagtgatcaggtcaatttttggcagttgggacgaggggaggcttgcttttgtttgtatagttgagagtggcttgctaaggtgcagaaggtttcctgagcttggctcacacttaggttgctggcacttctttctttgcttcttgtcccattgtgtggcttggagaagcgtgggacttttcattaagttttaatattaataaaatgcaaatttattagaatttgtgctcctcgtgacatatccattatcccactttagcaagcaaatatatcttttttttttttttgagactgagtctcactctgtcacccaggctggagtgcagtggtgcgatctcagctcattgcaagctctgcctcccaggttcacaccattctcttgcctcagcctcccaggtggctgggactacaggcgcctgccaccacacccagctaatttttttttttttttggtatttttagttgagacggggtttcaccgtgttagccaggatggtctcgatctcctgaccttgtgatcctcccgcctcagccccccaaagtgctgggattacaggcatgagccaccgctcctggccacaagcaaatatatctttaagcaaataataagctaagctgtgatggtggcttttaggagaggagtaggaagtgggtctcctttgcatcacagaacttctcggccactgtctgccttggagcttcccgggaaggaaggctgcctgtccgctgctctctgctttcaggttcctcagtgctttgggaggcacttcactgtgcccaggacatcctctgacaccagtctttggagagacctctgctcagtcgttgcttccattacccgtcagaaaagaaggccaggtggtggcagttgccccgcaacagtctttagctcaccttccagaaagatgctcagaggagaatcctcttacattctggagaaatctgcatctggagtggtgagcatctgtcagggaggaaacgatcaatacttcatgtttcaatttttcacttggaaatgatgtaacttctattatgcctaaggaatacttagctcaatcactggcagttcctttggttgattacttactgccctggccagtttcaatctcagtgggcctgagactcttacagtgaatttggaagaaaggacttgtggagaaaaggaaagtctgcttgtttggcttttctgcatgcaagtgtgttttctttctctgaagaagacactcttattgacttcaatgaaaaatgcttttttttctagttcagtttcaaatttaaatcttcttgcattgataaagcgatggtagctgggatttagtgcctgtttgccaggcatcttgcatgtctgtaattttgcttttaaatgagtgcagaacctgaagtagattgtttaagtcacatgctcaacctaaactcaaggtaagctgcagaccagaaatcccaaaacagacattcctgcagctctaatacaccacccacgtgaccctgggacgcactggagatttcggcttagagccgcagaaaccatctgaaagacataagtcaggagacagagtcctgatacctttccctatttggccagttcatgatccagctagccctgggcaaactagtccatcttttggataaaataaacacctgcctcagaatcgcttgaacccgggaggcggaggttgcagtgagccaagattgcgccattgcactccagcctgggcaacaagggtgagacttagtctctaaataaataaataaatataaaaataaacacctgccttaagtcacaaggtgttttacaggcacctggtgtttctgccatgaaaaatgcatgcagcttcaagattacaggactgcaggaggaggctgcacaggctggcggggtggggagcctacctgtggggtgagtagaagtccgggaatgctggtgctctgctggggcagatgggatgagagaacactgggggtggggacagagagcctctgcttattttggtccccctctcaccccgaagaacttcagttccatcaaggatggggaaatgcaccatctccagaatagggtaatgtagtctgaagtgacagtcgtttgtgtgtaggaatcggtaaacgactgtgcacaatttactctttatattttgtataatctgtggactgtttgtagtttctagatgtttcaaaaagatgtctcataagagattgtacctgtagtcctagctactcaggaggctgaggtgggaggatcacctgaggctgctggttggaggctgcagtgagctgtggacattgcactccagcctgggtgacacaacaagaccctgtttcaaaaacaaaacaaaaccaaaaaagataaagtaggtaaggcaaaatttgaacattggtttgaaggctgagctgcttttcaaatacctgtatacttttggtattaaaactagtttctgtggtgtctgttgttgtgaagttgtctaatgaggtagacttttcgattttcatttttgtatcttattgtggcttatgtaaggatataacagggagatgattcatgattgcaaagtcagaaatgtgaaaattaacatcgttgtataaagtggtgtgtagaagctctttgtcacataagtaacaacagcggggttttgttttttgtttttgttttgtttttgagacggagtctcattctgtcgcctgggcttgagtgcagtgctgcgatctcaactcactgcaatctccgcctcacaggttcaagcaattctcctgtctcagcctcctgaggagctgggactacaggcgcatgctgctacacccgactaattttttttattttagtagagatggggttttaccgtatggcccaggctggtctcgaactcctgagctcaggtgatccgcctgcctcggcctcccaaagtgctaggatttcaggcgtgagccactgcgcccggcacaacagcgtttttaacactaaagaaccacgttagaaacactgaaaaaaggagacatttccaggagtttgtagtttagttgggatatcttgcaatacctacaggatacaattagaaaatctgctggtatttcatgaagagggcatacgcttttatacaaacagtggagttctagttgtatttctctcaaatatttgtaggaggggaaagggagaatcttcaagagagacagcgctggtcagagcatgcaggaggacgctgagccttgcaggcactgagggtgggagtcccggcagagaaggggacagtatgagtgactcccagagggtgtcgtggagaccattaggttttaggtcagcttcagaacctggaagaggacatctcagagtctggcgaccctgaccagggctcttgcaggcacgcctggagtgtggaccagatctttagattgatgggacaatgcgaggtcaggaggggtcccggtttgctcaccgactgcctgtcgtataggatggagcgacaccactgcgtgtgcatgacgatggagctgggtaggggaggctcagaactcatccgagatgacaccttgcctgcggcttggcttgcttgaagggtccccccatgtgaccttggagatggtatccaccaagccctcacccacaactctggctccaagaccagagctgctggcaccagcatctgatgcgatgtcttgtgttaggagaggcacggaatgcctcaggagacttggaggtggacgcgttggacctctgcagtttctgcgccatccttggcctcctgggaagggtccctgctgtcttatgctgcagacgtaggccatgaggacgtttcccggtgctggggttggggcacggtcaagtctggagatgcccttccacgagcgggtgtcgccagtgcctttctagctgagaaatgagtgaagcatgggggagacgggtgtgttcactgcagtcctctcacctccagaccagacgctgactccctcgcagttggtgttctgtcactcttgattttactattcctaaccctctgaaggaagttcaccaaaccacagaaagagtgctccaggacagtgaattgatgttagagatgatgacagggtgtcactgggcttctgcgtctgacctctcacgtccagacagacatcttccaaaggcccagctctggctgtctattagccgcgtgcctttcggtgagtcatttaacttctcacctttcccaggctgagggagggactttgaggttggtttcccccaccacgaccctgatcctccagctctgtgacaggacagtgtgcgctgcttggctttcagagctgttctgacggcacggcatgggaaacgcctgggtttggagtgagaaggttgcgtggttcttgctgcctggtgacttcggggcttctaaagcctcagtttcccccatttcatttttttttttacatgacataatgctattaataatttctgaaagtttccccatttctaaaatggagataactacccattgcgaggacaggaagaagcagggcatttgaatgcattttaaggtgccatttaaatacaggttctgttacttccaggcctgctgggcactgagcagctgtgtggctttgtgggtgacctactcagcccgtgcctcagcttccccagttgaaagatatggatactttttcttcttaaggtgatatgaaggggtgcaggtggtggcattccagaccaacccaggacatgtgatggggaagaggacgtgttgcaaagaataggtggtagggcctgtctggagctaggtagaggggccagcagctgggagggtgcgctggggccacatggctgtgccctcactgcaccgtctgcacagcaggctgtggcaggtgctaggggtttgggagacctgagaagaggctgttgaaattgtcttacttgggcggcagagagctggcttgggaaacaggcggtgcggatgggaaggggaaagcaggtggcagtgtggcctctggagaactgtggcgctgacacgggctaagcaggaaggtgggttccatttgggaggacctgggtcccagcagcctggggtgtgctgtctggggctgccgaggggcagagggagcttggggaggccctttatctaggctccgtgggaccctgtgctgtcactgagcacttgctgtgtgtgaggcctgggaccaggcttgggtgtggggaagttccacacggttcttgctttcaaagagtgcactgttggcgatcctgcttctgcaccccacttccctgcaggcttctcgatggttctcctcattgtgcagaccacactcagcctctgtgggctcagcaacagtcacagatggacctggctttggccttctgcttttcgctgggtgtcctgcacccagagaagcccacctagttttgtttacatcatcttacctttccgtctcttgcctttctcctcccatttttcttgttgcttctctgtcttccccttcagtcatcaccttctgttttcatctgaatttctctgagctgagtcaggtggcctcacacaggctgtcatcgtattctaccaggtgtctctggtcccactttctatttcatttcgcttgagctgtactcagtgagccgaggtcaagcagtgaagccacttctgcatctgaaattttaggggtgaaccagaggccaccttcagtttctgctctgaagtttgtgattgttttttaaaaagcattccaagtttaggccgggcgcagtggcccatgcctgtaaccctagcactttgagaggctgaggcgggaggattatctgagttcaggagctcgtgaccagcctgagcaacatggtgaaaccccgtctctactaaagtacaaaaaaattagccattgtggtggtgtgcacccataatcccagctactcgagaggctgggtgccggaattgactgcctgggaggcagagcttgcagtaagccaggattgcaccactgcactccagcctgggtgacagagcaagactccttacacaacagcaaccaaaaaagcactccaagtctagaataatgggcaccaaatattagaaaaggttacttggggcgatttgctttcttgtctgttttttggggttttctgtctgttttgttttgtagagacaaggtctccctgtgtggcccaggctggtcttgaactcatggactcaagcagtcttcctacctcagccacccaagtagctgggactgcaggtgtgtgccaccacgcccggcagtctactttttttttttttttttttcttttttgagacagtctctcactctgtcacccaggctggagtgcagtggctagatctcagctcactgcaacctctgcctcccggtttcaagtgattcttctgtctcagtatctggagtagctgggactactggtgcacgccaccacatggggctaattttgtatatttagtagagacagggtttcaccacattggccagactgatctcgaattcctgacctcaagagatccgcctgcctcggcctcccaaagtagctgtgattacaggcgcccaccaccacgcccggttaatttttgtatttttagtagagacagggtttcaccatgttgtccaggcttgtcttgaactcccaacctcaggcctgccttcttttctgaatgttcatcttgctttactttcctctactgaggatgtgtcatttttaaaacatcagaaggaaagggtgaacccctcacacccagccttgggctgctgggaggtggcctgctcctctgaggagtgagtgccgcttcaccagcctcatcagagctgcctttactgttgtgccttcttttcacatctcctgtgtgcctttgcctcctctccacctctgagagcccgtccagctcagacactccattctgttagcctttactgtttcactctccttgtcttggatcaccagtgctgtgatccactaagatttagcaagacatgtggattatggaattttaggaaatttatgtctgttactttttcaaatatacctaatgccaacatgggctagcaaaaataaacctgatacgtaacggcagggctggttagcaagttgtggtcttggaagatgatagtttagcgagtgtttcttaggaacctgaaaatggctctgaaagcctttgttgtgggtggtgcagaggtggacaggcagtccttgctgaagtgactccacgtgaggaatccaggctcctagtgagccagagtgccctgtattgaaaagttaagtttcaaatggcatctgtacctgtccatcatctgcggaagcaccaggttctggggaaccacctggttgattaagtccaggtttggtgaggaatgggcagggccagataacatgtcaggcatttgattagcctggttggtagcacagagcatatgcatacctgagttttgtttctgttgtctgtgcaggctgggaatggagcagccggaaagcggcctgggtgggacacacttggaactcattgtttattccatgccagtgtgttttgggctgtgagtgctggacattcaggtgcagcaccgtctggtagctctctctgcaacgatggccgcatgtggacattgactactagaaatggggctggcgtgactgagaggctgagttttttttttttcttttttaagttctttttttttttaagcctgagtctcactctgttgcccagactggtgtgcaatggcacgatctctgctcactgcaacctccacctccaaatttggagacagaccccccaccgggtgaggcactgagcctctagcctgcgtgtggctgcccaggcagggcccccttctgggtcgatgaagaagcagatctggatggaaaagcctgtgattatctcattaggaaatcatttttacaataatctacatttgcttggcttttgctttttttttttttggagacagggtctcgctctgccatccaggctggagtgcagtggtgcgatctcggctcactgcaacctccactacctgggttcaagcaattcagttctcctgcctcagtctcccaagtagctaggactacaggcgtgcaccaccacacctggctaattttttcttttttagacgcagtcttgctctgtagccaggctggagtgcagtggcgcgatctcggctcactgcaaccactgcctcccaggttcaaacgattctcctgcctcagcccctcccgagtagctgggactacaggcgtgtgccaccatgcccagctaatattttttgtgtttttagtagagacggggtttcacaatgttggccaggttggtctcgatctcttgacctcgtgatctgcccacctcagcctcccacagtgctgggatgacaggcgtgagccactgcacctggccacgcctggctaatttttatatttttagtggagatgggatttcatcatgttgcgcatgctggtctcgaacttttggcctcaagtgatccacccgcctcagcctcccaaagtgctgggattacaggagtgagccaccacgcctagccagtttttgatttttaaagcatttttgtttcagagtttgaaggtttcccagctttttatggtcctgcagttccataaaaagagaaccctggttatcacagggatatgctgacagttcccgctccctctgcgaggaggaactgaaatgggtgggaggaatgtgttaggccatgaaaagtttttatctgtggtcttttgactcctgccacatctctgcctccggtctcggaggagcctggccagggttctcggtccacagctggggaatgaagcctcctcggggtcgtcttgggcttttccctccttggtctcagaggacttggcatgagattgggaactgatgctataataggatttgcaaggttatcaggtcattctcagaacactacgtttttttggtggacattgattgagggtaaggaattttaagactaaagattcttaggcgttggacagttcatattctgaagcactgattttatctaaaagaaggtggtgttttacacgtttgtttccttgagtttgaatctcaacctacttatttgaaaagatgttaagaatatttaaccaaaaacctcatttacaaaagaaatacgcatgaaatgtgatgtgaggcttcattttgcagagggaagggatctctgtctccattgtggacagggcgtcttaggctgcagcgtcattgtgctgttacatggttccacataaaatcttgctccttttctaactgtaaaaacatttgagggtcatttggccaggtaaagatcctggcagtcctaagcagcctcgctggtgccgtgggtcctgggtgctgcctgccagcatcctcggttgaggagtgtggagtgggacctcagggcagtgggcccttccctcccaccggccctctaccctgcccagcccgccagctttctggaacagatcactgtacggtgctttctctccaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgaggtgagtaggctgtggaggcacggccaggcagcctgggcgtccctctcggatccctgccctccgttccccgtgcttcctctttgctgttagattctagaacgcagattcctgggcgacccccgcagtggcggaggctgatgtgggctctagccttgcccactgaccttggctgttttatctcctcattgagattttagaagctagtactggtgaggtgtctgtgaggaggtgtttttgtgtgtttccttcatttccttttggatattctcaccccttgtctctcaaagatgttcttgactgaaggccctcttgtttcagggctttccctttgtgctgagtgggctgatttaggcgggatggcctcttgaggggaggcacaaggcggtgcttgtctcgggggtcagtgtagctgagaaacctcacgagatgttgctgctgacttgggacaaaatggaaagtcctaaaaatagagagaagccactccctgaccccaccgcccagtgaatgcccgtgctccctgctggccagtttcacctgcattattgttttctaaatccttgtaattattgtgagcatactttttaattaacattgcttgcatttttcacggtgtttcatagctcttttgctctgtatttttttttaacgcctgtaaatattctccttgcctgtgtgctcactgtgtgcttttgtaaaaacatcatattggagcacagccatggccagggtcgatgtactgtctgcggctgatgccactgcagtggcatagttgaagagctgcaccagacagggtggcccttgaggccctggccagccactgctctgcttggccattcctgtgtggtcaaggatgactgagatccttccagattctgttgtcgtaagtaacgctgtggtgaacatcggtgtgcacgcttcatactttagactgcttctttggcatacagtattagaattaggttcgtgatcggtgagccttgttctttttttttttttggagatggaatctcactctgttgcccaggctggagcgcagtggtgcaatctgggctcactgcaacccccgcctccttggttcaagcaattctcgtgcctcagcctcctgagtaactgagactataggcacacgccgccacacccagctaattttttgtattttagttgagacggagtttcaccgtgttgcctgggctggtctcgaactcctgagctcaggcaatctgcccactttggcctcccaggagccttgttcttttaatagctaattaattggggtgatggagaagtcttgtcaagcctgggaagcagaatgctcaagaaagaaatggaggctctggaatgagatgtttagagaggcattagaaaaggagacactcgtaaatgtgggcatgagacttgagtacggtgcatgctgtggccagggtcgctcccgccctgggctgcaggttaggttctgcccaccccaggtggaccggactgccgtggcagtgtggcttgattctgattgtccaaagagaagtgtgcatgagtcccattgcagtagatatgaagccatttaaacacattcgtgtgttccttttcttcccttggagggttctagagtacagcaaggaggctggttttgtgtagattcaagccccaaatcgtgcctttaagctgtttgttggtcttggaggacctgcgattcctggaatgttttcagaatcagcaaccattgctgatttttgcctgaaacaattactcctgtggtgtggcccttcctccttggcaagactgtagcctctgcaagagggtctgggtgcctgggagcaggagatgtggttgtccattaaaggtagcagaggaggagttccttgttaatgatccaccctttacccttattcaagcagttcagttcgtgtccttcccattgggttaagctgctcattagagtttttctatcgggtagatgctttttgaggattctgaaatcctgaattagtaataataattaatagttggctgttctgatcatgtaatgctttctgctgtgggttctctgtatctgagtttgtatatgagaaagagcgagggcaagagaaaggactttttgtttgtttgttttgaaacggagtttcgctcttgttgctcaggctggagcgcagtggcacgatcttggctaaatgcagcctccacctcctgggttaaagcgattctcctgcttcagcctcctgagtagctgggatcacaggtgcccgccaccacacccggctaatttttgtatttttattacagaccgagtttcgccacgttggtcaggctggtcttgaactcctgacctcgggtgatccacctgccccagcctcctgaagtgctgggattacaggcatgagtcaccgcacctggcctaacacgtttcatttctgcattgtgtgtctcatcaaaactaggtggccttctggtggggtcttgatgtgtggctgactggccggtggcaggtgtgactgtgaaccctcaagctgtggggtgacggtgactgggcacaggcctctgctctgagaagtgcggcttctgccatgttgtcatggccaccgctgcctttttgatgcctccctgggaggggtgcagcaaggctggctggggcctgattggatgcagggaccccaccgccatcactgggcctcagttggtcactcctgatcatgggctgaattctctcctgcttcagctgctcctcaggcgagagtgctgcccctgcacaccctactttgggcagtgctgggcatgctcagattcgcgcccgtccagttatggcccgtccagacttctccctctggcagggcgggcattcacctgtggcagggcactcgcctccttcctctgaatacccttccatttctgtggcaggtctgcacagacccagccctgacttcatttcaagttcctgttcctgcttatatccgtccatcatccatgcttgtttttgccatacagttcttgatttcctacctgacagccacacagccagcgtcctgtgcttccttctccctctctgcataatggctgcggcctcagctctggcctctgtgcttcgcagtgttccccttctctgtccccacctaggccctccctgtctctgcacaggcagccgggggcatcctcagcctgttaccatctccacagctctgtggacgctgcaggtttctatctcttcaccccagacagctctctcagactttcagccctgcccatcttttgttctcattgccgttaccgtgtgtatatctggttcttgactcaggacagagcactctcgccacactgagaatacagaaaagcttctgtctggtggggcttgctgccttggagacacacggcaggcgcgacacagatgccctgggactttaggaggcagcagaggttaagaacacgtgagcaggaggcctggaactcaggttctcagggaacctcttgagtagacgaccccgcagtgacatgcagaggccgtcaagttgcttcatcgtggttcttgccgaggcccagggagcgtggggagggctgggcctgcctggaccttgcaggaaggcctttcacgtgctgcttcgcctctttatgctttatctgccattccttttgaaaacaatgaacacgttttactttttctaaagtttttaatttttcatttcatttttgcacccagactggggtgccagccttccagccccacccgccagcccacagcagcttctgtcttcacctccctcagcccctgtgttgctgggagttacagatcctaaaatgtgtcagtgtgtcaagcacaatgccacctcccctctggcccctccaggtcacctcacggtcccccagctgccaagagtcttctgaggtggacagggttgggggccagcaccccagcagtccccaggttctcatttccctgaggatcttgctccccagttactaccccttaccccccatcagcatgttttttatttttttgatttaaaaaacatctttttttgagagtcagtcttgctttgtcacctaggctggagtgcagggctgccatcttagttcactacaaccttgacctcctgggctcaagtgacgatcctcctgcctcagcctcccacgtagctaggactacaggcatgtgccaccatgcctggctaatttttaagttttttgtggagatggggtttcactatgttgctcaaactggtctcaaactcctgggctcaagcaattctctcacctcagcctcctaaagtgctgggattacaggcacgagccaccacctggctcccttaactttttgttttgaaatgtttcagactttttaaaagttgcaaaaacagcacaaagcaggtcccctccaccctgcctccacagcattagggcagccgcactgtgagggtatgagcacagacatggccctgcctgctcatttgcaggcggtattcagattaacaagggtcccactcaggtccatcctggccaggacgctgcgccgcactcggctgcccaaactcctcagtctcttgtaacctgggacagctcctgggtttttgttttttgtttgcatgtttttttgtcgttgatgacctcaacacttgtggagactcacagcatgttggtttgtagaatgtcccttgtgtcagtttgggttgatctgcagtttcctcatgattctatgttacgcatttctgtcaagaattccacagcagtgataccgtgtccttcttggcgcatccagttggcggcccgtggtgttctttctgtctccgtcctggtggtgtttgccttggtcgctgccctcaggcagcgtctgccaggtctcaccgtggctgggtcatggcttggctttgaggctgtgtaaataccgtgtttctcatcattctttgctcccactgatttcagcagccatcgctgccttttccctgaagcagttgttactgtgctgtttgctcccagtgaggaccttctgtttcctttattctttctgtgtttgctgattggaagtcctgtgccaagaagagccctgcgttctcccccacacgtgcagttattctgttacctacacccatgtagactcacagatgttggctttattctgggggtcatggtccaccatgccattgtcggctttctcgccccgttggttccccatttggccactggggagcctcatgctggctcctgcatcctcttctcacgtccccatcgcctgccagtgtattctcgtgtgctggtgccgtcaggcattccagactcagtggctgcttgctgctctgcagttggctgtttttcctgggagcccagcttccctttgcaaagtggtatttagaaaccaagacctgggcgctaaggatgctggttactgctgagcccttccagtacttaggagcttggctttgatgagatgatcgaacactaggttctctatggcagtgcctgaagcagcactgaggtgaggctgttctgtggaacacaagttctcttctgaaaatctaagtcacactcagcttttgcaaagaagcgttccaagaagggttggcctccacgtataatcagagtatagtctgtgcggttcacttactaaatgctcacgtttgctgtcctcgtttgaatatggaatatattttgtcagattaaagcagtgaggatgtttctgatctgttctttaagatgccataactgcttctcttccagagcttttcttcatggaggtgtctcatttcattatctgtgaagaactctagcaattaaggcatttgtccaagtgatgagctttatgtttctcctgtctggggtgcttgcctctttggtatccatgtgctctgatggttctgttcctggttccattgctcctttatcctgattaaaacctaaggttccagggagtcgaagttcaagttcatacacagataagagcttggaagggctgcttgtttgactacagcctgtctcctttctcctttctcggaaccttggaaagggtccagttaacacagaaagctgcattgttttaacccctctacatttatcatggaatttattttccagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatggtgagtgtgccacgggccaggctcgggggtgcccacaggcagggccggcttctgctcagagcgcagcttccagcaagcccgccggacctgctttctggcattttctcaccagccgcttggcctggggctcctcgccttgcagcgctttggctgattgtgtgctgtctaactcggtcaaaccaagttgccaggaagtggcccgtatcccatgctccagggttcttaccactgcttttctgagctatggtttgtgtgtttccagtggctctgagtgtgcgtgagttctgggtccctggctcacctgaagcctgtggtctccactgcaaatgatagcaccatggtccagcgaggggcttgggccgcaggcaccgtgcctggcgctggtcttcctgggggacggccagccttcccaggcctctcgccctctacactgggacccaggtctgcgtcggccctcgttcagtcacgggaccaagtcatccccaggtagaattctggcttctggctcagagcaccctttggctactggtggcttctccggatgatgctttgtccatcaccatctctgtccttgggagtcttagctgcctcctgcctccgcctatgagaactacctctccagcagcgcacctgtgctgggccctgctcttcattcctgtagcttcacacacagcttggtccttccagatgtacccccagagcacccctctgccttctgagccttctttcagatgtctcacattctgacccagggtacctggactgtggccacactgccactctttgtgcccttgcctgtgcctcgtggtgacctaaagtccttcgccttggccattcctgtggtgtcctctgggtgggttatggcatcttgaccatggtgcatcagctttgcccggagctttgggaagagccaggacccagctcccctgtgtgactgggcagagccctgagggccgcagacaccccctgcccaccacgcagctagcttctccactgaagaacctccactgggagattgtcaccgtttctggagatccatggaaacggctgttggtctctgcacattaggggtaccccttgattcgggtctgccgccgatgcggttttgtttgtttgcttttggtatccacgtgaccattcatgtaagattttctgctgacttcacctatttatagcacatcagttccgttttgtcctatatttgatgcctgtgctggtcttctcatgttcagctcacttgtttatttgaaatctcagcactggtcagatcccgtcatccaaggctgttgtggttaatgtcaggttgtggtgagtggccttgtgccttccagagtggcacgcagcaccgacttttcattgtcggcctcttcctgtgtcgtctgtcctttgcatcgttcattagtgcctttttgaaagacagtccaggctgcgcgcggtggctcatgcctgtaatcagcactttgggaggcagaggcgggcggatcacgaggtcaagagatcaagaccatcctggccaacatggtgaaaccgcatctctactaaaaatacaaaaattagctgggcatggtggtgcacacctgtactcccagctactcgggaggctgaggcaggagaattgcaccactgcactccagcttggccacagagcaagactccgtctcaaaaaaaaaaaaagaaagaaagtcagtccatgagagcagatctgccatccactgtggctggtcttgaaaagctctctatgggggaagctggccagcagcggaggggactgggcagctgtttagtagatgaggtatagagagagggatgggattccaggagcttcggtctagtgtgctttgcttgaaccatctgcgggcagggtgggaagcgtctttggaccctcaggctcctggcgtagacttatctcctcttctgaggttcaaatgcacattctacttgccaacccaggctctctcccatgtcaatttcagaaggcagtcaaagcaaacatttcttttctaattgtgtcacctttccctgttaaacaacctcctaatcctaaacttgctggtgcgaggaggcctcattcctctttggcccttctgtccatctagggtgaagggtaaatgctccctcacacctctcggtggggggtcacacccaacacaggtccttttcccttctccgtgtgggcccctgtgcttccctctcttcctgacctggcacagcaggctcctacagccttggtgtctcctgttcgtgcatctttggtgtgaccccacatgatgtgccttcttcctgttgagctcaccgttctcccgtgttctcccgggttctctgatggccctgactgtctcttcagcagggctgtctgcctccgtgccagcgggcagcggcattggggcacccgatgctgacttgcccaacaggagcatgaggctggaggccactaggacactgcgaagtgactggccccatggactgtcattgcgcatcaaacagagtggcaactttttcacgttacatgtatttttggcgtgctttggagttttgttttgttttgttttttgagccagagtcttgctctgttgcccaggctagagtgccatggcgcactctcagctcactgtaacctccatctcccagtttcaagcgattctcatgcctcagcctcccgagtagctgggattacaggtgtgcaccaccacacccagctaattttatattttttaggagagatgaggtttcactatgttgccaagctggtcttgaactcctgagctcaggaaatccacctgcctcggcctcccaaagtgcaaggattacaggcgtgagccaccacgcctggcctgtgctttggagttttgaagagcacaccgtgtgcactttatcatgggtttgtctgactcatcttgtggcgtgagacacagagtggtggcaagcgagcgtggaagggactgactccgcccccagcttgggggccttgcgtgtgtgttcgtcttactaatctcccgtggtttccatgcacatctgcgtttccttgctgctgtccattgctcagtggagattttgcttcacgaactcaaagttggatgaggtgagcttggttcctgtccctgagtgtgtaataaaacatgaggtgccacctaggaggccgtggggccaggcggggcatcagggacacctcccggaagccctgcttcgtcccagggtcccacctcccctggggtcccttgtctgcagtgtcttgctcttggtgctactttcttgtttctgggttgtgggtttttttctttttgccatttcaaatagtggactttaaaatatatattttagaaatggggatattattcacccttttaaagcatacaacttagtggttcttaatgtacttacaaggttatgcagccattgccactctctagttgcagaatatgtccattgcccaggaggaaaccctgtgccccggtgctgggagccctcagtttactacctcctgtctctatggatcgttctactctggatgtttcatagaaatgggatcacgtgctatgtgtccttctgtgcctggtttccttcactcagcgtcaggtttcagggtttgtctgtgttgtagcgtgtgccagtcctttgtatggctggattattttcctttgggtggatggccacattttgcttgtctactgaatagtggatcttaaagctttccgagtcatgggctcctttaagaaagtctgatgaggccaggcgtggtggctcacgcctgtaatcccaacattttgggaggccgaggtgggcggatcacctgaggtcaagagtttgagaccagcctgactaacgtggtgaaaccccgtctctactaaaaatacaaacattagcagggcgtggtggcgcatgcctgtaatcccagctacttgggaggctgaggcaggagaatcccttgaacctgggaggcggaggttgcagtgagctgagatcgcgtcaccgcactccagcctgggcaacaagagcgaaactctgtctcaaaaaaaaaaaaagaaagaaagaaaaaaagaaagtctgatgagcccttaggtcttaggtctttctctcagaagagcctttgagagcagttggcctgtgcttagccgtgtccgagacccatggtccagaatcctcctcatatcttgaaagcctgcttctccatttaccagtcttagggccttgagaacaggtctctgaggagagaactagagaggacaattgtgagagtagaggggacaaatggccttcacccctgctctgtgaagtgacccaaaggggcctggactgtgttgtcacttggtttccctagcaggattaggtctggtgtaatacagtaacaaaatgcaaaatagcagtggcccaagcgcctcagaattcactgtctcgtggcagagacgcctagaggctggcgcccagggcaggcaggacccaggtgcctcccattcttgtgcttggctgtccttggtgacagctccaggcagtggctcttgaggaaagaggggtgggaaaaggggaaccctcctgcccaaatcaggctctttaaggaggcttctggaagtctccactacttccagtggtgtagccatgaccagctgtccatgtctcagcctgtttgcctcccaaataaaacaggggccttggctgggcacggtggctcatgcctgtaatcccagcactttgggaggttgagacaggtagatcatttgaggtcaggagttcgagaccagcctggcccacatggtgaaaccctgtctctactaaaaatacaaaaattagccaggccataatggtgtgcacctgtaatctcagctacttgggaggctgaggcaggagaatctcttgagcctgggaggcagaggttgcggtgagccgagatcatgccactgcactccagtctgggcgagagagtgagaccctgtctccaagaaaagaaaaaaaaaaaaaacagggcctcttactgaggaaggagaatgggcctcaggcaggggtgagcacctgtccttggctcctcctcccgcctgggcccgggctatgcagatccactgtcctgggagggcacaggtgaggcaggaaggcagcatccaggtttcagggctgctggcctcacctgtgtgcagagatggatgacaggtttagtgctggccacatctgccaccttcacgagtaccagctgttctgagtgttgtgttttctcctccaggggacatttcctctgcctattggggtaaatttctaacgccccactttggtttaactttttattttgaaaatcgcagacacagcaccgtgttctatacactctgcccagtgtcccctgtggttgacagcttgcatgacaaaggtacagggaggagatccaagaaaccacgtgagcctggtgtggctctcacacccaagccaggcagcgcctcctgttcccctctctaaagccgccttctcttctgtttctcagtgttctctcgaggcctgaagaagtcatcccaggaactgtatggcctgatctgctatggcgagctgcgcaagaagattgggggctgtgagtacgctgactgtggggttgcccacggctcctcctgtcctttgtcacctttgggctttagtgctcagagttgtttctagtttccctctaacttttatcttgaaaaaattttactagaagaggtgaagaatatgatggcggccgtgctctttagcttagatggacctgttgctgacgttggctacatttgctctctttctccatgcacatgcacacatgctcgcgtgcacacatgtgttcacacactctgcattccactcgactgtaagatgtcacgccacagcccagaatacctccaccggcatcacctcagagaacatttctcctatatagccttgataccatggtcgcacctagacttttagcatttaccaaacaggtgtagtgatcttacctaatttcctgcccatattcagattttctaaaacatcccaaaatatcagtcagggcttctgtcaagggccgttgccctgcatgtgactgtggagtctcccttgggtgtctttgacttagagcggccgcactgcctgggcttctgagacattgcaacgcgctcaggccttcctcacgcaggcccttgcttggatttgttccgatcgtctcctcgggaccagattcccttgagacatttttgacacgacctctaggtagggacattgtagacttaccaggcgcttgtgcccagcgcccctcagccctgcttcttctgcctgacttcataagaagagagcatgcctgggctgtccagtgggcactgtaggggatccccccctcttcagtgggatactgcacgaccacgccagctagcatgtcacagctcagggcgggtggtggggctgagaggacagatacggagcagtcgccctgtctgtgccaggcctgcaccacactctgtccccttgctgcccctccatgccttgctgtgtcctgcggggtggctgctgcaatctagtgtggcatttgtgtgtgggaggccctgccctcctgcacttccccactgggtctgtcccctgtgggcccagccactcctcttacctcctccagcctgcctctccagcccgcactcatgtccgtgggcctcgtgtcccagctcttcatgcctgttcctgccgcctctcatctgccctctctcagccttgggaagcatcccaggccccaaggagtttacgccacagctctcccagctctcatcttccccagataaaggaaaaccccatcttgaccatgtgttcccactccttgttgcctggtccttttgcaccactgcttgttctggtttcctccctagaagcttctgagaggtggagggtgtccaggttcttggcatttcgaacaaagaattgtacaaaatgcacaaacaaagcaagggaagaatgaagcaacaaaagcagagatttattgaaaaccaaagtacactccacagggtgggagtgggcccggacgtaggggctcaagagcccttttacagaagtttccccctctagagggggaaacctctagaggtttcccattggctgcttggtgtacaccctatgtaaatgaagtagtggccagcaatcagagactgaagtgaggttacaaaggttacactctatgcaagcatctgattggttgtggaaaacaaccaatcagaagctaaactggttacaaagttacacttctttgcaaaggaagacttggccccagtcttggggaagactttttagactttttcaaacctagcagaagcaaccagtcaggctgaagtgaagttccaaagttgtactcctatgtaaatgtccgattgctttctgctttctgcaaccaatcagagatactttcaatttcccatctgccatgaagaaagaaggggagggggcgttgcaaagggaatagcgtgtctggtccgtttgttacttaggtgtggaaagttggggttttccttttgatttagttctaggaagtcagcgtgaattggccttaggttccctacctctagaccctattctcctgcctcatgaggatgctcaagtttgatgaaaataaatgacttgattgctgagtgaggggcacactgctcccaggcttccaacccttcatccgggagcaggagaggtggggcacggtgaccctgtggcatgccatgcctggccggtttccgcaaccggttcctttcttggtgcctcgcctggcgacaagagccctttccggtgcttttcattccttcctgaagttccgtttccatctggctttgtttcctttctttctgaaaaacctcctgtatttttttccgtgcagttgtgccggctgtgaattcttagttattattaatctgaaaattctttatttcatcttcattcttaaaagatgtatttgccggatagagaattctgatctgacgggttcattctttcatcacattgacaccgttgtctgctgcctcttggcctgtgctgctctgatgagaggggtcagtggtcatctatgccctcattcctccgtgcgaggtgcattgtctgtctgtggctgctttgacaattttgtctttggttttggttttcagcctggtcgttcgtttgtggagtttttttccctaaaacatgcagaagaattcaaagaattttacagtgaacagccaagtacccagcacctagtctctcccgttaacgtactgtagctgctttcttgcacatcttgaagatagtgaagagtcccgagcaggtcacaggaaatggggcgtctgctccaggaaactcagagggtgtcggagtcttcattctgtggaccctgggtgccttgggggttccacactgtgggccggaaggtcaacaccggacactgtcagtacgagcccagcaggaagtgtgcgtgggcaggtgtggtgcctgcaggaagcagctgttgagccaggcagatagggatgagtggaaggccggcgctgggggacctaggagggagctcttgggaggacagatcaactggtcagaggctgggtagtgggcctgcctgaggagggggccaggcaggggcgtgccaggctttcaggtgagcgggggcgaccagggcagctgactcgaaggtgtgactttgagggaggggctgcagctactgtagggcttttattccagaggaactttaatattcggtaatgggatttgagtctatattgagcggaattgtatgggaatcttcagtggctttgctcctaactacattgtggtctcatttatttattttttccatttaaaggtatggatgacaagaatgcaacaaagctgaatgaactcattcaggttgggtaagtcccagtttccatgtgaaacatcacttctctgggtgttttgtgtttattctctaaaatacagaagctgaaatgctctcagtgaggaccttccgagttaaaacttcataacctctcagttacgtgttcagtcccaacaaaaggtgcttggtccagggagcagtgactgcgcccagagcctgtgcctgccccggggagggaaggaagtgccgtctttggcctcctccttcccgagggtctctggctgggcgttgtggtctcgacgcagcactcagggccctgctttttgtgctccttttcctccacctttgtgcctgctgtggggctggtccccggcttctagggcctctcctttccattgcatttttgtcgtgtcctgggccacttctgacagcttccctgccttcttgtgccctggatgcttctgtctccaactggccgctctcctcccctcacacacctgactcccagagggcacatgctctcctggccacacaaacaaccgggcccctgatggtccagttgacatctgcccagttgctgctgttgggctgcacttcagggcagggccccgccaccctactccacagcctgggggttccctgctttacagcttggggaaggtccccacgccacagcctgggggggttccccactccgcagcctgggggtctccactccgcagcctggggggtccccactctggagcctgggggggggtccccgttccacagcctgggggttcccagtgcacagcctggtggggttctgtgcatgtacatttctcacctggtgtgggtcctcatgggtagccatcccatcttacatccatcccgcccactgaccacaccagagctatcccggcagcctggctgactgctctcagttcactgaaccacagatattgggtctgcacaaccagccccgatccttgtgggtatgccacccgcacccaagagccctgcccttgcagccactcctgaacagtccttacccatctctcttccgtccatagcacttcacccttggacctctggttgcttttccccttggcccttctcccccaggcttgtgtctgatgacctgggaaccctccctgccccagtgggagcagtgcctgctgggccagcacaggccttccctccagtcccagcacagcaggtgttgggcatgattcccaggctgtgtgtgagctgccaccagcctgcagccaacgactgtaactgggtgaccacagccaccagaaagtgcagccagcttgccccaacactggacagacttcccagagtgggtctggggtacagccaggggccgccagccatagggagggtgttcaccgccttgcccaggcgcccctcccagcttcagagccctgcttccttcccactcttgctcctgctctacctccatcaggcagtatctggcttatcctgagcagcactgggcacattggaggaaccgtcttgagaaggcccaagatccaaggcttggttggtttctgatgtcagctgaccagtaggcaaggggctgtcccatgagggaaaacactgccgcaggatccatacttggggcaaatcttacttcaccttttatttcatttcctccatgattgatggaatgaagccagagttccagactctttgctgtatgcttgaggacggtgcacagagtggcctgtccgatgagcgttccttttgccaaaacacagatgtgctgcccagcgggggcgtggtgggcacctgcagcgccatccgcgggagaacttatgtaagaaatagattccttctgaccacacgggcacagggagttcccagggactggagacacttgacaaacaaatgcaggtagtagctttgtggaggtcttgggcctttaaaaaaaaccaaggaaggagaaggaaagaaatggttacaaagagtattctagggacaactcggggggctttgattatgggctgcgtgatagagtgtagtctcccgagtgatgacagggttgtggcttgcaggactagaggtgctggctaaagtgtgcagagggaaagtgccttctggtataaagaaccctcaggttgcccaggcgtagtggctcacgcctgaaatcccagcactttgggaggccaaggagggtggatcacaaggtcaagagttcgaaaccagcatgaccaacatgatgaaaccccgtctctgctaaaaatacaaaaattagctgggtgtggtggtgcatgcctgtaatcccagctacttgggaggctgaggcaggagaatcgcttgaacccgagaggcggaggttgcagtgaaccaagatccctccactgtgctccagcctgggtgacagaggaagactttgtctaggggaaagaaaaaaaaaaaaaaccctcaggtggttctgccgagggaagggcaagaagcaggcatgggcctgggccatgtctgtactcagtagcatgtgtgctagcgcccctccagcctcatcctcccgggcagcaggtgcgtggacagcggaatcgaaatgtgtcatgagcttatgcagcacgcttggtgccatttacagtcatgccatctgccactctgagaaccaaatgaagagggagcctggcatgggtccccagctcctccaggccgcgtgttgggcatgttggccagaaggcggcatggctgaatgtcggctgtcatcctctgctgtgctcctgcagtggaggggctctgagatgactgactgtgggcctaggcggtgggcctgtcagcaggatggcaagattgattgtcctttttcttaaggaagctagtgttgaggtagctcacctggctaccagcttgtctggaaaagactgggcaggtggcaaaagaaaaggtgagctcaggtgtgggcgctgatggggaatttgcccgtgtagccaaggattttggcaaatggcaggtgaaggcagtgctgactcctggaccgagtgctgggtgaggccgcagcgagagtgggagcctgcgctaagggacttggccgttctcacctgactctctgggccccagcctcacctgtcgtattgtcatcctccagagaggtgtgagacacggagaaaaggtttggaacagcatggtaccagcaaggaaagatttctgtctgcacccatggagagatctgaggcagaacggctgctgaatagtgtgttcattggttctggaaatgtctgggtgcctgtgtgtgcctggcacaggaatgggtgctcgttatgcagtggtgacagctgtggtgtggcagctgatgcatgtccattgaacaggtcaccttagcatgtggtgtagacatgtacagtaactggggatgaaagttactgtgaaactgacgtggcaggtgggtgcagacatggcaactggcaggaagggaacctgcctggggcgtttagggaagcgatcaggggccacacaaagagttggggaatcacctggcccagggaaaggaaggtgggaaggaggaactgggtcatggaagcctcaggaggggaggggagaggaagagtgcagagctgaggctggagggctgggccaggcccagctctgagcacaggagggtttgcagcaggagagcccctcgttctgggtaaaactgtgcctctcgttccctgtggagaagagatggggacgctgttggaggtggtgtggtgtggtgtgtacattctttttctttctttccttttttaaatagaggcggggtttcgccatgttgcccaggctgatctcaaactcctgggctcaagtgatcctcccgtcttggcctcccaaagcactgatattacaggcatgatccttcacacctgacccattttttgctttaatatttttacttttgttcttttttttttgctttttgtcatagttatagaagtttgttttaaaacattttagtttttagagcagttttaagttgacagaaaaactgtgtacagagctacgcccctcccctgccccacacgatttcccccattattaacacttcgttggtttattttcttttgttttgtttgagatggagtcttgctctgttgcccaggctggagtgcactggcgcgatcttggctcactgcaacctctgtctcccaggtttaagcgattctcgtgcctcagcttcccgactagctgggattacaggcgcccaccaccacgcccggctaattttttatatttttagtacagacggagtttcaccatgttggccaggctggtcttgaactctcgacctcaggttatcctcccaccttggcctcccaaagtgctgggattacaggtataattaacactttgcattcgcgtggtccttttatcacaactcatgaggtttccttgacccttcttcatcactcagagtccatagtttacttacaggcccactcagcgttgtgccttctgtggttttggacagatgggtaatgacatgtgcccacccttctggcatcacacgggggcagttcactgccctgaacaccctgtgctctgcctgtcacttcgtagtgcccccagaagccactggtctcactctctctagcttcaccccagcagcctctagtctcccgctctctctagctgcacctttcccggagtgtcgtcgtcacattggaatcatcctgggcttagttttgtagattggcctcttcacttacagttctagaagttttcacaaatttgtagagttgtgtagctgccaccactgtcaagatatggaacgctgccagcaacccccaagtccccttctgtccctcccccacaccttgccccaagcaccctttgcgccactctccgttccctgtaattttgccttttccagaaagccatctaaagggaatcgtggtgtgcagccttctgagatgggcgtccccactcagcagtatgccctcgaggctcttccgtgttgacttgtggatctgcagcttatactttcacctgctgagtcatgttccacagtgttgacatgctgcactgtgttatcccttccaagtggagggacccagggctatttgcagtgttttagtgttgatgaagaagtgcccaggctttgcctccaggtttttgtgtgagcgtggttttcggtccccaggaggaggaggaggtgggagtgtgtgtttggctttacatggagctgccagactcttccaagagagttgcagttgcttcccacactccccagcactcagcgtgttcggggtgtttgtctttctaaagtcaccctagtaggtgtggagtggcatcatgctgtggttttgatgcgtttccctgatgactcatgacaccgagtgtctttctcgtgcttatttgctgtgtgtctttggtgaagtacctgttttcttcttcttgagtttagagaattctttgtatattgtagacacaagtcttctgttggatactccatctgcaaatactttctcctagactgtggcctgtctttttgttcacttactgtcctgcacagagtgaaagtccttcgctttgatgaagtcaagtctgtcactgttttcttctatggtttatgcttttaatatgacatctaagaactctttgcctaacccaaggtcacagagatgtgcccctgtgttttcttctagaagttttctagttttacatttaaatccatgatctgctttgaattaacttttgtgtaccatgtgaagtttaggaggagctttgctttttgtctgtgggtgtcaagctgtgccatctgaaaggactgtctctcctccattgagtggcctttgcatccttgtcaaacatcagttgactgtaccgtgtggttccattctggaccttctgttctgtcaacttttgtgaccgttctttgaccagcagacattcgtatttacaaacaaacaggaaacctgtcaaggtgagagattgggaaaatgactgaggtgcctgtgggaggctacccctggatttcagcccaaaagcgattggggtatttgacttgctgtcgcctctacctctcatgcagacctgtttcaattaactgtgaatcttctttggttttagaattgtaaaattaaattaaagactaaatgaattgagtaaagctctaaactaaagtgaaagcttactacgtggttcgcagacccagaggcctaagtttatcacgtgcttattagatttatcaagtggttttgcagagaagagaataaatgtatccgaaacgaaagccaggctcccatgtacatagagggattactctgttttcgattcagaaatgctgttctgttctgcaatgatatttctattctgaaatgctattcacctaggcgtggtggctcacgtttgtaatcccagcactttgggaggccgaggcgggtggatcacttgaggccaggagttcgagaccagcctggccaacatggtgaaatcccgtctgtattaaaaatacaaaattagccgggtgtatgttggtgtatgcctgtagtcccacctactcgggaggctggggcatgagaatcgcctaaggccctggattgggaggcagaggttttagtgagctgagatggcaccactgcactccagcctgggcgacagagtgagactctgccttaaaaaaaaaaaaaaaaaaaaaaaaagctactcatggaggggtgtaaatagagcctctgtttgagggctcacttagaggtcagcttgtgattcttctcttatagccctgtgccgggcctatctgggaagtcttagcctgtcttacagcttccaggctggtgcgaggatggggaggtatggacccacgtcccggaactgtgaccaggcctaagcgtcaccctggctttcgcacttgaacatggcttttcatcgtgttcagtgtcgcagcctcaagtcggtcgcagaacttccatttgagagaaaaagacggaggactgtaacctcagaatggttccatatgaatgcagaagggtgcacttagtttgattgaaggaaaaaaaaaaaggaagtcacaaaatagcagtttaacggaaaatgtgattattgaaaacacaggtgccacatgacacagctccgccagctgtttaaatcttgcctactactgttgttttggggcagatggaataaaaaatggtgagtggaaacgtccatttgtttccagagcacttcattggaggagattattttagaattgacttgagccgggtacagtggctcacgcctgtaatcccagcactttgggaggccgcggctggcgaatcatttgaggttaggagttccagcctggccaacatggagaaaccccgtctctactaaaaatacaaaaaattagccaggggtggtggtgggcgcctgtagtcccagctacttgggaggctgcggcaggaggatcacttgagcccaggaggtggagcttgcagtgagccgagattgcaccgctgcactccaggctgggcaacacaatgagactctgtctcaaaaaaaaaaaaaaagaattgactccatgcttaatgactgcttttgaccaatgtttcccctggttccttctgctgccgccctactctgacatcattaatgttcataaaactgctgtggcacttagatctgtgtatttcagctgggttaaggtggtttaagaattttgtctcaggccgggcgcggtggctcacgcctgtaatcccaacactttgggaggccgaggcgggcggatcacgaggtcaggagatcgagaccatcctggctaacgtggtgaaaccctgtctccactaaaaatacaaaaaaattagctgggcgtggtggcaggcgcctgtagtcccagctacttgggatgctgaggtaggagaatggtgtgaacccggcaggcggagcttgcagtgagctgagatcatgccactgcagtccagcctgggcaatagagcaagactccatctaaaaaaaaaaaaaagaagtttgtctcagtacaacatgttgttctctggggactcatcctctctaaattatccctcaagacagaaaatctgtacagacagaaagggggtgagggcatggaagttttttttctaccgtcttgactctttggtcaggctttccaaggctcagctctgtcctttggtatcctgtgtttgattcccagcactgaaggcactcagtcagtagttgggtgggtggacagacggacacgtgagtggatggatggatggacacatgagtgggtgggtagaggcatggtcaatggatagatagaagagtagctgccatgcatgagggattgttgagctttccatagctactgaaacccagctgctgctcctgcctttctgccaattgggacctcactgtttggccttatttatttctatttttatttttttattttttttgagacggagtctcactctgttgctcaggctggagtgaagtggtgccatctcagctcactgcaagctccgcctcctgggttcacaccattctcctgcctcagcctcccgagtagctgggcctacaggcacccaccaccacgcctggctaattttttatatttttagtagagacggggtttcaccgtgttaaccaggatggtctcgagctcctgacctcgtgatctgcctgcctcggcctcccaaagagctgagcctacaacagtaggcatgagccactatttttttttttttttttttttttttgagatggagtttcactcttgttgcccaggctggagtgcagtggcgcaatctcagctcactacaacctctgcctcctgggttcgagtgattctcctgtctcagtctcccgagtagctgggagtacaggtgcatgccaccatgcccggctaatttttgtattttttgtagagacagggtttcgtcatattggtcaggctggtctcgaactcctgacctcagctgatctgcccaccttggcctcccaaagtgctgggatgacaggcgtgagccaccgtgcccggcttgtttggccctaaacacttgattaaagccttaggtttttggggtgatggtaaaatctttgtggggtattgagactgcataatgctgaaattagagctaggacccttttaaaaggatggggattgcagctttgtttactgggatgtggagattgtggtgtcaccctttttgcctgtctgaggttgccagaactggctgtctccattagacgccctcagcagaggctgcttttcagccaaactgcgggagtcatctggagagtccctcccacgcagcactcgcttcagactcttgttcacattttgatctctaattttggtcagcattgtattggaataagattttttaaaaactatacaagtaatgcataaatataagtcttaagcaattttcaaacaatacacagataaaatataagaccctcttcaccaccccatcctgctcatctcatcgaagctaaccacttacagtcatttcatgtgtgtctttctgaatttttttcttagtgaatttacataagtaagtgtacaggtacaaatatagatacatatagagatgaagatgtaattttttacgcatccttagaatcacgctctgttctgtagcttttttcatagactgtttcttagaaattgaatagcaacagcaaatatagaagcagcaactctcctacctgacgtgtgcaactgggagttggtgaattcctaaaattggttaaggcagaaagccgtaaaaacaagatacacatgccctgagcattttgtaaaacacaagcccattgtcgttcaccagccagtgggccgctgcccagagccatgtcttgactggggtccactccttggaattcaagttggtttttctctcagatcagaaactcctcacagggaggtcacatagaggtggactgagaagtcacagaggtagactgagctcacacagaggtcatggagaggtggattgaggtcacacagaggtcacggagaagtggactgagaggtcacagagaggaggactcagaggccacaggtcatggaaaggtagattgaggtcacagaggtcacgaaaaggtggactgaggtcacggagaggtggactgaggtcacacaggtcacaaaaaggtggactcagaggtcacagagttggacaggttacacagaggtcacacggtggactgagatcacggagagctggactgaggtcacacacaggttatggagaggtcgactgagaggtcacacagaggtcatctaggggtggatttaggtcacgcacaggtcacggaaaggtggactgagaggtcacggagaggtggactgaggtcacagaggtcacctagaggtgaattgtcacacagaggtcatgttgaggtggactgaggtcacacacaggtcatctagaggtggattgaggtcacacacaggtcatctagaggtggactgaggtcacacaggtcatttagaggtggattgaggtcacacagttcacggagaggtgggctgaggtcacacagaggtcatggggaggtggactgagaggtcacctagaggtggattgaagtcacacagaggtaacctagaggtggactgagaggtcacggagaggtggactgaggtcacacagaggtcacctagaggtggattgaggtcacacagaggtcatagagaggtggactgaggtcacacaggtcacagagaggtggactgagaggtcacacagaggtcacagaaaggtggattgaggtcacacagaggtcacagaaaggtggactgaggtcacacaggtcatctagagatggattgaggtcacatggaggtcacggggaggtgaactgaggtcacagagaggtcacgtagaagtggattgaggtcacacagaggtcatggggaggtggactgaggtcacaggtcatgtagagctggatttaggtcacacagaggtcacagggaggtggactgagaggtcacggagaggtagactgagaggtcatggggaggaggactgagagcttctgctctgagggcccaaagtgggaggactgcacagagctggggcagtggagagaggggtggccatctgaggggaccccaggatagtggcttttccagggatgggacatcagcttgtgccaggccagtcaccaaggcaggagggcacagcacattttctgtaaacagcaggtgtcccttggagtgtgaggtgtggtcaggaaagtagcaggatgtgcagagtcaccacttcttgtttgtcactgtgtcctcccactgtcctacgcgggctcgagaggctggggtggatgcttggccaggccccacctggcctggctcagcgcctctccgtgtgctggcccttccgtccttctgttcactcacaggcctcagcgttccttcaaaactcttttcccagggccaccactgtacgttacaaagggcggaacctgcggatcaaagcgcccatgtgccgggccctgaagaagctgtgcgatccagatggtaagtgaatggggcgctcccgggaccagaggcggtgcccatggtgtcccattcaatgatgggcaggctgagctaccgggttgctgccacagttgctttgtgtctgaccctgcttaatcccagggctgcacatggaccactcttgaacttgaaatgctccctacgaccactcagtcaagttgagctcagagccatggcagcagtcagcagagtggtcggaggttgtcaggatcgagtctcctatggcctctctggaccagtctgtggcctttgcaaacccctgagcagctacattggagtttcttcttcgctggggtttctctgctctccttgcctctgtttgcaaggccatctgctcacagctgatttcactggtttttctggcccagcccttggttttctaccttaaggttgggctgcactaaactttcatggttcttctgcattgcaggcttgagtgatgaagaggaccagaagccagtgcgcctgcctctgaaagtccctatagagctacagccgcggaacaaccacgcctgggcccgtgtgcagagccttgcccagaacccacgcctcaggtaacatggcccttggcacgcagaggggtcccaactgcttgagcaggactggaagcaacgtgtgtgagtttccctcaaggaacttccaggagaagcaggtccacccctatgctctgtcatcacacgaggacgcagcagtgtggaggcgactggagtccagggagcactgggctgcagtcctgtatctgggcagggatcgcccaacctgtgttcaggccgtggaggggatgtcgcggtgagaagaggagctgcagagccttcctttcgtcccccactaaggcccatacagttcctctcccacccgcttcttggagactcgtggctcgcatatgcacaaggcgccatcgtggaaatggaccctttttcatttgtacattttaaaaaatgaggtgaccgggtgcagaggctcacgcctataatcccagcgctttgggaggccagggcgggtggatcacgaggtcaggagatcgagacctttctggctaacgccgtgaaaccccatctctactaaaaatacaaaaaaaaaaggtggcaggcgcctgtagtcccagctactcgggaggctgaggcaggagaatgacgtgaacccgggaggcggagcttgcagtgagccgagatcgcgccactgcactccagcctgggtgatagagcaagactctgtctcaaaaaaaaaaaaaaaaacaaacaaaaaagaaattgaggtgactgggtgtggaggctcacgcctgtaatcccagcactttgggaggccaaggcaggtggatcacgaggttaggagtttgagaccagcctggccaagatggtgaaaccctgtctctactaaaaatacaaaaaaaattagccgggcgtggtggtgggtgcttgtaattccagctactcgggaggctgaggcaggagaatcacttgaacgcaggaggcagaggttgcagtgagccaagattgcgcccctgccctccagcctgggccacagagcaagattccatctcaaaaaaaaaaaaaagaaaaaattgaggtaaaattcacatatcataaaatgaacttagcctttttttattttttcttttttttttccgagatggagtcttgctctgtggctcaggctggagtgcaaatggcgcagtctcggctcactgcaacctccgtctcccacgtttaagtgattctcctgcctcagcctcccgagcagctgggattacatgcgcgtgccaccacgcctggctaatttttgtatttttagtagaaacggggtttcaccatgttggtcaggctggtctcgaactcctgatctcaggtgatctgcctgcttcggcctcccaaagtgttgggattccaggcgtgtgccgccgtgcccggtgaacttagccatttctaagtttgcagttcaggggcatttaacacgatcacattgttctgtggccaccgtctctgtccagctccagagcattttcatgacgctagaagaggccctgtgcacctcagcactcactcctctattctccattctcaccctcccacggccgccggcacctcccagtccgccttgtgtctcagtggacttgcctgctctgaacgtttcatagaaacggaatcacacgcagaggcctccgggcctggcatctttcactgggcgtgatgcttttgaggttcacccatcatagcgcatcagtacttcattccttccgctcatgtacttctccctcagaatgtattaacactgtccaggcccgcccgcccttgaagccagaaggagctggtagactaggcagaggctgtgcgccagcacccacgcccacgccctggcggagaccttttgctggcaaagaatacttgggatctctgtgttgttttctttagctctgtgtgaatctctggccatcgcagctggaaaggctggtttttagccacaggagccaagggccctgcagacgcccgctcccgggtgcctctccagaggtcccttgtctcttttggcaccctcctgctgtaagcagcctcgggactcttcagatggtttccttcctgttctgcgaacctcacttcctcctgtctgtcgtctccgtaggatgatcgtggagctacatcgaaaggtctccagcctcatcgaattcttgaagcagaagtgggcgctccatgaggtgcgagttgtatccttttccagctaaagcaaaccatccaggctgcgctgcctctgctgcccagagatggaccacgcctccctgtgcctgtcatcgtcatggtccccgtgggcagaacagccatgctgtgacatggtgtacatctggaaccataacctggagccccttattccctgggtgtggagccccctctgtggccttgcagtgctagaactcagtcacagccagccctccacgatgtcagtggcctgtgtctggcccacggggtgtggccaaagcattcctaccagcaggttgagcaaaacgaccaagggtcagcccagccttcttcacatccatggctggctcccggccctgcctgctccccacataggcgtggtgcgtgtcaggtgtgaatttcctgaaggtactaagtgcccgggtcagcattgttgggtagtggtgtgaggaaagccacgggtggtggcatgatttataccctgggggatgccagtggggagcgtggctcgtgtctgtacccatgtgcctggtcagcatcccgacctcagtgctagccagtgtgggccttccttgacgggcactcagcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttcccccgaaagcgcccccggggagggggctgccctaagcttgagcagcccggacgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggtgagtgggttggagcccagcccctctggcggcccaagggaagccaggcccagccttggagggctccctgctgggtagctagggccagcacggttggggtccagatgagagagacagggtcctgtggcagggggccaggagccttcaggacctcaaggaagtgggagaggcagggacccaaatggtccgggagacagaggctctccacagactactttcctctccctcgaggagggatcctcgggcacttgatgagtgtccccacttacgtgcacggttccagaagtgcagtgatgagtggcctgggtgctcccttctgtgtgggacatggaagaagacggccaacaggcaggcagtaccttgtgagccgcctcgtgttcctgggagtctgccaagcccaatcatgcagctgaagggacagtgtgcacaggacccagggtgacagagtgaggcctggagccgagctagccttctggcttatctaatcactgttaacaggtttccacagagggaacgatgggtgtagttcttgctctggaaagaccatcccagctgctgtgcagatgtggcaaagtcagaggctgtcacagaagagcagggatgcggtgccgcagcagaatagtggagctggggaccagacaggacggtccctgcagggtgtgggtggaccctgagcctagggaagggtcccttaccacagggaggccagttggtggagccgacagatggggtgcagaaggcactgctgccaggagtaatcctaccccacagccccaagtccgataggatctctgggtgcaagagagcaaggtcccacggcaggtccatcctgaaatggcacgtttaggggctggcgagctgctggacatgggcgaggggctcaaaggatggactgggcaggagctgcaggtcactgtggaccccttagcgctgtttcatggtcagaatgtgtgtgaggctcacatgtccctgtgctggggggactcgggactcgggcgctcacgagcccccacacacccactgctccacacaggccgtcttacagcttctgagtgatgctcacttctgcctgcattccccacgcctcccgctttttttccgctcccacccccagccggtgcagggcttgccccggagagttggtccatcagcaggtggcaggaatgtgcagatttgcctggggagcatcaagggggctggaggaaagaaagttcttccaggggtggtggagactgagcccaaccctcaggcacctctgaggccaagcctgagggtgaaagtggctcgggggtcgcatagcagggacaccagggtgagtaagcggggaccagaaagacagtgtctttagaaggcttttcaggtttggcttttggtgggctcatgggaggggctgaggagagacatggcgcctgtgtttgggtgccccagggaaggggccagggtgggctcctgagagggcaggcagcagttctgggacacagagcaggtaggaatcccacatggaaaggcatccccatcccctgggagctagttagggaggctgacttggggtgggcctggcagactggacagacagacagacaggtgcctgatgcagctcaggtgtggggccaggtggccctgtgctgtctcttgcctggtggagctgtgacaagcaccccaaaaggcccgagccccagagatcaggagatgccggaggctgctgagccgctgtcgcaggtggaatgagtagcataggaagggtcatgaggtgggaggggtcctggggaaagcctgtagtatggggctagggcctgaaggctctgagtgagcagacgggcagggctgtgctgagagcacggggtggagggcttcttagtccatagggaggttgccccgggtgggatgtgtggggtgttcaggagagtgaggagaaggaagagagccgagaggctggggtgctggccgagtcttcccagcggtggtggcgtttctgtggtgagccagacagggaccccaggactcggcagcaggctctgcaggctgtggcgtgggcctgcacatcccctggggttgggctctgtgggcctgcacaacccccaaagttgggcttcatccctgcagagtgctcttcagctgtgcttgtgtctgattctagaaagtcagcctatatttccttcctctgactcacaagcagagaggctgctgcagtctcatgttgactttttaatatagctttgagctcttgacacttgtcacttgccatccggcacctcttcctgcagcctgtgctggcacttcgggctggttccctccctcccacctctgcccgtagcacgtggaaaggtacttgtgaggaagggagtggttttcattacttacctgaccagtgacttttattgattgattgattgattgatttttttcttttttttttgagacggaatcttgctctgtagtccaggctggagtgcagtggtgcgatctcggcccactgcaagctccacctcccaggttcacaccattctgcctcagcctccagagtagctgagactacgggcgcccaccaccacacccggctaattttttgtatttttagtagagacagcgtttcaccgtgttagccaggatggtctcgatctcctgacctcatgatccgctcgtctcggcctcccaaagtgctgggattacaggcgtgagccaccgcacctggccgaccagtaacttttaaaactggcaagctgccaagcgactctggggacactgaggttgggcgtctctggccctggcctttgccgtcatgacactgtgctttctgagctcgatgattttcttgtgcctcctactccagggcacgcaagagccatttctcatgtgctgagtttggacattgtttggcccatttctgtcctaggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtgaggctgtggcagccacactccttgtgcctgggctgccctgatggcacctcaggcttcaggggccgtgccgaagctgagagcacaggtgtgcctgaggccggaccccactggccagctcgccactatccagatgacagggtgaaggtgcagaatcactgcctcctcatggggagggtgatgccagggcttgtcgtgaaggactttggggtcccagggcgtagaagctggtgagaagccagcctttgccagtctggtgactttggggtctgcttcatggggccagcaaaagccttgctaatgtgctgagttggtggttcaaagtccctgagaaggttgttttttttctgtttttctttacatgtaaaacctcagaatagagaatccttcagttaggggaggtgccagtaggttaacacaagtcccggaaagaatgatggagcaatctccaagtccacagtctaccccagctgcgtataggaaataatttaaattcagggatcataaattgtgttcctggtacataaaaccccaagacaagcatgaacagtttcccgaggcatcagtttcactggctttcaacccatagtatttttagaataaagcagagattatcatggttagaatggtgaatttttaagtgtaaaaatggtgagttttagactgggcacagtggctgatgcctgtaatcccagcactttgggaggccaaggctggtggatcacctgaggtcaggagttccataccagcctggccaacatggcgaaaccctgtctctactaaaaatacaaaaaactagtctgacgtggtggtgcgcgcctgttaatcccagctactccgaaggctgaggcaggagaatcacttgaacccggaaggcggaggttgcaataagccaagatcgcgccactgcactccagctcgggcaacggagcgagactccatctcaaaaacaaaaaaaaacaatgagttttcaacgtaaaataaggcccggaacagtggctcatgcctataatcccagcaccttgggaaaccaaggcaagaggatcacttgaggccagcctgggcaacatagcaagaccccatctctacaaaatataaaaataaaaaaagtagttgaatgttggggctcatacctgtggtcccagctactcgggaggctgaggtgggaggatcacttgaacccaggagttcaaggccgcactgagccgtgattgtgccactgcactccagcctgggtgacagagggggccgggtgagaggtcctggcctcctgggtgacggagggggccgggtgaggggtcctggcctcctgggtgacggagggggccgggtgaggggtcctggcctcctgggtgacggagggggccgggtgaggggtcctggcctcctgggtgacggagggggccgggtgaggggtcctggcctcctgggtgacggagggggccgggtgaggggtcctggcctcctgggtgacggagggggtcgggtgaggggtcctgtgagagggggccagtccctactatgaaagaattttttttttttttttttttgagatggagtctcgctctgtcgcccaggctggagtgcagtggcgtgatctcagctcactgcaacccccacctcctgggttcaagcgagtctcctgcctcagccacccgagtagttgggattacaggcatgtgccaccatgctcgggtaatttttgttttcagtagagacagggtttcgctatgttggccaggctggcctaccatgaattcacagggtgatttacagcagcactgacagtgatgaaaacatttagcagggtcccacaatactaactctcaaatatttcctgttcttttacctctgggtctgttttctaaaaactagagatttacaccagggagcagcaagctataggcctgcagcccagatccagctcactgcctgctgtttataaataaagttttattggcacacagccacactcatttgctcacctgttgtctgtagttgctattgtgcacggctgagttgccccagagacggtgtggtctacagagtggacattggttttctggcccttcaccaggaaagttgactgacttctggtctcccctggagacactgaaggctcttctagccctggaacatctttggtgtcttatctgcccttacccctgagcactgagcgaagtggtgaagtgcttttgtcctatccaggagaccagtggtctgctcaaaatgggaacaagaatttcagtgagaaggatagaaaatcagtctttatgtgggactgagatagaggtgtctcctttcaaggcagccgaacgggttgccaagagaatgtctttctgactttcttcccaacggaattccgtgaccctggacctgttgctaggtgaatgctgtcacactgattctctcctctcctctcccaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtgtgagtgtgtggggccgggccgcccgcgtgcgagcgtccccgtggtctggagagtgcaccttcaggtgccggacgctgctcccttacagatgcagtcggatttcttcctgccaaagccccggaagctgcggaaccggcacctgcggaagccactggtggtccaggtcagggtcttctcaagtctgaacgtgtggcctcgtggctgggccaaccaggacacagggcttcttccctctctcacattttcatggtgtaaaatgtgggaaattcctgccccttccttccctcttgtgagtagggtaaaaatacaagtaataacagtgaacttaatggtacccagaagtaaaggtaatctttcaataacatggaaatccacttgcaaaaaagacaattatagggattcaagtccaaagaatgtcccagattgggatgtatttatggaatctcaacacctatttataaacatttagtctgtgggagcagttgccagggcatgtgggtcagccagagcccaggcctctcatgagctccccaggagtccccgaggatgccgtatgcaagcctgggggacagccagggactcagaggcacctcagaagaagagcttggcattctgacgcataaaaatacagaaagtgaggtgggaagtctgaggtaattatggcctcagaaatgtatggatgtgtgttattttggattcatgcacaggtttccttttgttagactcttagaaatctctttctcccttgagattagtatatttacaaatgagacattgcatgaacggtcttaggaagaaagtgcctgctaaatcttaggtgttctttgttcaaactaagatcagggttgaaaactatggcccagggaccacttccagcctgactgttgttttgtttaatttaaaacaactttatagatagagaattcacatatcataatgtttgcccatttgaactttatgactcagtggtcacaaggtgtacgacgaccatcaccatggtctaatcccagaacgttaccacccagaaaggaaaccctgctcctatgaactcacgttgccttctcccgccagcccttggcaaccacggatccgctttctgtctctatggatttgtctgttctgggcatttcctataaatgggatcatacaatttgtgttcttttccacataatatttttgtaaataaagtttactggcacacagccgtgattattcatttctgtactatctactgttttccacacgggcaggtatatggccccaaaacctaaaatatttcctgcctggccctttacagaaaaagtgtgtcaatctctgctacaaaaagtgtagcctttggagtgaaagctcccgctactaggctgcagcctactgctgtccctagtagtgcctcctctctagtctctccgacgccagtgtcctggggcatttcaaagggtcagaactgcagcggcacccccagaggcggaagcgcctcagacacttgtaggtcgagagacacttttttgttcatgttttatctggattactagcagtttcagtgatgaacacggtttctcagatggtagtccttgtcactcaaacctgccgtagcacattcagcctaattgttcacacacaaaagccctggaaaggagcacttcatgccctttggtgcctgtgtgttacaagcagtgactttattttactcaccccatgtgtgaggaagcccagaatgggaggtgtcactcctaaaagtccatgtccagtggttataaacaggtttgtataactagttgcattccagtcaaatccagaagaaagttctggattaaaagtggatcaggccaggcacggtggctcgcacctgtaatcccagcactttgggaggccgaggcaggtggatcacctgaggtcaggagttcaagaccagcctggccaacgtggagaaaccccgtctctactaaaaatacaaaaactagctgggcgtgatggcgagtgcctataatcccagctactcgggaggctgaggcaggagaatcacttgaacccaggaggcagaggtttcagtgagccgaaattgcaccactgcactctagcctggctgacagagcaagacaccgtctcaaaaaaaaaaaaaaaaagtggatgactctgacattcctccagtttccctggggagggtttgattacctgggtttgtttgagagaggacctaactggagcttggggtacatgggtcctaactgtctgagcagtcccaggtaccctgtgtcatcggctctggaaaaagccccacctggctatgctgggcaccctcttacttgggacattcctttgtaactgggagtgattttttggtatgggagtttcatcaccttgattgttgaccattttccccacagagaacactgctccctagaccatcggaaaaccagtcccacaacgtttgttccttctccatcctgtctaactcttccgtaactggtaaggaccctgagcttttctggggtagcttgtccctcctcctcacaggagggccttggctttggagacaatgggtgcttatttccatggcctatcttcaggcattcctttgtccattctaccgacaaatacctaatgtgccctatgtgctgggctgcaggctgcggtggcgggcgaggcagctagtccagcgaggcagctagtccaaagggtgcccttcgtctgtggcctcagatggccctgtgtgaggcgcttggcttggttagagttgtgtctcttgtctgctctctctgtgtaatgtcttgtcagccgttttatgggatggatgtgttcttggggtgtatggattatgcttccatcagtctgtacatttagtgggggccttggctccttgcggtagatattacacagggagaagcctctagtgaaacacatactctgtgacttcccttttctaccagtgttgacttccacgtctctcactgacttattgcaagacccttaacagctgtcaattgctttttctcttgcctacttgtcaattttcaactgtgggaagcctggcaagataaaaccaaattgcagtggcagcatcttagtccagaatctgatgctctgactgccctggggcctgtacctcagcttgggggcttgtcacccttcaagagccatttccgcaggatgacagtggtgaccgcagccttccagtagctcctgggaggcacagtggtgggtgccagagcttgtgtcacgttgggggcctgtgtgacctctgactcctcatgttagcatttggaatgttcagtggcttccagcttggctcggctcccacactcccaacagtggctgtaaaggaagccccctgcggccacatcctgctgtgagggcatggcgggcgggctcgacatgtctgcttttgccctcgccctcgcagggagaggttcgttccggcccatccagtcttctctgaccaaagcagctctgtctcggccgatcgtgcccaaggtccttccaccccaggccacgagtcacctggccagtaagtctgtacctgcatggccacagccactgagtgagcctctgagggatgtttttgtgaccaggttttttgaatgttttcttctccaaatcataatgtctcattacccttcaccaagaacatctaagcccttggctcttgcattgacatgaggtgcgagggagaagctgttccccgagccctcttgggacatcttatgggttgtcagtagagcagagatgtgcagcgtcctttttgttgccaggtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtgggggtgagtatgtttagaagggcttttcagcattaccaccaacttctggtgtggacgccaaagccatggggctgagatcacgctggactccagctctgcctttggaggagagtctctggaccaggggtgccatggcataagcaaactctgtgtagtacagagcaggagaggcctccggagccactgacgaaaggtggggacaggcttgccatgtggcactggagaactcagagctaagacggtgtggaaacatagctccatctgagagtgaccataaccaaggtggcagcccacagcgctgtgctcggacaccactgagcatctctttcatctgggaagagagcagcctgtatggccttggccattgctcctttccaaggctctgagcacctggtttctctggcctcccacggccacttcagagctgccccaaggagggtggggtgggctgatgctgttaagactccagggagcccagccctgcctgccacaaggttgacttcctgataggactttacttcactcttggaagcaacaaaaaattggaagtacacggtccacacctgaaagtagcctttcagtgttctcgaccttagacccctgtccatttactgtccctctgctgttaggaggccagggggatggaacgcctctttttctggaactctgtcgcgggtgagggtatgggtggcatctggtgcaccctgcggctgctcatgggcgtgctcttcctgcagggctccgacccatttgtcagcatcccttcgaggcctgagcaggagccagtggcagacagtttccaggtagagtgtgctcttgggctgctgagcaaagcagctgccccaggactccctccagtgccctgagctgccacctgcagtcttggagtggcccggcttctctcctagactgtgcagtggctttgctgttcttccacctgctgtgccgactgcccagggtggataaatgaatatggctgtccgccacctcagacttccctcctcccctctccaaggtgggctgtttcagacccagctctggaagaacttagcgctctggaagaactcagctttctgggaggaggaggctgtcagctagtaactcccccagcccccactctctttctggcagcagtcaaagcaggtccaggccactgcagcctgactttctgactctgccatagtgagtgtttttgggagaaataaattccccgagtgtgttcctgagttggaaggatgaggtgactgcagcgctcatcaccctattgatttgcctgcaagctaggagagtaagctggtgtttcttcccttgtcatgggttctgatagacctggttgtgtctgaaaaatacctgtctcccagcagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtaagggcagggcggcctcacagcccttcctgtcatcaggtgttgatctcctgccccaatgtttgccacacttcctggggatattccagttttgtgatttttacgaattgaaaacctgtcacctacaaggtgctgcctgtctccagcagggaccttgcaggtggataaggtacctgtgggacctgaggcagctgatggcctggtaggcttgctcctgaccttcaggcgagacagtggaatggcccccaggtgctcttcagcctggggatcacagagtgttttcctagttgatcttgaacctgagcaggcggcctggggtcttgcacagcttgtgaagcagttgggctgggccctgtgggctttggtctcacctgctgtctgggacaaagctcctgggggcagtggtttgttgttcactggcgcgacccaggctgtgggctgagagagatatgagttcacagtgtgctagcatgtagccttgggcagctcaccaccttgctgagcctccctttcctaagcggtaaattgagaataaggtacagctcctagggctgctgtgggtgccgtgagatgactcatgtgcaacccgtggtggctactgccgtcgccttcactccgctgcgccctgcctccctgcagagctgttctgcggtgctgcgctccttacctgccgagccatgccatccatctggttcagcagggtagagccctgcggccctgctgccttctccgtggtgggctggagaagtgagttgctgttcaccaccccgcaacaaggcgtttctgatctgggatcttggttggcaggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttggtgagtgtatggggagggctcccatctccttttccagggcagcaggggctggggtctgcgggacactggattctcattctactcaaactcccactaggactgttggcttgttcgcttctcaagtgtttgtatttttctgagttaatatttttgggtgtaatttacatgtaggaaaatgtacacatttttagtgtacagttcaccaagctttggcaagcatgtatagcctggtaacccacaagccaatggagacctagaacattcccgtgaccccagatgctgggttctgtgtgccttcccagtctgttcagctagcccggcccctcccgactgggttctcttgaggggagaaaaggaaactggtgtcttggcactctcttggctcttctctttctgtggtcagtaaggtattcagaagtggatggtccagctgccacctggcacattcttgaatatagatcggagagttcagaggacgtgtccatcctcctcccccactgcccgtttgcccactgggtagcaagtgtggcaggaagggggtgtatcagggaaaggcacaccctgctgctgttgcctgcccagagagagctcccatttggatgtctggggtcttcccgcccacagttgtacggggccagggcttgtggctgggcacatcaggcatggcgggtaccatgcctgacagctctgaaccagttgggcgacctgggtctgggaggtgctgagggacccagcaccctgcaggcgtttccttttgtctcatgtagcagtgcagatgtttggaaagtcacacgtaaatcttgaaaaactggaaacaggccaggcgtggtggctcatgtctgtaatcccagcactttgggaggccaaggtaggaggactgcttgaggccaggagtttgagaccagccttggcagcatagagagaccttgtctctacagaaaattttaaaactagccaggtgtggggggtgcatgcctgtagtcccagcaactcgggaggctgaggtgggaggattgcttgagcctaggaattcgaggctgcagtgagccatgatcaccactgcactgcagcctgggcaagagcgagaccctgcctttaaaaaaaattaaaagcaaagttggaaacaacctgcatgagactagtcacagagaagaaagtatgggggtggggatggcagtgagggtgggagagcatgatgggggtgggggatggcagcgagggtgggagaccgtgatgggggtgggggatggcagtgagggtgggagaccgtgggactcgtggaaaacaaggtgcatgtctgtatgcacgaaggcctgttaaacgagaagagctcgtcacggcgtgttgagtccctcggaagctcttcgcacaagtctggattggggccggggccggggctagggcttgggctggctgcccccagcctcaggacccttccgctggactggtccagaccaagcagggttcagggtgttttcctctggccttttctccgcagcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggtgagtgcattgacctcacagctgcacctgaccaccaaccctcgtgccagaggttgccagcactctcctgcacacctgtgggttagtaagagctgtttgccaagagtagaagaacaggagacagcacgtccacactcaggtccctgactactgagaatggagagatctggggacgctgggccggctctcgtccccacatgcagaatgacagacttagtcatagctgagctctgcaggcctctgaactggaaaccctggtctggggcgcagagcagggtctctgaaggcagccagagccgagtggggatgttacctctccttccctggctgtgaggtgctgaggtgcggggagtgttgtggagggaggagtaaggggtggtggcagcagttgtgttgtcagtgctcccatcctaacagcaggacctttgagtggcatctccctgtcatgttgagctgcggtgcaggggaactgggatgggctctgctgtcctcatgcttctcccacgcccagggtagtgataggaggagtcactggggcaggttcttgaggggaaggcgaaacgtggtttgtgactctccacttttgacgagatgcagcgtccctctttgttggccaggccatctggttgtagccctcaaggcgtccaccacatggtttgtgtggcattcgtgggcaggtcaggcttgcagggtgaagacaggcccgtttcactgtgacgtaaagtgcagagtggcaggtgtgtgggcagtcgggtgagggctctatggacagggagggaactccaggtccaggagatcatccgcatgggcttagcccatgtgaaagtcctggagcagcattccccgaatctagtccccacaatgttgagacattggcaggtgttccttgaggattttgtgggtagatacttgagggacaccctggatccaaaaaagctcaaaacagctgtttctcacggacacctccgctacccagtatccgaatgtgaatcgtgactcttgagatgatgaactcatgggcaggctttggagaattccaagccaagccatgatatgactggaaattttagccaaatatacacatagacacaattaatagcgtagacctccatctcacagtgtgtggcgtttctcaaacctgtttggccccagaatcattattcagggcacaccttggactctgatgtttcccgagaagccagtctctgtctcttcccctgtttgtgcgcatgttcctaagtgctgggctctgtggagatgggcgctgcgtacgtgccctgaggcagcatgctcacgccatgctgttgaaaggacgggccacagcccagtgacaggagccccttggagtcagaaatccagagtgttagcctcaccccaatcagaatttgcacctttaataaaatcctgggcaacagatggcacttgggagtgagtagcagagaaagggtgcagttagtatttgtgaaacgctgcccgtcgcgagtaatgcaaacgtgttcaccttcagaaagagcagatcagcgtttagcatgagattttcccgagagccctccactcagaacgtgagtatgtttctcagcaggtcctcgtcatctggaaggatgggctgaggcatttgtggatgaaagggtctggtggtagggctagcatgaagggggcgggggtggagctgggtggccctgggatgaaacgggtgggagctgctgatggacatacaggggaaggagaattactctttgctctgcttttgaaaacaaattttaatttgtctgacatttcccataatcaaagcataaaatttcatttacgccatagctctattcagaattttccagacttcttgcattcacagtgtcatgcagttcattaagggatatttctgcagggtctgctgtgtgcaaacaatggcccctgtcctcatgaggcttctactctagagcaggacgcagacaataagcgctgaaaacggcacattctacgtatttgctcatgggacaagatcccggtgccgaggccctcccgtcctccgtctcctcagctctgtgctgcctcactcactctgtcatggccaccaccttggtcgtgcttttcagtcaaagcctcttcctgtctcagggaacatgcctgttgcttctttaaaaaggaacgtactccccatgtgtcctcatgtctctgacgggaacgtgctccccacatgtcctcaggactgatgggaacgtgccctcaccacatgtccttgggattctgacgggatcgtgccctccacctgtcctcatttctctgacgggaacgtgcccccagctctcctcatgtctctgatgggaacgtgcccccagctgtcctcatgtctatgacgggaacgtgtcccccacctgtcctcatgtctatgatgggaacgtgtcccccacctgtcctcatgtctgtgatgggaacgtgccccccacctgtcctcatgtctcttgacgggaacgtgtcccccacctgtcctcatgtctatgacaggaacgtgtcccccacctgtcctcatgtctgtgacgggaacgtgtcccccacctgtcctcatgtctatgatgggaatgtgtcccccacctgtcctcatgtctatgatggaaacgtgtcccccacgtatcctcgggttttaccccacctcccgctcaggtcccagtccttggagcaccctctctggcctccttttcccggcactctctgtcccctcactctgcatctgtttctgcaggctgcccccagtgcctgtgtctgctgcatacagtctgtctacctgttgggtgtcttcccccataggtctcatggcgggcggggggaccagcaccctcaccccagccatcagatgtgccaggcacatcataggctctctgcgagcacttatctaaagagtgtgcgggcagacgacaggtgattgtgattctgcacagagccctgggctgccatccctagcttagcttcctgcagcgggagtcgataggagcttctcgtcctgtttcaggacccgccctccactgaagggccagcaggtcgcggtgacttgttcttcctgtctcctcttcctgcaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaggactgtcgtttgtgcctgttcttcagggccgcgcgcccatgcccgcagtccctggtcgggcaggtgcggcccaggtgcggccccgcggtcggctcgcgggctcccgcagaccgggcttcctcccgagggcgcggccgtcccagggcccgcccggcccgccgcccaatgcgagctcccacctccgcgagcggcgtcgccttccccaatcggctgcgggcgcggcgccgaccgttcaaagcctaagtcgtcgggggtgggcgtgaggggcggtggccgcgctgagataggctgcggagggatgattggcgtcttggcgcccaatgggcgctggcgggcggccttgagtacctgcgctgggcgggcgggaacggcgcgcggcgagctgagggtggcggcggtcgacatgttccaggtcccggatagcgagggcggccgcgccggctccaggtgcggcgcggggcacacgggaggcgggcggatagcgcgaccacgtggcgggagcgggccagcccagggcgtccaccagccgtgtggggttggggtggggttggggggcagggcgacctcacagaggccctcggggccgccgcccgcctttctgcgccgccgccagaccgaggcccgaagcccgaggggccgctcgctgaggcccgggctgtggagagctgcccgcgaccgaggccgagggcggggaggggcgcccgggctctgggaacaaagctgtgtggagggcgggctgcgctccctcgcgcctgggcgcccgcgttccgtgtggtgcgttccgtggggggtttcctgggggcggggtgtgcccgtgggtgcggcccattttgtctgtgggatgcgtgtccatgttcccgggggggtgtccctaaggggtgtgcggcgatgtgttcgtggggggtgtctggccatgcccccgctcctgtgcgtgtggccgtgtgcccgtgtccctggtgtgtgtgtggcctgtgccctgcccatggccgcgcttccactagttcatgtgagtccacttcctttggaaagtgccagggcgtctggggaagagtcagttctatctcctgggaaggtggatggcgctcctgggcttcgctgtaggaagaagtggattgggacgaagatatcctgactcagctttaatagccaggaacactgagcacacttttcttatgtttttgaacttttaaagcactctttgggtattgggactcgcatgaattagagggacagagcttacaaggtctttcgtgccacttgagcagtaaacttgcattgtgaagtttgggtcttcagatgcctgaggttttctgtatgatgagcccctctgtggcacagcctcgccagagaagtagaagagaatatgtgtgccatgactgttaagaccaatactatattgcttctcagccttttggctatgatcaagtgaagacaaatactatattgaataaatactaagtaaaagaattgctccaacttgctaaaaataaaaaccctttagattggccgggcgtggtggctcacacctgtaatcacggcactttgggaggctgaggtgggcgagtcacgtgaggtcaagagttcgagaccagcctggccaacatggtgaaacccccgtctctactaaaaatgcaaaaattagccaggcgtggtggtgtgtgcctgtagtcccagctacttggagaggctgagacaggagaatcacttgaacccagaggcagaggtggcagcgagccaagataatgccactgcactccagcctgtacgacagagcaagactccgtctcaaaaaaaaaaaaaaccctttagatttgagggagttaggtcagtattcagtaatacttgtaaccaaataattacccgtggcagggtgcagtgactcaacggctgtaatcccggcacttggggaggccgaggcaggtggaccacgagatcaggagatcgagaccatcctggccaacacggtgaaaccccgtctctactaaaaatacgaaaaaattagccgggtgtggggtggcgggtgcctgtagtcccagttccttgagaggctgaggcaggagaatggtgtgaacccgggaggcggagcttgcagtgagccgagatcacaccactgcactccagcctggatgacagagcaagactccgtctcaaagaaacagcccttcatccatggaacagtgattattatgcctaggtctgcaccgatgtgggaccaggagtttaaactagtgctcagagcgaatccggtttctggttcctggtggccagagttttgcaccacccacatcagtggggggagggactgcatccccagccctgtcccagttgtgtgcatttagtacgtttcctttttgtttgtgctgcctggcactggctgcccggtaaatgatggtgtttattatcaccctgagcgacgccgatgtttttatattgactttcacgctccagaagttagctgcacagggccgcactaaagtcatactcacactaccctgggggactggtttctggacaaggtgttgagaaagggagaaaactcttccttttaggatggtgaggaaggaaagccggtctgaactggatgatgaggtatcactggaagcttctgcttggggtccaccagacgctgcacatttgccactcatctgaacggggtcgagtcgcagggcgggcgccttgtaagcgtcacatttagttttgctgtgaagcgagtcaggtggtggctgtaagattacctagccaggttttcctctcctgagacctcacatctctcctttccttgctgagggattgtcttgtgttaaaggggtttcgtaaaagcgttatgctttagccgcgattaacctgaggtcttccttcaagctggaacatttctatttgtaaggaatttaatccaagtttatttctcactgcttctctctaagcctgaccagtcccctcatcctttctgaaactcggggacaaactattagagagggtcaggagcatggagacccccgaggagggtcacacagcttttccctacctctccagtgctgcagtccactccagctgtgtgaggtttttcttctcctgtgcgcttgagtttctcttgtgtgttttgaatatcttcactgaaatatatggaaggggtaccacaaaaggcaaaaaataattgggaagcaccccccactcacattgtgaatttgtccccaaatgtgtgagctctagcgttccccctccccctattagtgtcatagtggtaagtgcctgtagcctagagaaagccacactgcgccattgttgtcgggctgtttttgttgaaaggtctattgaacgctcagttccattcatccgagacccctttgaggcagcccagccctgcggtctgtgtgaaacctgcagtgggacctgttgcctttgtgaccgagatagccgctgccccttgcctggggctgggcctgtgtgcgccataatttctgctaaaaccgtctttggtaccacttttttttctttgcttgttttcaaataaaattcagaaaagcacatagaacaatattaaatattgtgtttccatcaccccaaagtaacactggtcattgcaagtaactaccactcacctcctgcgcccattggtccccattccacatggaggccacagactcaatttgggtttcacctcttccaaattttggagtcccgatggcactaggcgtctgtcacgtcactcacacagacactgaaaccacctgtgcagagctctagctttcctgtttaaacttgaagctcctccggggtaaggacttgctttcctctatctacggcgtctggggaaggattgccaatgataggtgctcgagagatgtgcaagttgaactgaagcaagggtgaaaggcagaggagacaggagactgtgaatgtagggaatgtggggtcgggaaagagtcctacagagcttgcagtcaaggcgagtctacctggaatcagatctgacagtttgtagcaccttgagggcttgagagaaaagccatatttgaaataagtcagtaaaaggaattatagctcatgctcagctcacataagacttgataaattcagttcagttcgaaagattgcaggccttcatcccttatttccaaagagagaactgtagagacccgtgcatgtttagacctgctacactatccaagaaaaatcgcagaattggctgggcacagtggctcacgcctgtaatcccagcactttgggaggccgaggcgggcggatcacttgaggtcaggagtttgagaccagcctggccgacgtggtgaaaccccgtctgtactaaaaatacaaaaaaatagccaagcacggtgacgcacacctgtaatcccagctactcggaaggctgaggcgggagaattgcttgaacctgggaggtggaggttgcggtgagctgagatcgcgtcactgtattccagcctggtaacagagtgagactccatctcaaaaaaataaaataggccggacacagtggctcatgcctgtaatcccagcactttgggaggctgaggtgggcggatcacctgaggtcagaagttcaagaccagcctggccaacatggtgaaaccccgtctctactaaaaatagaaaaattagctgggcatggtggcgggcatctgtaatcccagctactcaggagcctgaggcaggagaatcgcctgaacccaggaggtggagattgcagtgagccgagattgtgccattgcactctggcctgggcaacaagagcgagatttcgtctcaaaaaaaaaaaaaaatgtagaattaggagggctgcgtgattcaaaaatggatatggaagtcagatggccttatggccactctaagagcacctcacctaaaatcttgttaagccacgccctcccacccaccaccctttattttttttccttttggtgaaacaagtcctcactctttcgtccaggctggtgtacagtgatgcaatcatggttcactgcagctttgacctcctgggctcaagccagccttagcctcccgaataactgggacaacaggcgcataccaccacacccagctaattttttgtttgtttgtttgtttttttgagacggaatctcgctctgtcacccaggctggaatgcagtggcgcatcttggttcactgcaagctccgcctcccgggttcacgccattctcctgccccagcctcctgagtagctgggactacaggcgtccgccaccacgcccggctaattttttgtatttttagtagagacgggatttcaccgtgttagccaggatggtctcgatctcctgacctcgtgatccgcccacctcggcctcccaaggtgctgggattacaggcgtgagccaccacgcctggccttatttttgtattttttgtagagacagggtctccccatatgcccaggcgtgtctcgaactcctgggctcaaacagtcctcccacctcggcctcccaaggtgctgggattacaggtgccaggtactgctcccggacagccctttctcatttaagcttggttattggttatttttaaaaaataatttttcttaagtgcacctgtctttttttttctccctcctcaaatcctccaggaaatggcaactgctgacaggaagtttggcatccacctcccccagcctcctgagtggacaggggccctgggcaccacttcagaggtcggccagcacacgcttggtttctggggtacagtagccagcccgtgggtctctgcaggcggagactgaagcactctctgccttcctgctttatagcaggagatctgagaactccattcacatccagtcacaaggagccctcagcgctctttctagatcttttgaggagaaactgttatttttgttaaccaaaccttgagtggtcagtgtttgcaaagctttccagtgagatctaacctcatatcatagtttttgtgtgatgttgagccctgtaatttcaagtatggtcatccttggtatcctgcgggagttggttccaggacccccaggatgccaaaatccaaggatgtgtaagtccttgatataaagtggtgtaatgtttgcatataacctatgcacatcctccatatgcttttaaatcatctctaggttacaaggttacatataatacctaatactatgcacatagttgttacaccgtatcacctggggaataatgacagaaaagaagtctgtagatgttcagtacagatgcaaccatccttttatttctgacattttgatctgaggttggttgaatccatggaagcagagcccgtggatacagagggctgacttcgtttctaaacgtctgggatcacagacagtcccattgcttaggactagtgagagagcatgtgccactcactggtttaaatctcaatttcagtaagcctctctctcaaatgcatttaaaagtttttccagttgttatgaattcagcgtttcaccggtttttaatgtagatagtgctctagaaatagagctttgtggcaattccttattagttcttaagtttaagtttttacaataaaaagtgattcaagagccaggtgcgatggcccacacctgtaatcccagcactttgggaggccgaggcaggtggatcaccccaggtcaggagttcgagaccaacctgaccaacatggcgaaaccccgtctctactaaaaatacaaaattagctgggtgtggtggcgcatacctgtaatcctagctacgtgggaggctgaggcagaagaattgcttgaacccaggaggcggaggttgtggtgagctgagattgcgccattgcattcctccagcctgggcaacaagagtaaaactccgtctcaaaaaaaacaaacaaaagttagccaggtgttgtggcaggcacctgtaatctgagctactcaggagactgaggctggagaatcacttgaacccaggaggcagaggttgcagtgagctgagatcgtgccactgcactccagcctgggcgacagagcgagactccatctcaaaaaaaaaaaaaaaagaatacttttaagggaaactaaagagcagcagaagtagtctggcgtctgtaaactagtcataccagtattaactaatggtggtatgtgatttctcagtagatgttaagaaaatacttttgctgggtatggtggctcatacctgtaatcacagcactttgggacgccaaggtgggcagatcacttgagcttaggggttcaagaccaactttggcaacatggcaaaaccctgtctctaccaaaaatacaaaaaattagccagctgtggtggtgggtgcctgtaatcccagctactcaggaggctgaggtgggaggatcacttgagcccaggaggcagaggttgcagtgagccaaaatcacgtcactgcgctccagcctgggtgacagaatgagaccttgtctcaaaaagaaaaaaacaaaatacttttaccctgtctagttgtgccaaaatccttgcacagtgacaagctttcaggtctgccatcagtaattggcatgtactctgtgcttgtagggccatgaagcccccaggaggagaatcgagcaatctttttggaagtccagaagaagctactccttccagcaggcctaataggatggcatctaatatttttggaccaacagaagaacctcagaacatacccaagaggacaaatcccccaggtatgggcctttggaaatccttaatcctttggcctccacgattctcttttgaaaatattttctgtttctttatactgatcctttcccatattgtctggttcaggtaatcacttgttatcagagttcttccaaaatgaaaacgttctgatttgtactttctctcttgaaggtgacttgagtagtcttgaattctccatctgttctggagactttggttgaatacaggcactgaggacacaaaagtggacgggggcttctggttcctgccagggagctgctcccaattgttccacggacccccatgagattcctgaaattgcgtgcaaattattgtgcatttaaacatttttcctagggagggagagtgtttttattcagatcgtcagtgggattgaaactcttaacaaggaagaattgatctagcacacatctacatagttcttcagtatttacccaacctcctagtggttacagtaggagggactctttgaaaaaggtttcttggccaggcgcggtggctcatgcctgtaatcccagcactttgggaggccaaggtgtgcagatcacgaggtcaggagatcgagaccatcctggctaacacagtgaaaccccatctctactaaaaaagaaaaaaaattagccgggcgtggtggcgggcacctgtagtcccagctactcaggaggctgaggcaggagaatggcatgaacccaggaggcggagcttgcagtgagccgggatcgcaccactgcattctagcctgggtgacagagcgagactccgtctcaaaaaaaaaaagaaaaagaaaaagaaaaaggtttctcagccgggcgtggtggctcatgcctgtaatcctagcactttgggaggccaaggcaggtgatcatgaggtcaagagtttgagaccagcctggccgacatggcaaaactccatctgtactaaaaatacaaaaattagctgggtgtggtggtgcacgcctataatcccagctactcaggaggctgaggcaggagaatcacttgaacccgggaggtggaggtggcagtgagccaaattcatgccactgcactccagcctgggtgacagctagactccatctcaaaaagaaaaaaaaaaaaaaatagaaaaaggtttctcttggctgatagactgtccagttgaataaccacccagtggaggttacctgagtcgctttcccccgtctgtacaagaggggaaagcatggtctcttccatccttagaaggtttgagaggccgtgcttaggtgtcactgtgtcaggcaggtcatgaatcagagccagatccactcccgacctcactccgttttggggtaccaatatttattgaccaaatgtagaggaaaaaaagcagtagatccagaaactagttttttcttttgtttttagtctgttttgagacggggtctcactctgtcgcccaggctggagtgcagtgtcaccaccatgactcactgcagccttgacttcccaggctcaggtgaccctttttcctcagcctcctgagtggctgggactacgggcgtatgccaccatgcttaggtaatttttttttgtattttttgtggagacagggtttaaccatgttgcctaggctggtctcgaactcctgggctcaagccatctgcccacctcggcctctcaaattgctgagattacagacatgcacccttgtgcccggccgaagctaggtttgctgcttgcctttttttggtctgtttggttgcttttttggttgttagagaaatgagtgtttcttattaagtgactaacattctcgttgtttccggtttatgaatttaggcccagggactcctgcatgtcctttttagcaaggatagcagaataatatatcgcatgcaagatagaatcctatctgagccatttccaggtgtatgaatctgctcatttggcccctactcagcagagtcatgtctggagctgttcctagagcactccatggaaggcaggcggtaccactttgcccgttccacatggtctcatgcccagtggggagcccggccccttgcggttagtgagccagcctctactcctggtcacagtgtgtggtgccagccatcatggctccccatgccaggttcctgcttctcatggtccttctcacggttgttgggagttttcctatctctccagtgctcttggaagacggtttatggtatattatcaagggaagcctgaaagggaaactgctagttgtgttcaccacccaacgagatctggagtcctgccttctttctacacttagtcacacagacctagccccacagccctctagttgcagggcttgattgagaaaagtatgcagaggccgagagtgtgtgtgaccgaccacatcatagccatcgaatgtttatcaattcccattcagtgtttcagtgaatcttcagtagtctctgtgttctttgttagtcacctggtttagatgttccatgaattgttcttcctcttctagcaatgatgaccaacgtctatgaattgttaatatttaccggggactgtgctaagtgctttgcatgtgtatttttcatttggtgttcgctataactaggagtaggttgttttgctcctttcacagaggaggaaacaggcttggaaaaggtcactggcatgcataaatcccaagctagtcagtagcagagctagtcggtagcagaactagtccgtagcagagctagtcggtagcagacctagccggtagcagtgctagtcggtggcagagctagcctttgaattgaggtttttctgactccagattccatgccttaaactgacttcctgaatgtatccactgggataaatttctcaaaatggaattggtagatcagatgatatatgagtttaaaatatggatagatagttccaaccggtttttcagggcattgcctggtgtttaccattcttgtgtatgtgcttatttgcaccagcagtatttatcttttagttttgcttttaaaaacaaatcttgtaggccaggtgcggtggctcacgcctgtaatcccagcattttgggaggccgaggtgggaggattgcctgagcccaggagtttgaaactggcttgggcaacatagcgaggcccaatctcccaaataaataaatgatatttttaaaaacaaaataacacagagcccttggaaatcaaaaatctagcaggaggaaaaaacatctctcgagtttatcttcaattattagtgaatttaagcatgttttcttgcttcaaagctgaatttatttttcaagtaaaatggtaatagacatatgtggtatgactacctagttatgaaggttaaaagcagaggtacattgtttagtacctattgcacgtatacgtggtaaaaatgtttgtggtttccaaaaaattcaggagtgtggtaaccttgggtgagagtgaaggaacacaggagtttctgggaacgggcactgttctcgatgactttggcagtggttacctggtgtctgccttgtagttatttgtgatagttaatgtcttacagacttttctgttatgtttcacagtttaactattttttaaaaatgagtgatgtctttggccaaaaacttcaaattgagttacttttatcttctattttaaaaagctggagtcacattaaaaaaaaaaaaagtcagccgttatagcacagccaggaacattgcagtgggggctgggggttgcacacacagttttatccgccccgtggtcctgacgtgcttgttgacacagccctgcagcattgctgagggcttactcagcaggccaggactattctaaccacgtcacctgagttaacttgtttagcctcaccagtgaccctaggtaggtatgattatttattaccttttttttgttttgttggttttttgagacaggatcttagtctgtcacccaggctacagtgcagtggcaccatcacagctcaccgcctccaacttctgagctcaggcagtcctctcacctcaaccttctgaggagcgggaccagaggctaattttaaaatatttttgtagagacaaggtctcacttgtttcccacgctagtattgaactcctggactcaagcagtcctcccaccttggcctcccaccgtgctaagattacaggtgtgagccagtgcacttggactgtttgttacctttttaaagttaagaagatggatatgaaggaaggttgacataacttgtccaaggtctcacagttagtgagcagctgagcagagactccctgacccaggcagtctggccacaggacactctccccaccgtgctgtgctgctctccctggccaggggtgtcaagcttggggactgtgggtccctgggaggtccatggctgaggttcagaaggtttatcaccctgaagtcatgtgaaaaatgtacacatttctctgcagggcgagtcccgcatatccccaggtgttctgttaccacctgcaaaaggtagacacgcccgcccgaccccccacttgctgtgctctgttatagtcctccttgtcgctgcactctgggcccctagaactggtgtcccagaaagccaccctgctttaggccccgccgcagcagtggggccctcaagcgggtctgaagacgagcaggtgcacagacccccagccgagcctcatctccacgcaagcacacgtgggctcttcatccggttgcttctgtggagcagtgtggattgttaacactaggaattaactgttgaatatgtggttttttcctgtaaccaaattgctgtaactgtacactaaccttgtgtgagaaaagtttgtagtcctgctaaaagctcctctgtctctgcctatataaatgaaaccctaatgtccctacttcagaacactgactccattcctttggagttggtgtttccaggtgggctatactcaagcattacacatgaataaactctctttaagttaaataaatcaatttacaaaatgtaatttttcgagaacagaaaatgcaaaagatcaaaactctgtaaacaaaaaaaggagaccatgttaagcagtgtggagcccctgcatttccccagtcctgtttcttcacacgtgtaggcatcccccacaggtaactgcttttcttcagataaaagcaaataagaacacttccccttttacatgaaaacactgcatgctatatggattgtttgcacccttgtgttttcactggatgatatgtatagatacctctttatcattgcatagaaaatagagttgacatgtttatttccatcccagacactgttgtaagcatttgacatatgagctacagtaactcactgagctttcttccagtcctgtgagggagttcttttattatccccattctacagatgaggactgtgggacacagaaaggccaagtaacttccataggatcacacagcaagttagcagaatgcatcttctttcctcttagattataagttcttggtgcaccagggccatgattttaatgacaccaacctccatttagcatagcactttgtcaaaagtgggtgcttggtgtctgctgagtgaagagatgatcagttggtcccacagggtagccatctttctgtggaatgttaggcacgggcatttatgctgagcatctagcctttagtcacctgctactaggaagttacctcttagacgcacattttcattatggcttatcaagtcacttatagttggcaacaaagatgttacatgtgtctaatttgctgacatatctagtcactggaagtaccagccagaatgaggtcagaagaatgactaataaatattttcaggatggcaggtttcccttgaatagggcatgttattaaattcagaactcttatctgtgtgacttaaacatttagctgtttatttttaatctactgaagaacttttcatgggttttgtgagcagacacttcaacaggaaagcatgaaatgttcagggttaaagaaattctagagggaaaatctgcagtttgatgccatctcacctctagaggccagcctagatcagctcagttctagacataagggctgcaggcaggcccctgatccagccatggttttcaggggtttcatggatcttcaggggtttcagtctgagcatcctgccctgttggcctggagctcagggctggcactcggggttcctatgagaggaggtctccaaagcactgcgggggtggggtggggtggggtccggtggacgtctggttgctcagtgttctgtgatcgtttctgcagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagggagaatcatggtgggtgccgtagattatcctggatgcaagcattagtcatcgagtttggaagttcccctgagtcacccaggaaacagtccagccttgtgctgactgaagccgtgggggaagctcttctgtgctggtggcggacgcccactgcagacgggctgtggcggctcctcactgcagtgctgcggggcgcggagaagcggtggggagcggaacgtgccgcagacgagctgggcccttgtccgtcttccactcttcctgtttcaccttgcagaggaaaagtgacagttcttttctgatgggcttttccccgcacagtcaaggtcctcggctggttacctgtggagattgtcagcacttgactgaagcgtagctgacgcctctgacccagtaatggcatcagtaggataagacaagtggcctggaaaggagaggaatgcctacacgatgcgacctcgggcatggccttagcagggattgatcagagctgcagcctccctgggctatggtggagggcttgcctaaggccagtctcggctttcgtgaggaccagagcctgcactaccctagcttggacatttgtttgaatggtggcagaacatttctagggtttactgcagccaccgttcatcagtaagaaagaccaggatttattactaacataattagcgatattttttcatctattcacttttctaccttttttgtggttaaaagatatggtctggttccttaaagtggaaaattcttaaccatttctggagttacttaacgcctagaaaactgctgcatgtttattggtttatatgctggaagatggcccattgcagaattaaaatggaaatgtagacagaaaggagaggacatgagtggatgagggcattgatcgcggccagcctggtttggattgccctacatctctcttgtgctggcatctctgcagcgacatctctttccagtgtatagagtcttatataggacctgttagactctgctgaggtttggtcgtgttttttcgttttattttgttttttctttgaaatagagtctcattctgttgcccaggctggagtgcagtggcacgatctcaactcactgcagccactatctcctgggttcaagcaattctgcctcagcgtcccgagtagccagtgttacatgcatgcaccaccacgtccggctaatttttgtatttttagaagagacagggtttcaccatgttggccaggctggtcttgaactcctgtcctccagtgatccacccgcttcagcctcccaaagtgctgggattacaaatgtgagccactgtgccctgccatgctgtctgagttattttcaagagagcatctatttgggaagtatctttgggggctttactacaaggtgaactttggcaagaccagaaatgtcccaaaagtcagcaattcctctactacgtaaagcactcgaattagccggacacgagagcaaggtgcttcctgctgagactcacactttccagtgaacgtagatcaggtagaggactgtaggacatcagtacaactgggcatagaacaagtggaaacagagtagagctttctttgattttctaataaagttcttttggtccaggaccattggacatcgctagcatcaccagagaaatgactaattccaggtcagggtcagggaatatacaaaataagcgtagaatatctcgtaatgccagaaaatgaggaagcccttacaggctgctagggtggtgtcagaggacttggggaacaaggtgaagagcagccatggggccagagatgggaccatttgattatcaaaaagtgaaataattgcagtggatttaaattcaccaactgttcagaattcccggcttcctattgatactaaaagtaatgtaatttacgaccttgggagaatgctggaggaccggctcgtcactgcgaaagcgggcagatgacagaagggggcatttagccagcatttcctgcatgaagtgtgtgttaggatagcagctgttgaaagaaagttcccttttataaaagtttctgggatgtaagtgaagaaggaataaaggaattagaatatcactgttttataaacttgtactgaaatcgtggatctgagaaaatgttcatcagtggccgttaacatcacaaaatgagagagaaccaacacttatgggcctgggaatggaaatccaccatgggcccccattgacgctgtttcgtcaaaaaaatcaagctcaaatcagaccaagccacatattaattaacaccacagagctgcgctcagaacaatggcttacataggaaacaacatgacgagaatagagggaggtcctgaggattaaagagagacaagaatgtagccctataagagtcctaatggtgttttattctgtaatgggaaaaaagtcctataattcatatggaatttcatggtaccccaagtatccaaaaataataataattgaaaaagatgttggagctcttacttcctgctctcaaatcttactgcaaagcaacggtaatccaaacagcatggcactggcatgaagacagacacactgaccagtggagtcaagttgagaactgagaaataaagccttccaaagggcttttttttttttcacaagggtgccaagatcatccagtggggaaagaacagtctctttagcaaatggcattggtacaattgcatatgcacatgcagaaggataaaagcttactctttcttacaccatacacaagaatgaactcaaaatggatcgaagacctaaagttaagggcaaaaactataaaattcttagaagaaaatatagggacaaatcttcatgaccctggatttggcaatggaggtttagatatgacaccaaaaacagaggcaacaaaattaaaaataaattgggccgtgcatggtgtctcacacttgtaatcccagtactttggaaggccaaggtgggagaatcacttgagcccaggagttccagaccagcctggacaacatagagagacctcaactctaaaaaaacttttttttaactagctgggggctgggtacagtggctcatgcctgtaatcccagcaccttgggaggccgaggcaggcggatcacctgaggccgggagttcgagaccagcctgaccaacatggagaaaccccgtctctactaaaagtataaaattagccgggcctggtggcacatgcttgtaatctcagctactcgggaggctgaggcaggagaatcgcttgaacccaggaggtggaggttgcagtgagctgagatcgtgctattgcactccagcctgggcaacaagagcgaaactccgtcccaaaaaaaaaaaaaaaaatcagttgcgtatggttgcgtgcacctgtggtcctagttacctgggaggctgaggtgggaagattgcttgagcccagttgttcaaggctgcagagagcagtgattttgccatttgcactccagcctgggtgacagaatgagatcctgtctcaaaaaaattataaaaagcctaggcatagtggctcatgcctataaccccagcactttgggaggctgaagcaggcagattgcttgagcctaggattttgagaccagcctgggcagcatgacaaaaccccttctccacaaaaatacaaaaaattacccgggcatggtggtgcacacctgtggtcccagctgttcaggaggctgagttgggaggatcacttgagcccaggaggcagaggttgcagtgagctaagatcatgcaactgcactccagcatgggcaacaagcaagactgtctgaaaaaataagtaaataaataggtcttcattaaagttataaacttctgtgcatcaaaggacactataaagaatgaaaacaggccaggcacagtggctaacacctgtaatcccatcactttgggaggccgaggtgggcagatcacctgaggtcaagagttcgagaccagcctagccaacatggtgaaaccccatgtctactaaaaatacgaaaactagccgggcatgatggtggatgcctgtaatcccaggtactcggaagactgaggcagaagaatcaactgaacctgggaggctgaggttgcaatgagttgagactgcgccattgcactccaacctgagtgacagaatgagactctgtctcaaaaaaacaaaaaacaaacaaaaaagcctgggcacagtggctcacacctgtaatcccagcaatttgggaggctgaggcaggcggatcacgaggtcagatcaagaccatcctggctaacatggtgaaaccccgtctctactaaaaatacaaaaaaagtagctgggcgcctgtactcccagctactctggaggctgaggcaagagaattgcttgaacccagaaggcaaagggcgcagtgagccgagattgcgccactgcactccagcctgggcaacagagtgagactccgtgtcaaaaaaaaaaaaaagtgaaaagataactcgcagaatgggaggaaatatttgcaaatcatttctgataaggagttactatccagaatacataaagaatgcctacaactcaacaacgaaataacaaacccaattcaaaaatggtagtggacttgaatatacatttctccaaagaagagatacaagcagccaaaaaccacccgaaaagatggtcagtgttattaataactggggacatgcacatcagaaacccgtgagatgccagtgcatgcctgttcggatggtgtgatgtaaaaatggaaaatacgagttggtgaggatgcagagaaactggagccctcgtgcattgctagtgggattggaagatggtgcagtggctgtggatactgccagttcctcagagttaaacaggattaccatatgaccgaataattccactcttaagtacgtactcacaagatttgaaaacaaggagtcaaacactagatccttgcaccaggattattcacagtagcccaagggcgggaatgactcatttgtccatcaacagatgaatgggtaaacaacatgtggtctgtccatacaatggaatattactcagccatagaaaggaatggagcattgacacacgctacagcatggatgaaattattatggatgaaatattacagcatggatgaaatattatgccagtatttaaaaatttgactttgaggctgggcacagtggctcacgcctataatcccagcactttgggaggctgaggcacgcagatcacttgagtccaggagtttgagatgagctgggcaacgtggcaaaaccctgtctctacaaaaaatagaaaaattagccaggtgtggtggctcacgcctgtagtccccactactcgggaggctgagatgtgaggatcgcttcagcccaggaggcagaggctgcagtgagccaagatcatgccaccgcactctagcctgaatgactgaacaagactcttgtctccaaaaaaaaaaaaaaaattgactttgatatttaaggaatcattaatattcgcagttttgagggtgctactgttattttttaaaggatgttttaagagctacatcttgaaatatgtatggataaatgaaatatcaggtttgtttcagaatagtctgtagaggattgggggggtcctgaggtcagatatacaagcatttttgtaaattaaaaggttatatggtcctgattttcattgtccatttgaatgagggtaaaattttctgagtgagtcctgatttggtggtttgccttgttgcaggatcatgttttcttatgtgaaggagaagaaccaaaatcggatcttaaaggtgagcttttgttttctttcccttctcctgagtggcctcattatttctggaagagttgctagtctctcctctgggaatgaaaaggagtctttctttgcaccttctgggccacctgattaaaacgagctcaggtgtatccactgcaagaggattcagcatttgaagaaggctagggtgaaaccctgggacttggttgtcttgctcatcagcctaggcccagggccatggggtcgtctcctagaagctcatctgtgtagtgatgggcagggatcccaaaccttcagtgaactcatgaccaagcatagagctggcagaactaatcgagaagagaggggcacaagagagggatggaggatggggaggcgggtgtctccatggtgagtcaccccgggggagtgagccactgctcaggttgagcggcagacttcgactctccccacggctctttagcctgaccatgggcatcggtttctgcctttgggtctccatttcccttaactaatgaccaagatttgtgggatttcattcacctttgaaaagcccagggtaacagcaacagagcctgcctttgccttgctaagccctcacctaggatgcattccctcgccgcctcatggtcactctcaggggcttgctttctatacttgagatggaagaaatgggagtggtgtctaacaagcaatataaagaaacaattcacttaggaagaaatcaaggagtatttacagtagcaagccccaactttatgcccatttcaaaactgcatctgctaattacagtgagttgttttggtaccagatgaaaagcctgtctatattgtcttctctttcccagttacagcatgaatttcttgcaggttgctctatgacacactttttatttccacagcctgcctgtcagggtcatgggttgcctctaatgggatgttgttctaactttgtgtcccacagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagagcttttgcctgtcagttgtgtgtgtcccttatagtcccttcccccacagctcttgctgaaagagtttgccttgttttgttttgttgttttgtatttagccagaggatgccaaaattagtcttctcaaagctttgagtagagtaagtgtgggaataagccagtttttttttttctgtttctgtaacttaaatgaacgggtttttttcccttgtatgccacttgtcctaacatgtccttaaggtgtttaacctgcctctgacctggcttgcaatgcataggtgaggagaagcagagagcttgtcatatgcaagtcctgtcaagaaaacaggtgggcatggtggctcaggtctgtagtctttgggtctttgggaggccagggtgggaggatcacttgagctcaggagtttgagaccagcctagacaacatactacgaccctgtctatacaaaaaaaaacttctctaaattagccggatgtggtggtgcatgcctgtagtcccagctactcgggaggctgagtgaggcaggaggatcacttgagaccaggaggttgtggctgtagtgagtgatgatcatgccactgcacttcagcctggaccacagagcaagaccctgtgtaaaaaaataaaataaaaaacagattgg

SEQ ID NO: 37622 - DNA, 20988 bp, Homo sapiens; identical to SEQ ID NO: 37419

SEQ ID NO: 37623 - DNA, 39546 bp, Homo sapiens
atgatccggcggatcctcctggggaggccgggccggggagagggcgcgggcgccgagtggcgggggcagcgggcgggcgcggcgaccggggccggggcggggatccgggcggcgaccgcggcggcggcagcgccccgggcccgccgccccctcccctcctgcgaggggagccgctgcatggggccgggggggcggccctgcggcgcggagcggcggcgacggcggcggaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggtaagcctcggaactgctgactaaggggccgctccccgggccgggaactttggagcaactttggcggagccccctcgccgcctccccagagcgcactcctctcccctcccccgccgcgccctctgccaggcggccggccccacccccgaagcttcgctcctggcaacccctcgcccgctgatccaccccctctcccacccgccccctacgcggctcctgctccccgcacttcctacccctcggcgccctgggccgtcctccttgaccttcccacatcccctttcctactgccccaaggccccgggggaaatattcgaggggaccgagcgagacgtggctacgggacttgggagaagggggtggacggctggggaccacatcacaccccggccctttgccggttcacagtgagctggccgcacgggaaaagggggtgacatctcgcggggagcgcccccacgcctctagctgggttgggagaggagggtccgggtggggagcgaaattgccccagagcccaggtcactgtgagcttctctccccgcccccacttctgtccttgcagtcagcgtcaccgtggggggcaagcagtacctcctaggactctatgacacggccggacaggtgagtgtcttggcctctggccgacgcccccctcctgttccccagttctttgtggctgcgaagggcctttggaaaccgaggtgtctaggtgggagggtgtgtctgcgacgggcttcccctggattaggtctttatttcttgtaacaagtcagcaaattaggaaaacaaacaaaacaaacagagccggataagccccccccatgtgaacccctgggctgtgaaagtttttgcctgtgtgggtcgttctgtgtggcgcctggtgtgtgggtcccaactcctgttgcaaagtggcagcagccaatcatgaagcgcccttatttttagttgcagatgaccaggtctcccccccacagcctctgtctggtccctcattggtgagtggtctgcctgcccaaggagcctgattggtgggaaatggcatcatctaatatgatgggaaggcatttggtcctggttatgtttattacaacatcattgcactctgggactccagtccctgaaaacgtaatttgtggtgttaccaaaggaccacagggaaaaaagaaaagaaacaacaaccatgtagccactccctggggtggggaggaagggttaggagtttagagtgaatcttggaggaggaggggttccccccggccctacttcagaagggccaggtgactttgtctgggttttctttgggagagattaattgtgcagaaagaagatgcacactttgccctgcagcctctggccagggtttgcacatcagaggtggccaggctgtgcttctaaagggccaaggtcttctctctgtctccctgtcccagcttcagcctcttcccaaacccacttttgctctggggataagttgtgtgtgatgaattttgtagaatccagcactatgattagagttgaagactctggcagaagtttccacatgtcatacagacttacatccttgagaacacaggagcagctgaaagtcttagagaatgtctttgggggaagtccagtagtagaatttccttatctgcaaaatggggtttaaaaaaataagatgatcccctggtgcagatattgtatggcaaatgtttagcattgaacctggcacacactaggtgctcaataaagggagtgatgtactttgaagcttgtctagatttggatttcagaactgtgattagagtttaggttggattctgaaacatgccttattgagggggagtgccttgatgtgacctctggtttctaaactgttagaggaacgtctgaagatagagaactgctggcagttcaaggtccctgagaccaccccctttcaccaaaatggcccaggtcagtacagccagttctcagctctcctgggcccccattggttgcctgccctgtagtcgttattccttctaccttcattggaggatgtggagggcaaggggcagagcttgctcaatcaactaagactgacttttaagtcgtattattgataaacaagaggttgaccttattggttgaaaagaggaagcttttaaaaaatcgcctctaatttgaacttctcactaccttcctttctcttatctcctttacttgtgaccatgataatttttgaccgcactccctgttcaacaggatgtgtgtagtcagagctgttctgagtatgtttaaaccctgctagtatttactgagttttttcctacatatggggccagaggcagacacatgcaaatattattttatttagtccataaaacaaccccatgagataggtggtatttcatctttgcggtgaggaaacaggctcagagaagctaggttgcttgcctgaggtcacacagctactgaggggtgttgctaggattgggacaggggtctgaatctgctccagtttgaagtagttatacacacaggacaccatgggaatgctgagatgccacggggttgattggattgtttgtgcatccatagttgtggtacctgtaatcttcacagccattctctgagtgggtgttggatggcacctctacagaggagagaacttagatccagagtcacttgaagttgaccccacttacaaaaccagggctttccatatatggccgtaattactctttttagtggaggatcataagatatagaccaagcaggatgaacatattagtaaggctcaaatactactgttttcacccaatgctggacaccattggtggggcctagatgtgtgttaggccccattggtgtttttcccagtgtctagacttttgtttttgcatcaaagctagtaatatttcatctcccagcatttgagggtttattactaataagcaacttagcaatgatgagaccaaatggcaagtgcctgctgtgtacctggtactatgtccaggtacttttgcacctggggagtgcaaaggaatgaatttaaaatggggatctaccacagctgatgtcagcaaagggagaaatgtctgtctcgggtctctgttcatgtgttacataggagatctctacattgcacttggtcattaagacctcaggcttctaggaatccatatcagatttgtcttacaataataacaatgataaataaacatgtaaataaaaagtaaataaaaaacattaagggtttatatatatatatatgtatccgtatacacatatacatatatatatatatatatatatgtgtatatatatatatatatatatatatatatatatatgtatatacatatatatatatacacaaatccttaagcctagtgggcagcagagaaaggtccatgggctttggaacaaaacaggcctgggctcagatctccaccttagctagtcatgtgattctagctaaattatttacctttgtgatctagtaaaaacgtgaataattagaatctgcattacaaggtcataggctggcttaaactctttaacatatttaaaagcagctgatactttgtgcatagtgggtgagtgacaaatagtacaggaaattattatattccactatggggagttttgtggggagaaaggttcacagagtggaagagaacagtatattgtgcctggagttgatagaaattccactagaatgccagatcctagaaccttttcaaccaaggtgtgcaacagctttgcgcattgtaattcccatagtccctattgtgggatccatggttccaagcccagtgctccctgccgtaaatgccctgttgtatcagatggttttctgtcttaagcagagcccgtatccccattgatagaagagaaatagcttagagttccatgcagaatttgacagacaagtagggtatgtaggcttcagttggttctactttcagagagttaagatggaatgaggcagctcatggcactacaggtcagttgccttctctccaaaatgttcactcatgcatgtgggcactcattgtatttgaataacagcaacagtgcctccctcagtttggaacctctagtccacttgctcactcatggtccctgccttaaccccagtcaagttcaaagccataggcatcatttgtccgactgacatattagggcatctaccagtcaaagggtgattgttgtagatgacctttggccttctagagcaggctgctttccacttgacctctgctgctattagcagacaaagagagagaatgggagagagagtgtattggacttcagtccccatcatgtgcactgcctggggacatcccagcacactcagagcaccactgccaaagggaacacttcccctctgttggccaagcccatgggtggtccaggagcagctgtcacattttgactgccaagcattttggagtggaagttgaccgaggcatcttccttctcactaggggccttgcgtgtgttttgggggtgaggggttggcttcctgcctgggcctctgtggagcttctcctttcttgcccagccttcaggacttcagtgtaggctctgcagcaaccccattgtctgctcaaggagggactggagagatgggattttccctcctgctactgcactgtttggagcgatgggaagtggaaagagctctccctctctgtccagacaggccagtggggagctgcctggcaagctgctctctagctgtgggctctaggctgatctcttaatccttggcaggaaggcagaacttgataccctggagagggaaggactgaagcccagtttattcaggtcccagaatatccacactcaggaggatgtgtgttgggggtgaatttgggatccctagagttccagatttagccactgtctcagtgtgtggaagtcaatttgtgtgctttgggatgtattgtttctatgtctgttaacttaaacacacaagttcagggaagcgtccatgacagctataaatatcttttactctggtgtcccttggtgttgctttttcaatgacaagtgagatttgttttacacttgatataacccagcagctgtggctgccctgcatgccctctgggtgcccacaaggcacttcccctacagaagggaatctccaccggaggcaggcttggcatgccccaccttctgcattttagcagaagggcctggcatgatgagaaaagggaaggagaaagggccatgggatcaccactcaccaggctcctcccacctccaggcaagtcatcctcacaacacccttcaaggtagacttctcccagatgaggaaattgggaacaagtgggcttatgggaaccagacagagatgtgattaggaaaaaggttttctactttggagaaggcctgcagggaacattagtagggtttaggaaatgccactcacaacatcagactctgggtccttgtagccccgtgttccatccttgctcagcccggtgagcagagcctgggaggagccccagggttccttccaggcatcagctgcaacaggtgagatgctggcactgagcatcctggtttcccttagtaacctactgtagatttgtcatgtgtgcattttgctaacctttttagaagctatttatatctctagcccacaccgcatcacacgggaatgctggtttcctcctctgcgttgggaaggtggatagcctttgttgactccaaagcctttgctgtgttcgctccaaagtctgaatgccctgtgttcccctccttgggactctgatgtgggtttgggttatgccagcttagactgtgggctggcaggcagggactttagggtgggggcagtccccaccagctctcgttggtctacaattatgcctcataatcgggcacataatctgtgccccatccccatcctggacctttgatctgtttggcttctccacttccatcatgattctcctgaggtttggtgacattcccacgctttgaacgacagcttccccgcaggtatctcaagcatgagtgttacaggtgtgctgagatgccaagctctcatctctgaggggccgggggagtgacagcctaagggggttgagcatgtattgtcagttgctgtgggtgctgtgatgtgaaaaaggtgggaagcattgctttaagcccctcggggtcagaggccccatggagaattgggcttttgcggttttgttgtgcagtttggggtttcaagagattagatctaatggtatgaaaacaaagccaacaaagtagctctccacgggggtgtccgtttccagaaagagcacatgtgttggcagctgtgggtgctacagaggcctcagacacaacagcaatgcttcagcaggagagggacgcagttacaaagaaacaagatggaagaccatgtgtggctcttaaaaattaaaattcctgattctcagctgtatttcctttctctctgacaggcttggctttgccctaatttggcacacttgggtcagagagcagctttccttgccctcagcaatttgtcattcctcttttggtttctgagcacagctgctttgcatgtacggaggctgggctgtctgagctctcaggggtcccccggctccctgggtagaacgctctcctgcccagtgccggccaggacctcctggatgcgttcttgctctcttcaagaacagtgtctttctctaccatgttgcagtgctcagcccagtgcctgctaccttgtaggcatgcaacaaatacatcttaaggggattcatggccaggcagggtggcatgttcttgtctgtaatctcagtactttgggaggccaaggctggaggatcatttgaggtcaggagttcaagacgagcctggacaacacaacaagacccccaattctactaaatttttttttttaattagccagatgtggtaatgcatgcctctgtagtcccagctactcaggaggctgaggtgggaggatcacttgagtgcaggaattcaaagctgcagtgagctataatacaaggcttcattgcactccagcctaggcattagagcgagaccgtgtttatttaaaaaaaaaaaaaaagaattgattctcatttgactgtcagcttgtttctgctaaaaggttaaccaaggactaaagtcatagctgctaaataatagcatcagcacaaccccttttccaggaaagcttcactaatacagtagaagtctttaaggttcaaaggagaaacaggcacataggtatggggcaggccatcagttttgtctttacacaggcccaggggccttagtgatcaccagtgggtctgtctgtcccccaacactctgtctcagactccggcctttgcatgtttcctgagacctcttgctcccagatcccctgaggaggagacaggttggcagtggaaagagtgtgggttttggagcctccagatgaacttcgaatcctagttctacctctttgtagctgtgagacatcggccagccggctcacttctgtgagcctctcttccttctgtgtgaagtgtggagataatttataccctgcagcatagctgtaaggattagaaatgatgtatgtcgttaccctgtagggcttggtgctgagagtgcgggcccaggctagctctgggggcttcacactggctcagttcggttggtgttgattcaatgcctggtgtgtgttcccaccttccacaggagaaggtgggggatcgggccacagaaaggtccactacacaactgggcaagttcatcgtgtgaaattgagtgctgcagggtcccacacaggaagaggtgacagggaggagctttttggaagatctaggcttgcaggaagagatgggggccagtagagtactggttgccagtgtggacccccacactggactcccagggcccaacttcagctctgccacttcccagcaaggggcttaaccttcggaaacctgtttccttatctgtcagatggagattatgatagtacctccttgtggggttgttagatatgttggagcttcccagctcccagataagggatttcctcagccctcagggcagctgggtagggcctgggacaagccatggctcaggttgtcctagcttgagcagtctcacctcaggcatgcagcagtggctcctctactccacccgatgtgtgctgaacacatcatctcattttctctgtgtgccatgaggtgaagatttgggaagcattgacctaaatgagttccagcaggcagaggggtgtggagagctcatattctgagtgggaagaatagtgtagggaggaacggcagagggggtgaccccaaagcgtctttttatggaccccagatccctgctatcagtgtcaacatgtggagcagggttgataactaaattatggagtttttcacctggtgactgacaacttggtaattaaagagatattaatctggtgctgtgttgctggttgattttaatagaaagaaaagaatgtggggaaaggggtctttattgctgtctctgttcctttttgagtgaatggtgagagcactgaagcagccgcctctccagatccctagattttcctgctctactcaggctcagggtagactgaggggcttaaaagtggcaggctcatcatcaaatgacatttttacagcacataaagcatgtcgcacctggtaccgccttgagttccctcacctgctctgtgagtaaaggaagccagtggtggctgtctcattttgcagatctggggaggttaaatgactcgctccaggccacacggttggtaaaaggcaaagccgagatcaccaggcaggctgtcggactttaagccctgggttcttgatgttaagtcactctccctaatcatctggcccatgttaaatgcctcttttatcacatgcactgttgttcagcgtttcatgtaaaaggtacattccaagcgtatcgcttttctagctagaagagatggtggaacattgtgtataggtggaacacgtagggacggctgctaaaacggctcctacaaagacttctgccccacgtgacgttacgggtgttttgtcactttgtccctaaaccaccatgcttcctcaaaaaggagcaggcccgaggtggcgctgatggccccattgctcaagtacgtgtggaagaagctcatgccatttgcctaaagctgtggccccttcccagaagagagggacagggaaatgctgtttggggggctgccaggcgggccagctttagcctgcaaatgacgggtgtcgtttgtgtcccatgggggctacctcaggcctttcctttctcccttcaaggattttcttattcaggggaagcctacctctgcaaaactgtttgtccctccttcatctgaatattctctaaatatggcgcaaaacttcctctgccacctgctgctcatattgtttgccctcttgggccatccccattgccaccacctctgcatgggctcccaaatcctgcctggctgcttcctgtggtggctggcaagcctagaagagaacattcatccagtcagtcaacatacatttcctgagcaccagatctgggccaggggcaggtgttagaagatctgtcaggcacaggcctggcccccagaggcacagtgttttgaagggtaggtcaaccatgagtggtgggagggcagtggggcctatttattgggggcacagaggaggaaggcttatccttccaaggaggtgaaatgctagtaagagttaagttgagtaaggttgtttccacgaaagttgttttttagctggagaaagtgatcagtttggattcttacacgtactagatgctcagcgaggccttgaatggtggcactggttctcaaagtgtgatcctcaaaccaacatggatttcctgggaacttgttagacatccaaattcttaggctctatcccaaatcctctgaatgaaaaactaagaaatctcttttataaaagcccttcaggtgattgtgacgcaggctaaactttcagagtcactgaattaatgactgtgcacttctgtacctgctctttgcaacccatctccaccccctgccccctccctccctaccacatccaccgctgtcttacatacacactgtccctggagtgcagagaacatgacttattttattcttttttttattttttcaatttttaaaaaaatgttgtgggtgtatagtaggcgtaaacatttgtggggcacatgaaatgtttagatacaggcatgcaatgtgaaataagcacatcatggagaatagggtatccatcccctcaagcagttactctttgtgctacaaacaatccaattacagtctttgagttatttttaaatgtacagttgcattattattgactatagtcaccctgttgtgccatcaaatagtgtcatgtctttttcgaacttttttttttttttgagacagagtctcgctctatcgcccaggctggagtgcagtggcacggtcttggctcactcaacctccacctcctgggttcaagcaattctcctgtctcagcctcccaagtagctgggactacaggtgcccgccaccatgcccagctaattttggtattttagtagagacagggtttcaccatattggccaggctggtcccgaacttctgaccttgtgatccgcccacttcagcctcccaaagtgctgggattacaggcgtgagccaccgtgcctggccctaactatttttttgtacccattaaccatccctacctcccgccaaacccccaactacacatcccagcctctggtacccatccttctactccctatgtccatgagttcaattgttttgatttttaagatcctacaaataagtgagaatacgtgatgtttgtctttctgttgctggcttattttacttaatcatctccagttctatccatgttgttgcaaatgacaggatctcattgtgtgtgtgtgttttttttttttaatttataaatttttaaacccccagccccacaaaacacacccccatataccctcatttctagttctttacacatggttgagattatccgtaattactggaatgaattgaatgattcagccatgggtgctccctatccagttcacctggtggagaagggccgcagtgctatcaggagaaaaaaaatggaagcagaattttttgtggggtgccttggctccattagtgtgctatgtggcctagggctgtgcgcccagtaggctctgcaggtatttcttgatgcggcctaaacaccaagctatttctctcccgcatattaaggggctcgatagacaggacgcctggacagggctctgttcattgtggctgaggttagcactcctctgggtggtgacagaccctgtccctgagaaggatggcagcttggtttgtgctaaattagttccaaagcatcagatgggcaatgacgtcctttctgtgttaacattccccaggcgggtcacaaggagtggctgaagggagaggaagggctgtgttactcaaacacccatcttgccagtaattacttctttcctggctgacctctgctttctgtgcaagtgttctcccctccctttattctcctgcgcctgctcttttacatttttttctttctttctttttttttttttttcaaatttgttccaatctagaaaacccatcctctttcaaatggcataatggttgggattataaatgagttggctcaaagtgtgccccctctaggagcagccactgagagagcatttaattttgagcatccagttcaattaaaattccatttaatccagcttacttttcacagagttgtcttccccagtgagctgattacctggaggtgtttccaccagcctccttggccctggaggaatggggaagggactggacacgaggagggacagagcaggcagatgggggctctgcttccttcggacagggacttcgtccaacaggcgagagctttgggtattcatccactgcagaaagtgagaagtccaactgaggctgaggcaccccatgacctcctcacctctgactccggccctctagtggtcgagtccctccttagaatttccactaagtgaattgtctccaggctgcactctagcatttggttttattcatgtgtaaatctttgctccccatgcagattgtaaactcttccccttgccgtccctgcaggactgcacgtagcacatagcactttgcacaagtgttgggggccccagtaggaactaggtgtgtgttaaatttaggggagtctggtggtaagattattatggaaagaacctttcccatcactttatatcatatccatattggctttcctatcagctcatttgagaggaaattctgacctgtctggacattattgagtggctttaaagcaggttataggtggcgatttgaatacattgaccatttaagcaaagtgggactcatttctggactcacagagctcattaagcagacaggctgccaggtctgtttggatgaaatactggctatgcgcatgtactgttctccagcaagtctagacctgtaggagtccttcactgggctttatgtcaggtgtgcttccagagtggcctgtggccctctgtgataagtcggtaggagggggacatggtgaggatgctgacctgctcacttgtgtcttgactgggagaccggaatgcctcctgttgtctgaacaagctagtatggaagtagcatctaggcaagctggtgttaagacgcaagtaattactcagagaaattgctggtgtgtcaaactgcttgatatgtaagtttcctcctctttcctttgttttattttttgaggcataattcagagaacactttcatcaccccagaacgaaaccccatacccaccgacagtcactccccaccattcctcctcccccgtctcctggcaaccactaatctgtctttctgtttctatggatttacctattctggacatttcatattaatggaatcctgcaatgtttgccctttgtgtctggcttctttcacttagcataacgttttctaaggttcatccatgttgtagaaggtatcaacattccattcctttttatggctctgtgatctttctctttccattttattcctgcccccgctctttttcagttgttcttccatggccattctttcccgggctctggggactattttcagggtttcaaggtacaaagtgaagttctgctagttgtgcacttgtggtgctgccttcgcccctggctcaggtagaggcgagggctgatctcttctctacccttctgatattctttttcttaaaaaatttttttaatttttttttttttgttccttttaatgcttgggtctggaccttccagtgttcttgttttctctgtgcctctgttcatatactctcccaccccaaccacaccctaatagctttatttatcaaacatataaatatccattaaacataagagtgaggtgaggaacacaaaattccatccgatcgggttcttcccccgtaggagtttacagtccagttggaagatgaatagagctggccagaatgcaagtagaaaatgggatgtgcatataaatcatgaaatgtgagtgaggagtgttagaaaggtgcccaactacccggctgtttgacctgagcttcccagataggcaaggtttctgtggggccgtttagattcagaaacaattttattggggctttcaaggaccatcaggtacatgggtctgatttatgttaactcgtaagagatcagcctataaatgaggttgccaaagagttaatctaccatgtagccccagtggaaaaatggacaagacataaaccaatagctcacaagagaagaaaaacaaatagccaatgaaaacacactctgtaaagacatgtgaataaaaactttgtttttcaacctatcaagttgaaaaggagaaaggaaagtaaatactctctgccccatttttgggaatgaaaactgaaacaaccagtttggaggttaatttgccaaagactctttggtttgcagtgatctgattttatgaatttatgcctagaaaacattcagtgtacccagagatttacataaaatgatattcttcacaatgttatttataatagtgataaattataaacacattgatgcatagtaaaaagggagttgctaaatcacagaatgatttatattagaataatcacagccattaaaaactgccttcaacaaatatttaaagaaatgtgaaaaggctaatgatgtgttaagtgtgaaaaagcaggaatcaaaaccatatatatatgtatagtatgattaaaactttaaagaaaatgcacatgtataatatgcagaggaaaaatcagaacaaaatagtcaaaatgttaaagtggttggttctaggtggtgaccatgaataattttagaaatttacttctttatactttattgtgttccctaatttttttaaaaaaactcatttttatcaaacttctatatgcagatggtttaaagagtcagcagttctggaaggagttattatgaagaaataaaatattcctctttacttctcctgcagaaaagacatttcccactaccctgagacaaccactttcaactctgctgtttattttgataacaaatattctctgttgaattcacatgatgactgatgaggcctgagctccctttcacacatatcttccacttcctatccacctttctgtaggagctatattgtaatttcagtttgaccactgatcagtgtttatatttttatgactattcacagctgagccatgtagtgtactatgattatattttttttcttgtaccactttctgtttctcaagtgaacaattatcttgttgcttctcttacttggttttcactgtatgtctcagctatttcatgcaaaattcaccctcccatgcagcaagtcatatcaagtattctgtcagtttcttcttttgcagccatccctcctgcaccttctaacctgctgtagctgggctggtgcctcttgcctgctgcacagctgttatcctgggatttcccttcaggtttattaggattctctttgcctctatctcttgtattagatccctgtttccaggatctcaggtcttactggtttatttcctcactttggtggaatgtatattttattagtttcctgagaaaagagtcattgtaggcaacttttgggatacctagtatgtttgaaaatgtttttattccttcataccggactgatactttgaaaatagattatattttttctccctttggaatttttaaggcattgtcccattgtctttcagcttctatttaagttgtttagaagtcccctgccaacctgatccctgatccattgtcaggaacccatttttcctctctgaaacttaggatctgccattttaacctcctgaaatttcacaatcataggctttggggtagggcctggctgggtacccacaatctggaaactcatatcttccagttctaacaaattttcctggattatttctttggtttatttagtttcagtcagtctcttttgttaccctggaacttccactattcagatgctggagttgctggaatgatcctctaattatcttacatttcctttctgtcttttttctttattttggggagaaatagaaacttcctcaagtttatcatctaccccttctattctgtttttgaaatgtgattctatttttaaagtgccttttcctgttgtctggatgttctttttttctttagcatcttctaagcggtttaggttttgttttgttttgtttgagacaggctctcactctgttgcccaggctggagtgcagtggtgtgatctaggctcactgcaacctccacctcccaggttcaagtgatcctcccacctcagcttcctgagtagttgggactatagctgcatgccaccacttctggctagttttttgtttgtttgtttctttggtttctttttgttgttgttgttgttgttgtttggtagagaggaagttttgccatgttgtccaagctggtcttgaactcctgtgctcaagtgatccacctgcctcggcctctcaaagttttggaattataggcatgagccactgtacctgtctagtttgttttttgatggtatatcatctctgatttctctgaggatattaatgatagtgtttcaaattttttgtctctctgtgtaatctctaattttgatctctttcaggtagttcctcaaatgtctatctgtgtttacaagagtggcattgagcacatgagaaagcatgtatgggcagggctggttgactctgagcttccctgttggtcagggtttctcagcttcagtactgttgacattgaaggctggattgtttgttgtgggggggctgtcttgtgcactgtaggttgtttagcagcatccccagccttttccccctagatgccagcagcatccctcctccattgatggcaaacagaaatgtctccagatattgccagatgttctcctggggcaacaccagtcctcacttaccccacccccagttgagaaccactgttgtagggtgatctgttggggtctttttattggggaacctgtagggttagtaggtattggtcttcccccttgggctagtcatataaaccaggaaagaatcttctactcttctgcccgagggattcatcctgggaggcgagtgaaagaagcagagtgttggaggggggtctcaattttctttgtaccgtggccttgtgtgcttcgactgggcctggtgtctcccattcgggaagcctagttctgcccttaccagagaataagtatcatctgcctttcaccaggattggggagcatttatcatgatagggaaggggaaaaggtattaaaaagcaaactcgttccaccctcttgcttgtggctccgcgttcagtccagctgcagaagcaggcgctcttctggttcccatagcttcagaccctcagggaggtctgctgtgcagtccggtgtttaactggcacctcattgctcgctccgaatttggctccgtgggcctgttaagtaagttccacttgtttttttgccttttagcttctaaattttgttattgttatttcttttcctatttcttttgtccttgtggctttatgttttttaaaacaattactgtacatgttagaggattttggagaggtcaaagataaatgcatacgttcagttggctgggacttaactgaagtcttctctttttttatagttagaaacataaatatgaagaacaaagttatagtggtggatattctgttcagggccaggctcctgatgaattaataaagaagttgcttggcatacaggctttgcagcaaagcgagttggatttctgggaggagatttctgtttcatctggatcctggggtcacgtgatcacgttttccttccatacgagagcatgggtttccagtggccaggatctgttgtgtccactagctccagcatccgctgtcttactgttggacagaggtagatagtcactaatattctcattatgcaatttctactttgctagactttgcgtagagtctgtatagaccatgacttttcagttaacatatttttcagataggccaaaacatactccattaggttatagctttctttagttacattgcagtcaccttgattagatttgggtgttttgaagtgtctcagtcatctgaatataaaccgtattacagatgactaataacaattacaaattgattttcattaacttaattttcaaaatgtagccctatctcaaatgcatagagtgtcctactatagaccccataaacacacacacacacacacacacacacacacacacacacacaaaacctgtatatagacatatatctctctaatatattagtatatatatgtatatacaggtatgtgtgtgtgcgcacgtttatatgtctgtgtgtgtgtgtatatatatatacacctttgatatatatgtgtgtgtatatatatatgtgtatatatgtacatatgtatatatacctttgatacaggtatcaaagacattggccaggcaggaagagtacggtgaggggagggtctggacagttttcctaagtgagtagctggtatgtgtgtatggtttggggtggcaagggggcccaggcaagacagagtattccaggccaagaaaagagcacagaaagagtcatgtgggagaagctggggtggatggggaggtgtgggagcagcctatgttcattttggctacagagtagtcgttcatcggagaagccattaaatctaaggtgggaagaggagtttgatgactgcatggccaaccttgaactctgagctacatagtttggacttctaaagggcacggtcttctgaagatgggtgccttgatggagagattaacagagaacatccagtaatacctatttttccatgtagccttttctgtttgtcaagggcagatgtattctctccactctgaatccctgtggcacttagcatcaatggctcttggctcttgtattcatctgtgcctacatttgaggcttccttggacccgtttatcccatttagccctaacaatgacattaagaggtaggtcatactgtctacccctccctctgcaccgcatttttttagtggatgaggaaatagggtcagagatagggaaatgacttgaacaagattacatacatggccagtgagaggccaccctggacctcgggccaggccctctgactccagatctgcattccactgttctcatgacatccccttgctgccagtgtctcactggttgcttaactaagccagtggctctttgaagggagactcacacgatttgattttccaggcagcacataacacaggcccaaacgatggagcacaggctctgacaagactcacttatcggcagcacagggtggggatgagaacagggacctagccggttcctatgcaatttcaccagactgtagggtctatacctctaagtttgaaactccctcatccccactgctgccagcccaactgctccagtgatagttttccaccacttcaccgagagcctgggctcagctgctgccctcactgccctggagaaagagaggaatgacaccacctgtcccgttgctgactctaaggcttttatgagaatacacaaaagagaatagatacttgaaaccactggaatgacagtttatctggtgattttcttataaagttctattgttactagtttcctcctctatctgtactgttgcttctctttgattttgtctcactggctcttgctttgcttcagaaatggcactcctccctagccaggtcctttagagtaggaaatcaagaagttgagctgctagattgtctgaacttcttggaacacagaggatgctagtgtagacatgtgtgcattattgtacagggagccactgaaacctgcctgctgtgtgcaaagtgggccgagaggactccgtggccacatcaaagcccatgtgcatttgactcttttcccttcccagcctttgattttttttgaaaaacgtatttgagatatatcagtttagctattttctcagtattttaataaaatacctgactttagtccttgcctgccatgtaaacctacacacttatttaaaccagcaaaatttctcagtgcgtttgtgctgaagttaatttcacattcagttctcattttctgcctatttattactctgccccaaatctgctgaaactgaatggaaaaggaacactattcggtggacatggttataaattagcagccagcacatgtgttaagtgcctttcataccttagctcatttcttttcccagtgtttaagaggaggctccattagtagtccattttataaataaaagaaacagaaaaggtaagtaacttgtgcccagggccacacagctaggaagcctgactcagagactcaggaggtctgtgtctgaaaccccatgatagactacctggttgaaacaaagaggggttgtgtgggagagggtcctacactcgtggttaggagaattgcattcctgcttcactcctacccacctctccgtgtgactctggacaggtggtgagcttctttgatcctatttcctcatcagtgaggtggcagctgacctatctcctaggctgatggtgaagagtcagtgggtagcctgggttgctgtgaaggcatgagcaggcactcttctgggctgtaaagttacataggctgtagtaatgtcatgaggctatttgttttgtgataggccgggaagagcccccacggggaaccgtctgtagtataaaagggccagagctggtgggaagaagataaagggaagtaatacagaataggcaggggaggggagggcatcaaacccgtgcaaggaggataagctgtgctcagtggtgatggatgcatattgtgaagaattgatgtcaacacatcaactcttggcctccagggacttcttgcagggtaattctgcaagaattttctgaattttcaaagaaatctaggtgagtgtgcatgtgtgcatacacacgcatgtgtgtctgggtacctgtaaggcaagatcatacctttgcacacttgtggacctgtgtgtatttctttcctctttttttctctttttcttaatggagacagggtctccctatgttgcccaggctggtctcaaactgggctcaagggatcctcctgccttggcttcccaaagtgctaggattataggcgtgggccaccacgcccagcccctgtgtgtattttttttaaattgaggtgaaatttacacgacataaatttaaccatttttaagtatataatcaggctggatgcagtagctcatgcctataatcctagcactttgggaggccaaggcaggaggattgcttgagctcaggagttcaagaccagcctaggcaacacagtgagacccccatctctacaaaaaataaaaaattggccagatgtggtagcacgtacctgtagtcccagctacttggaagactgaggcaggaagattgcttaagcccaggagtttgactctgtattgagccacgatcgcaccactgcacaccagcctgggtgacagaatgagatcctgtctcctgtctctaaaagaaaaattaaaaaataaagtatacaatccagtggcatttagtacattcactgtgttgtacaaccaccagctctgccagttccaaaacattttcatctcctcctcagaaattgtgtgtgtttttgaaagggcctgttctgtgcaagcatgtctgtgagggcatcctgatttcgcctgccgggaagccatcctcgtcctcagatggcagattgcactgtatgcgtttatttggccagcagagtggggctcaagtattcacattccacatgggtttgttggtcatggcttaactcctctgtgcactctggctgcctcatctggacatagaggaaggcagcactgcagccttcatctgagtgtagttaccagggtcttctctttgctgcttggctgcgtgttgcctttgtctattaaaaggatgtgtgtaagtatgtatgtcaactggggacttcagcctctgtaggccaagtgttgaaaagggtgagagggctgctctggtagaagtgtcagagctgggatgtctgtacacctccctctccatagctagtcctggagataagtaagagcagattctgggactgagctgtcgcatacaccctggtggtgataacagcaaacacagcaatgggctatgtagagggagccctgaataatctccatgagctgcagagatagggccagtgagtggcaaatccttttatagtgtggaggagaggaggtggggagcagctgcaggagaaggtggggagcagctgcagaaggagaaggtggagcaggagctacgttggacaagccagtgaatactttgctctgattggacaacccagatcatgtgcccaccaaaaaccagcgacttagtgggaggggcaggagtggggaatgaaactcaatgattggcttaatccaaccagggactctctatatagctaagtatggggccagggtccccaggggcatgtgtctgagtgtagaaggggtggtgggtcctgcactgaatcagagttttcgaaagaaggaggaagtaggagaagaatgctggatagacagtcaactgtattctccatacctagataagacaaatgtcaagacaatgcagaaaaagttgtggtgaaaagcagcaggaactaaaatgcttaaagcatcactcagtctgaggctctcctattaagagctcacattcagggaggtgggttggacccattggtgtgccacagaaaaatggccctgctcacaggaggcaatttgacatctggccgaaagtgacatcagcagcctgagaaattaacctgttactggagagaattcaggtatttgatccactttctcaagctttgtagctggtgaaggaggtgcagctagcactgtgcaagctacctgcacaatgactgcagctgacttttctcacttcaccttcccatgagctaccgtcattgattcagcgggaatgtaataagctgcgaccatgagccaggccttgagcaatagtcccctgccctcagggagtcctgatgcagaaggggaagatgcagatcagaagaggcaatcgtattacagtataaacaaacaggatgacaggagaagcttgtggtgccacagaagtgtggagcatggcaatgcttaagctgaactgggggttcagagaagatctgctggatgaagtgatttccagactcaagcctggaagatgagtaggagctcccaggtgaagaaatacggagagagagaagaaacagggaaactcactgggcaggtgactgctttagtgtgtgtatttgtgttaggggttgatcctgagaactttcaggtttctggcttgtgcaccctgattgagtggtgatatcttctagtgagatggtgaatacaggaggagttgcagttttgattgggaagaaatgaatttagttcagaaatgttgaatttgagatgcttctggttcagctaaaaggaggtacatagtaataagctagttctggaactcagaggcagagacctcctctgaccacctgcttgacatctcaagcttaacacgtcccaaactgtcctcttgagttctctccctatggtgcttctctaccctaccctcagttttcttcatccctctaaaagatgccatatcatctagatatatccagaatatatctagaatccaccatttctctagctgtcaactgctgtcccttagtctaagcttccatcttctctcagctgaattactataataacctctccccttataagcctgactgcctaattcattcttctcaaagtagcctggattatcgttttcaaattttgtgacttttttgcgggggtcgggggctcaccttttaatgactttccattgcaggtgggccctgcagaggggtccaagctgactccctctccagccccacctgtcacctggcctttccctgtggtcttcagtatgtcagggcttttctgccttgggacgtttgcatacattgtcttgttgtctgtctccttaagcggtccctcaggtctcaggttgaacatcacccctgcagagaggtctttcttgcctgcgcagactgaaactcatcttcctggttattctctctcccagaacctggctcttttccttcatagcacctgtcccaatttgcatttatagtcatttttgtcccaatttgttcaatgcctgatttgatacctcaattttatcagacccatctcccatttttataacaaatacttcctttttacttatcctcaaatgaaatctatagataatataacctccctatacatgtaattttaaatcagtataacatcctggcagtgatataaaggagaaataaaaaggaaagtaattcatcataaaactatttatttcagtgttaaattcctaaactcccaaggctgactactccagaaatcataatgaagtaatcaggcctgcacctattaggtaaaatgaccacgaatgcaacagttacaaatattggctaacatagttattttttattagtgactcagatactaacagcaatgtagccagtggcatgtggttttctgtgatggtaagtaaatcctgtgatgtttgttttttctttttcttcttttttttttttctttgagacagggtgtcgttctgtcacccaggctggagtgcagtggcatgatctcagctcactgcagcctcaatctcccaggctcaagtgatcttcccacctcagcctgccaagtagctgggactataggcacacaccatcacacctggctcattttttatttttgtagagatcgtgttttgccatgttgcccacactggtcttgaactcctggactcaagcaatccacctgtctcagcctcgcagagtgctgtgattacaggcataagccactgcacccagcctcctgtgatgtttcaaacaaaataaagttcaatctttctccttcaatgtggactgaaattaccttcctagaaaattcattaaagtctgagggccgtggctcatgcctataatcccaacattttagggggctgaggcaggataattgcttgagcccaggagttcgatactagcccaggcaacagagcaagacccctgtctctacaaaaaaaaaataaaataaaaaaatttctgactagctgggcatggtggcatatgcccgtagtatcaactactcgggaggctgaggtggaggctagagcccaggaggtcaaggctgtagcaatctgtgatcatgctactgcactccagcctgggtgacggagtaaaaccctgctcaaaaaagaaaaagtttaaaatatgcactaaagttatgccaaaaaactttatttttttatatatgcagcaggatcaggtcctagattcatgcgattataaaaggtgttccatggtgagcaggtctatgcaaacctaccttcaaaggccaagggagctgagaggctgaagaaagagactgacaaatccagtttctcagaaagaaatatttaatagagacttagaaacagaaacgatgtctaggtaggccaagagatggtggattctcacaaccaacctccagaaagtatcctttatatagcaagcttttagggtaaagacacaggaagctcatcatccctgacttcctttagaaactcatgaccacggggaggttgtgagggcttatctgtgctactggaccaccttgaattgtaggcgtcaaacattggtcatcatggcagttttacttcaagatggatcactcttgctatgcaacaggctgttttcccacaaaagagtttttcatgtttatgaatgtctagcagtacactcactagtcatgcgggcctggagctggttttcctcatacaggtcattgtggcaccacggctcccacccttaaatgctagcagagtttccccattcattttggcaattgacagcacctcccaaatgtccgaaatgccccccagacatagggtggtactgccctagctgagagccctgtgcctactcctctgctgtcctctacacagaatgagggcagggtctgtgttgtgttcactcgtctatacacagcactcagcacctacttgccagatatttgtggagtgaatgaatgttctatcaacatgaaatttgtgccaaaaagttaggaaaggagtataccacatggaaatgtgaccagacatttaccttctttcagcatgctttaggccagctgacctctgttttagtgcaagagacttgtaattatagctccagacaatatggaatttcagctctaaatcctttacaactggggaagtcacctcaccatgcacagaagaaatagcactggctccgaagttgtggtttgtctttttttggaaagtcaggcttgtctgccaaagagctcgaaacacttgaccagctctctcatttatcttaacatgtgtatttattctcccttcacagatggggaagtgaagcttgcctgagggctgtatttagctaagtcttgatcctctgccttgtggtggtcagcttagataaaatggaatcctaaaacttgatttttatcccgtagtgtgaacctcctcccacattaaatctgctagtagggctgctcacaagggtaagaagtgttagtttgagtgtttttcatcatgtgacgtggcggtcttctagttcagggccctgcttttagagatgaggaagtgccagttcgtcacaacacagttagataatgacaaggccagtcctctagctggtttctttatgctccaccagatgtaaattttctctccgtttcctccagccaacctaaacaggagttacaatcagtcaggtggccaaaaggaaagcacaatggaaaagaagcccaagatctagttctctagctcctaaataattggtatattaattaggaggctgacttattataaatcaaaacatatgaagatgacagtagctaaaagtaagaagctaaacctttaatttcaagaattcttttactaagcgctaatcaggccagtgacatataaataccatttcacaactgaactgaaaattaaaaaagaaaagaaaacaccagatgtttgcaaagtttttgaaaaacagtgacctcttaagaatttatagcacctaaaaaaacctttctcttccccaaaattttctttagtccaagagtgctgggaggtagtaggaagtggtaggcaaattcagtaaactcatcactggtgagttttgaaccaaacttaccaaagtgttttcaaaaaggacccaacccagcttccttgaaaaacagagttatttttaaagaggtaaaaactgatattttcatttcacaaagttaaatataaaatgaactcaaaagtgtcaaaatgactgcacaatagaaatgaggtttcaggccaggcgtggtggctcatgcctgtaatcccagcactttgggaggccaagggaggcggatcacagggtcaagagattgagaccctcctggctaacacggtgaacacccgtttctactaaaaatacaaaaaattagccagccatggtggcaggcacctgtaatcccagctactcaggaggcagaggcatgagaattgcttgaatccgggaggcagaggtggcagtgagccgagattgtgctattgcactctagtctgggctataagagtgagacttcatctcaaaaaataaaaaaaaaaaaagaaatgaggtttcataggctactctgaccaagcattaccatagacatgttgtgatatataagttagatgtaggagaaaacagttgcattctcagaagctggcttcatgacatgtgtcctctggacttctgtgtagcaccctttgaagggtggagggtttcaagagctcgatgcctgttttggacttctcgctagaaacagatgttgtagatgaagattactactgtgtgccttggaagtgacacagagaattgctactgcacagaccacaaagccaccacttttcagggatattcttacttagttgtcatatgttttatgtctctcttcacgtagtcagaagctgctttagatttgggaaggctggggcttatctgttaccccttgttctaggttgtttctcattctaggttgttacagaggaaaactctagtaggttttgataaatgactatttcttacatcaaagtactatcctgcattatttgggattgtaatacattcctatagtactttatggtcttcaaagcatttgtcactgataagtctcccgtttttcagacagagaaactaaggccctaaggaataagggactggactaaagtcgcattcctagcatgttggatacgttcaagttctctccattctgtaaggaccaactcaagtgcctcttccaagaggtcttttcttagtgtcccctcattactactttttatatttaccacattctaacttgtaatatcatgttcacatacatcttatctaccttaccatgaacttcctaagatcgaaagctgttatgcatttgtgtgtatctcctcacctatcagaattgttcttcttgggtgctaacctgatgcacgttcccacaccagcctgcagtttcctcttctaggctgtggcttggaggtctgcaaggcgctggagtggtgtccaggcacattgtgggcactgctgcacattcaagtgcattgccttatttttaacatatagatacttaatgagagagctttgtaaatgtttataaggtgttttacaaatagatgttatttgaatctcatccttccctcctttatttattgcagttagcactgttctgggcacatagtaggtgcttagtaatgtttgttaagcatttctatattcacttgctccagcttacacttttattccctcctattgttgtatatgactgtctttttatatgtttatatcttgaattcccaactaaactgcaagctccagagggctatagtctcaataaatctttgctgattgcttttaaataatacatgatagcataccagctaacaaagcatggcacaaggtaaatcgtccaatgtgagtgtttttatttaagaaatgttttggatatgtattttaaaatagacatacacatcccaaaaacatatattttaaacagagatcactaaggtaggagggaacacccaggtccacatgaaggggacaaagaatagtgcagaagtaaggctcatgggcactgctggctgagctgcacacagaaaggggtctccagctgatggccattggctacatttctctgtggcattggaagagcttttgtttcctctcagagcgcatttctttagttttttgtttgcagattcttatcaggtggtaagtgtgtgtttttttttttttttttttttttttttgagacagggtctcactctgtcacccaggcatgttcatggctcactgcaggcccaacctcttgagctcaactgatccacccacctgagcctcctgagtagctgggactgcaggcatgtgccaccatgcccagctaatttttgtatttttagtagagacaggatttcaccacattgggaagactggtcttgaactcctggactcaagcaatctccccacctcggcctcccaaagtgctgggattacaggtgtgagccaccgcacctggccatgtgtgatatttttaaagtaaggttgtcattatcacatatcgaggactcttcaacaagggacagcctgaacactaagctgccagaacacacttaaaaacttgatacttctggtacttagccaattggtaagaagctaaagagtctgccatgcagtccaacagccatgctgactaaactcaccagttctttcattgttttgatgttgaacagctgtctttaatacacttttctgtactcctgagaatgttctagttaccatgctgaaatgtttaaatacctacattttaaaattagaactaaaatataatgggtttgttaattaggaggacactggagagttggctgtgagaagttgtgactttgataagtcgatcttttaaaagtaagggcagttgctctacatttgacttctttgtgttctcaaatttaaaatatatggctgaagatgaaagattctgcacacctccacttattcattcccaaatcccacatttcatattaaattcacacaggatactatgtgatgcatatgaaccattttatatgatgcagggtacagtatgcacaggggataatttattttctaaatttgctattattagacttctaattactcagctggatagaagcagaaaggtctcattcttgtactaactgccgattttttttttttttttgagacggagtttagctctgttgcccaggctgtagtgcagtggtacaatctctgctcactgcagcctccacctcctgggttcaagtgattctcctgcctcagccttccgaatagctgggattacaggtgtgcaccaccacggccagataatttttgtatttttagtagagatggtgtttcaccacattggccaggctgatcttggactcctgacctcaagagtcccacctcggcctcccaaagtgctgggattacaggtgtgggccatcatgcccggccactaactgccaattatttagccagagatgacaggcagaaggaattcattttagattgttcagacttaagaagtaacatttctttccaaggaggtctaaacatatgtgtgttttattttttaatagccccagttcttcacattttaattaatcaaacaaaacctgcaatttaagaaatatctagaaatgattggtccaattgtcctcctttgtgctcacgtctctcatggaggaaagtcaggattcactgtggttatgaaaggaatctgtacaatatatttaccttctgtaaaatacttggattaatattgttaagcatctctagggaacatggcattcaattagtttttatttcttgtcatctctcactagagaaagagcgcacacttctgtttccctgaggaggtaaacttgcttgaaaagtaaaatttccattaaaatctctaatttggctttcttaaatataaatctatttttgttacattttaaatagtcttaaggctaagtgactaatgagtacagtaataatatatcattctcttttattcatctgaaaattatactgtctcgagagacctgagttttgtgtgttttgattttatttcttactaaaagacttctctgtgattggagggagctgcaaagctgaggcaagtgtgggactcaggggaccctgcgtggatttgcagaggaataagagacttggtttcccatgggatagagaatttatgtttaagcattgaaagagttcttcgatgtgcgaggtgttatgcggagtgctttagttgcactatttcatttattcctcataatcctaagggatagtatccccattcctatttctgtgaaaattggaaatctaaatatggatgaggagtgctttttaatgagaacaccccatttcccggccatgacaactgcatgtttgctcagaagtgtggagttgctgggtgggatgctaagatgacatactgtttcttttttttttttttcttttatggacttgcagtttgaaacaggcagtagagcccagaaagtacatataaggcactcaattgtactgtttaacacaagctgatttttaaaaagttaaattttcaagaagtcttcctctagtaactgtctgggggtataacgtgtttcatacccaccctatttgatctcttcattgtgaatttcttaacaccagggcactgctttaatcaaaaccatttagaggcgttcactttaaaaaataaaagttgcagaagattgggggtggcatttcccctgtcgtcatgtgatagcgaacacctgagaaatcttttaatgcccacagctctagattataggtgtgcccttcaaaagcatcacagaaaaacaaaagggttacccaccagtcaagggtttgggacattaacatgctttagttgaaagttatattatgaaaaatgtcagaaaaatgcatgaaaggaaaattgttccatgagggaaatactactgctgaaactccaagtggaagatgatgtttttaatattcccttagttccacatttgtgtagttctgtagtgaaacgagtcatttaagaggggaggtggcccaggctaaaaataaagtttctttgaaaccagatgagagtctagctatgccaaaaatggaatccggactctgttcactctcgagaatgtaaataagtagaattttgtgtcacataaaatagtctatgcaaaaaaggatattcactgccttttgtgatagagactaaaataaccatcaggagtatagctgttctggggactctgaagcaacagtgtaaaatgatatggtagtctaacgtattctgatttagaaagatgtccaagacaaagaaagtgcagaacaacaagtactgcatgatttcattttatgtacagatgtatgaatatgtgcagttactggtatattcatgcatagaaaaagaactggaagaataaacatgaaaatattaagtagagggaatgaaagttggagagtaaaggaggattttggtgggtttactgtgtatgtttctctttaaatcttcacacacacacacacacacacacacacacacacacacacacacaattaataaaactatagaaacaaggaaagcaaagcttgaaggtctcagtgaagctgtatagtggttaagagtatagactctggagtaaaaactgccaggatttgaatctcagctccttgacttactggctacacatccttacgcaagtaatttaacttctgtgcttcagtttactcaaatgaaagtcaggattaagggtacttgtgtcatattgttgttacaaggattaaataagtaatccatgagagagcatatagactagtgcctgacacatagtaaatatttagcatgtattaattattataaattataatacttaggcaatgtctagctatattcaattctttgtgcaaactttttagttaaaaatgtttttagtgacagcgttagtgatcataatgtatttttccaaagttttcattgtcattgttaatgatattgtcatttttttttacctcatgggtgttcagaacttcacaaagaagaataacaaaaacagagttatctgattttacttagagtgccatacattccactagtggagtactcctgaatttgcatctttgaccatgtaatctaatgtacatattactagtaaacaatagaaatgtaaatacataatgaggcttttctttgttcctcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcaggtatgtctggtttgattttctgcattttagaataagctctttggtctgtcgtagaggctgctctcagacaaacagtcccaaagctgagcaaatgatgtaagtgtttaatctcagctgcaagttaatgagttctatcatatttttggaaaaaattgtgccaaaagaaagcaattattttcctggtttttaaaaattaagttcttttgtttaatctttttttggtatgtgggaattaagtgggattacatgctttgatttttctttaaagatttgtaatattatgggacattattgacctttcttaattagattgatctccgagatgaccccaaaactttagcaagactgaatgatatgaaagaaaaacctatatgtgtggaacaaggacagaaactagcaaaagaggtaatggaacactcacagaatttaagcatgaatgtaaaagatgctaagataacaatagaagctaattttattgtgtatttactgtgtgccaggtggagtgctttacatgcattatctcatttaatccttgcatgaactcagtgaggtaggtctgtttcccctgttacacagaagagacagtggaggctgggagatgtcagataattcgcccaagatcctgcaggtaataaatggcagagttgggtttcagtccaaagcctgactcctgggccgagactcttacacctttgctacattgccagtgatattttcctaaaaagtcacatatggaaaaaagcatcggaaacacgtgtcactactttcaacccttcttcattacttaaacagttgcactgtgccaaatcagctctgtcttaagactcattgagttagacagtggagccacctaggatgacagtttaaatttgtggttaaaaccaaaaaatgatgactaggtttgaaaagaaatgtgttgaaatttctccaatctttttatgaaaagaggatagaaaatacaaaaattctaaaaatatatgtaacagtgatgcatgcaataccttgtagcttatcttccttcgtgccccaaagataggtttactttttccccttttttcccatttggccttaacattattggattctattttttaaatgttgtgatttcaataggacttttgtggaaacagaatccatatatggtctttttttttttttttttttttgagacggagtcccactctgtggcccaggttggagtgcagtgacgggatctcagctcactgcaagctctgcctcccgtgttcatgccattctcctgcctcagcctcccaagtagctgggactacaggtgcctgccaccacacccggctattttttttttttttttttttttttcatttttagtggagatggggttttaccatgttagccaggatggtctcgacctcctggcctcatgatctgcccacctcatcctcccaaagtgctaggattacaggcatgagccaccgcgcccggcccatatatagtcttttaaaatgtagtatcaggaggcaaaagaaagcaagaaaactttctggaggacagtttttcctaaagcaaaaaataaatggctttactaacaaatcacttcagaaattccatgtattcagttttgtaatcttggggagagaaggaatttctaaatgtcataaagataaaagccataaatgaaaatattaatgatttcactgcataaaaacttaataccacatcaaatgccagaaataaaatgaaaagtcatataacctgagatggatggcagaaaaatgggttaacatccttagtatacaggaacctcttgcatatgagttaatcagaagcagccacagataccaatagaaaaatgggctaacaatgaaaaattcaccccccaaaatgcagattgccattgaagataggaaatatgttcaaacttattagtagtcaaatgtaagctcaatttgcacctatagaattggcaaaaaatgagaaattaattataatacccgtgtagtaaaatggacactctgttgtactattggtcattgaatcaaagcagtcttgacagtatgcaaaatccttaaaatcatggacacttttgatcaagcaattccatatgtaagagtttatcctaagcaaatcattaggatgttggtcaaagtgtacagtgttaggaggaatacattttttgagataacactgcacaacatggtaactacagttaataatggtggtgctgggcacggtggctcacacctgtaatccccgcaccttggaaggctgaggtgggtggatcgtttgagcccaggaattcgagaccagcctgggcaacatggtgaaaccccatctctaccaaaaaaaaaaaaaaaaaaaaaaaaaaaaaaaaaaaaattagctgagcatgatggtgcatacctgtagtcccagctacttggggggctgaggaaggaggatcacttgagcccaggaggtggaggttgcagtgagccgagatagtgccattgcactccagcctggatgacagagtgagaccctgtctcaaaataaatgaataaataaataatggtggactgcgtatttccaaattgctaaaagagtaaattttaaatgttctcaccacacaaaatgataagtatttaaggtgatagatgttaattatgttgatttaatcatttcactcgtgtgtgtgtgtgtatatgtatatatagagagaaaatattgctttgtaccttatataaaattataatttgtccatttataatatttaataataaaagtaaattattagggacgtacttagagctacaaagatgctgaattgtttataatggcaaaaattccctgcatctattaaaacttcatactatctgttaagatttcatatttattatgtagctaaagggaaaaaagtagttgcaaaacagtatgatctcatttctagactcatcagcatttggcacagttgcgtccttcctgaaactttcttcagttggactctcttggtttttctcccctctcattggactctgctccatctctttacctccttggtccctggttggagggccccagtgatgagcactcagctttgtggatgtcttcttctatagctacactccctaggcctaaatgagcttctgtcagtcttgtagcttgcacagtctacaaccaaagattcctggatttccatctccagcctggacctctttcctaaattctcaatttggttatccagctgtttactcaacaagtccatctacatggctgagtatctcaaaattaacatgtctaagatatgattcttcttttaccctccaagcctgtcctcccagttactcaggtcagaagccctcagctgggtgcagtggctcacacctgtaatcccagcactttgggagcccgaggcgggcagaattacctgaggttgggagttggagaccaccctgaccaacatggagaaaccccatctctactaatacaaaattagctgggtgtggtggcacatgcctgtaatcccagctagtcaggaatctgaggcagaaccgcttgaacccagaaggcagaggttgtgatgagccaagatcgaaccatagtactccagcctgggcaacaagagtgaaactgtctcaaaaaaaaaaaaaagccctgaagtcgtacttgaccttgctctttctcccataccacacatctagccttcggcacaacataccttcagaacatatccagaatccagacacttttttctaactcttccctctatcacctggttcagacctcctccatctctggcctgctttactggaatagcttccaactcacctttctgcttctgtctatgccccatggtcatctgttctcaacacagcagccagagtaagtcttaaaaatgtaagcgcaatcatgtcactgctctgctcagaatcctccagtgggtccccagctcagactaaacgccaaagtccgcacagtggcctacaagcctctgttccctctctgccttactcattgttccccaggcctcctggtctcctttgttgttccctcaaagttctacctgagaacctttgtacttttgttgttccctctgcctggaatgttcttccctatggacatgattcattctttcactcttttcaggtctctgctcaaataccacatcctcagtgtgatcttgttccttgactgctccaggcatgctcctgcatcaggatctatctgcctggagctcttcccctaggtatccctcactgctcaaacttccccattgagaagcctccccggacccccactaccattgtcctcagcactccccgcctccctcactctgctttttccccacagcatttgcaaccatctgctctgtattccctcccctgtgcctcttacccagcagatgtcagcacatgtggacgccacacagcagggactctgctctttcgttcagttcactgacatatccccaggacctaaacagtgcttgacatatagtagatacccagtaaatatgtggtgagtgaaataatttttcatagaaagtctggaaggacatatactagtattttaaaatcccctctggggttatgaacatggatgatgaatgtattctttttgcatagctgtattttataattttctttataatgatgtgtttatgtcatgccaattgtataaacatgatcttatatatttgtgattttttttctccctcccagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttg

SEQ ID NO: 37624 - DNA, 20988 bp, Homo sapiens; identical to SEQ ID NO: 37419

SEQ ID NO: 37625 - DNA, 39546 bp, Homo sapiens; identical to SEQ ID NO: 37623

SEQ ID NO: 37626 - DNA, 39546 bp, Homo sapiens; identical to SEQ ID NO: 37623

SEQ ID NO: 37627 - DNA, 30728 bp, Homo sapiens
ggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccaggtgagggaaaacgttgtgggggtggaaacttacttctgagatctaaaattctgtgagcaaagttgagctgccacaaagcaggagtggggctgtcggaagaaggagggtgagcacctgggagagtttggggatcttcatcccactcactctgtgtcgtactttcatagtcttaccgatctgtgtctgtgacttgactcctggagcctgcgatataaattgctgctgcgacagggactgctatcttctccatccgaggacagttttctccttctgccttccaggcagcgtaaggtgagcttcgttgctcagactgaatcctaaaggggtttggggcctacaacgggtaacatttggatgtaagaagagttagtctttgtgcctcccacccgtacttccactcctaggacattcccttggtttttcctaggaattgccttttctgattctctagagcagggctggccagtagaataagaccttcgtgtcgtcctataggtgcccaaggagtcctctttggcatcatctggccgatattgctgggacactcttttttggacctgccccgccccttctaaatatatcttctccctcctctttcctcacaggtcttcaagctgggtttgtgtagacaactctgttatcttcaggagtaattccccgtttccttcaagagttttcatggattctaatggaatcaggcagttttgtgtccatgtgaacaactgtgagtagaaacatgttggttgttctcattttctaacacaggagtgttatattttgtcttccctggcccacattggaagaagaattgtcttgggccacacgtaaaatacactaacgatagctgatgagttaaaaacaacaacaaaaaaaaagcaaaaaaaatgtcaaatgttttaagaaagtttacaaatttgtgttgttgggctgcattcataagccgtcctgggctgcatgcggccggtgggttgcaggttggacaagcttggtctaacatttattgagaattggcttttattctggccttttttccatttcttttttttaaactttttttttttttgtcctttgaatctctacgcctctttctgcctcttctctcttattacggaatacatttgcatttttgtttttttttgagacggagcctccacctatcgccaggagtgcagtgcagtggcacgatctcagctcactgcaacctccacctcccggattaaagtgattctcctgccttagcttcccgagtagctgggactatgggtgtgtgccaccatgaccagctaatttttgtatttttagtagagacggggttttgcaatgttggccaggatggtcttgatctcttgacctcatgggccacccacctcgacccccaaagtgctgggattacaggtgtgagccaccgcgcctggccacatttgcaactttttatgttctgttggctatggatcagaaaactcataaagaactttaatttcaatcattttaatcattcctcttaactcagataatcacagatagactatattccccacttactacaatctccatgagggtactaactgaatccccagtgcctaacacatagtaagcaccaaataatgtttgaatgaacatctttgacaaatgagtctatgccaaccttattttcatttcatgaggcaacagtgtaggaggagcattagattaggatctcagtcctgccatttccttaccagctatacagacttgggcaaatcccttagcatttccaggctcgtttcttcaactgtaaagtgagaaataatatcattggctttgtatatgaaagcgctctacaactgtagagtacaataaagattagaggttattattattggggatggttagtggacttagaaatttgctggtgatggctataacatttctaaagatatgaagctaatctatctttttaaaatgtctatgaagcaaaataatgttcctgcacaaaatggatttaaatgtctcttgcatcctggaagtcacctcatcctgatttcatctgactgttaataagaattgcaaaactatatttgtctcagaaaacaaccagtttttggttttgggggacttgaatttcaaagcagttatcagaagccttgtggttatttagatggtaatagggtaaagggaacaagatgaatacttcattttcagataaggttgtggcctgacgcggtggctcactcctgtaatcttagcacttgggaggctgaggtgggcagatcacttgaggtcaggagtttgagaccagcctaaccaacatggtgaaaccctgtctctactaaaaaaacaaaaaattatccaggcatggtagtgggcacctgtaatctcagctagttgggaggctgaggcaggagaatcatgtgagcctgggaggctgagattgcaccactgcactccaacctgggtaacagaacgagagtctgtctcaaaaaaagaaagttgtctcttcttttccaaacattttactgccttttaaatccagccttatgatcatgctccagggttattgcaatggcacctacctggtgctccctgcttttgatccccactcctgcccccgacaccatcctgcacactccttcgggatcagtggatctgaactttctttaaacacctgagggaggaatatggccacttccaatagtagttatggttcattacatcaatgaactttttcctgaacgagggtggggtgtacattcatgtttagtatgaaaaaggcaaaaatttccctttggttctgattatttacctaccttcctcacatatacacacatagcatctacacacagtatacacagttgtggagaatcatttcactagataaatctttccataacattgcattatgttgcttccttactgagaaacctccattacttcccactatccataaaataacatccagcttcttagccagcctgtcagatctcctatttgatccaacttagtgttcctggctcttttagcattactctgtacttgaccctctgctttggctgaactcatctactcgttgtcctcaagatatgccctgtatttttcccaagtttgtatttgcttttctttctgactctatagttcctttttctctttgcattttgaaatacctatattttccacgagtgttttcttgctcatcttttggaagtaagcccatcctcagaagttctaaagcatttattgtttgagtcaccgtcttagaacctataggatttattatattgttattagtttatgtaaacatcatgtctttccaggtaaattgtcaacaccatgaaaggatggaccatatctttgtttccccatggtgcttagtatctattggtacagccaggcatggtggctcatacctgtaatccagcactttgggaggtcagggcaggaggattgcatgagcccaggagttcgagaacaatcctggcaacatagcaagacccagtctttacaaaaaataggaaaattagctgggtgtggtggtgcatgcctgtagtgccagctacttgggaggctgaggtaggattgcttgagcccaggagttcgaggcatgcagtgatcatgctactatactgcagcctgggcaacagagtgagatcctatctcaaaataaaataaaattcaaaaaaatatgtatctacgataatgatcatcagtaaattacgtttttagtcaaagtctgtacagcatgatggagtggggaaaaaacaccaggaataggagatctgcaatctactcttggctctgcaagctggccctctggctttttgctacccttttacctctgaggatccaaatttcctcatgggattaggtcagatggtctgtaggcttcctttgacatctgaaattgtaatagaaatctaaatacctttaagctcttttaggtgtaatatatcatctgtgatggtagaaattttaggcaaaaattctacttagcctatgtttaccatcactaccgccaatatctttgcactgaagtgagagacaaaatgtaaactttctcttattcatttaagccatgaaaaaatagccagatagatattttgccatctcagttcaccttctttcttagcttaactttaacttttatttcatgtgtaaagatacaaataactgcattttacatgaggtaaatatctcctccatgtggttttcagggtatgagttccgaaggaaatgtttaaatagctcttggaagcgttagggtttgaagatttcagatcagaggtggaaagtggcccacagaacagcagcatcaacatcacctgtttcagagcaatgcttttcaaattctaatatgcatacacattacctggagatcttgttaacatgaagatgttgactgaggtctgcggagtggcctgagagtctacatttctgagaagctctcaggtgatgctggagctactaatgtgtgtaccccactttgaataagaaggatctaggagatgtgtggagagtgagtagtctgaaaggccccagaattgagagccccattcatgctgacttttcagcaagctgaaaagtcaggtaattaagatgttatccattatcacagagggtaaaggtcaggttcatttaacgtggaatcctcatttgctttcaatgatgcaggtattgtaacctcttttactctgtacaaatgaccattacttatatgaagaatgaaactggcaaggggcatgtttccctatgttcttttttcaatttagcagacttggagtagtaaagcagacagagtgttgtcaatcacctgccatcttctgggcaggggacagcatcacagcccttttcctacatctctctactggttctgaagtgccataaagagatgactgcaagagtttcggtagatttatacattgctatcatagaaattagagaattcttccagaaaatacccttttgaagtatctaaaatcttgaatggaggaattataaggcttaaggaataaaatgcaacaaatctctaaacttgagagatggcaacattgttaggactcgtcagttgttgttaggacttgtcagttgaagtgtagaggaaacaggaagatttggaaaggacagatcaaataattatcataattgtctctaattgtcccatgttcctatggaaatagtgcgattctgttagagactcatctggtatggggcagacatgagcattatcgagcttcctattttctttttttttctttttttttttttttttttttcttttttttgacagagtttcgctcttgttgcccaggctggagtgcagtggtgcgacctcggctcactgcaacctctgcctcccaggttcaagcaattcttctgccttagcctcctgagtagctgggattacaggcgcctgccaccatgtccggctaattttttgtatttttagtagagatggggtttcagtatgttggccaggctggtctcgaactcctgacctcaggtgatccacctgcctcggcctcccaaagtgctgggattataggcctgagccaccatgcctggctgagcttcctattttcattacaaattgctgatcatacacattcttgaccatcaatgacttgaaactgactggcattcatgaccatattcttatctcagatctgcatattaaaacaataattcagttaatagattgtgaataagaagtgatggaaatcagaattgttatttctggagatggagtattgattgggagccttctggggaaatattctgtaacttgatctggatagtggtaatacaagtatataaatttgtaaaaattctttgagtttacacttaagatttgcaccctgtatattatgcttcaataaaaatattttttaaaattagttacttggcatgtttttcttttatctaaacgctttttcttttaaaaaacattttagcaaacttaaactatttccagaagcttcaaaaggtcaatgcaaccaacttccaggccctggctgcagagtttggaggcgaatcattcacttcaacattccaaactcaatcaccaccatctttttacagggtgagcctggggaaggggatgggattgtttggtttagtttttactctcacagcagacagctgacaaggtaactttgcagcactaccctgcagctagctaaaccattgtcagctctttggagggcagtactgtccacgtaatcatgcccttgagttaaccttgtttctactctttcttttctgttgtagtttagtccagtctcactgtgaacaaagtttcttttatattttattcaggctggggaccccattcttacttacttccccaagtggtctgtaataagcttgctgagacaacctgcaggagttggagctgggggactctgtgctgaaagcaatcctgcaggtgaatccagagcaaaagtaccaaccttttcattcaatttaaaacaggctttctcatttaccactctcttaattatttgtgtttaaggtttcctagagagtaaaagtacaacttgcactcgttttttcaagaacctggctagtagctgtaccttggattcagccctcaatgctgcctcttactataacttcacagtcttaaaggtaggtgtcctttctctccctacactgtcactactatgaagttgaagtgaacatgcttctcactgttgtgggttgtggaaagagcattgaataaaagtcagaatccccaggagccacgtaaaagacagagggcctggaaaccacatctgaagacaaatgaaataattggggatatatatgcaggataagagatcatcacccttctcactaatgggattggcttgcgagggtggaagggggaaaacacccatctcaccaaacttcttgcttttgctattcagtagagccctgtcagagtaaataggcatcacagtctgtcaccctcctgcctggctccacttcctggcattttagtgtaaagaagagtcaggtggaatagaggaagtaaatcattctaatatattgactcccctgcccgccaaaccaaagcctattggtagtaatatgaaaccacaagctcctggtgatttttggtaaggtatatgcacattcatgtccctgctgttctcctaggttccaagaagcatgactgatccacagaatatggaggtatgatgctgttgtaccaggaaaaaagaaaaagaatatttggctcctctgcatctgaggcaattttagtctaagttgtactgttgaaagataaatgtaagcgtgatgtagcaaacaattaagtagggatctaaaacggtgcctttgcaagtacgtcctatacagttaatagcctcgtatgaaaccaggatccataaggtgttagataagtttgtaaacattgggttaaataaactatatttagggtgggcttcttaatttttttgagagacagggtcttgctctgtcacccaggctgaagtgcagtggcacggtcacagttcactgcagcctaaacctcctgggctcaactaatccttctacctcagcctcccaagtagctgggactatagacgtgtgccaccatgcccagctaattttttaatattttgtagagatggggatcttgctatgttgtccaggctggtcttgaactcctgacctcaagcaattctcctgacttggcttcccaaagtattgggattataggcgtgagccatctcacccctcctggagtctttaatttgctagagggccttattaatctctaaggggaatactgaatatagtatttctaacaattatttgactatggaacccttgttttatatttaatagaactagtgttctgagaaataagttttgagaagtgctcgtttagaaagacttgaatttaagttgttggctggcactggaagaagagagagagagggtggtcaaggggaaggaaaaatactcatcttagcatgatatctattaatagatacaagacaaaataccgccttcagttttagttaatttgcttcttttcgttgctagttccaggttcctgtaatacttacctcacaggctaatgctcctctgttggctggaaacacttgtcagaatgtagtttctcaggtagggatactgacctcagattctggactgatgtgtgttaatcaacactgccagaggtgcctcatcttccattaagtatcagactgacccaactgaattttgtttgcattctctaacaatgttgggaatgcaaacttgttgtattggtagattcttggttgcaatccttggtaaaagtagcatattgtgaatttcaacaattcccaacaagtttgaaattaaacttgtcaataattgagcccattatcctccctaccacgtttcagttatttccatcaccaccatcctccagtatttcaggtccaggacattaaaattatttctgacacctcttctgttgcccacttgcagtctgttactgattcttactgactgaccacattttattctcttgacacagtatcatctgaaactctgaagtagattaatcaacttgtattcctctgttctctaaacaatctaaccttaaaaagtaagaattatcttaaagcatcttcttaaagactatgctcagaaatttaaggttactttcaattgcctgcaacttgtatccccagcaatgatctttattaattctcaaacattgtgagagccaagtaaaccagatttctgttccatgctcacctctgcctgtttctacttgccctcctctgtccgtaatcaacttatttttcttccctttcagttcctaccaaaaactcacctacccgtgaacccttttaaagagctctatccagtttctttttcatatacaaatataatatgaaatcatctttatctttcatagtatttgtgtttggcatttttaacattactgtttcagtctgcctcatttagttataataacacccttgaagacagaaaatcttctgtcctaaacatattcggcccaataactactttttattaattgattctttttgcatttcaggtcacctatgagatagagaccaatgggacttttggaatccagaaagtttctgtcagtttgggacaaaccaacctgactgttgagccaggcgcttccttacagcaacacttcatccttcgcttcagggttagggcccttctcttataggggatttagaggggaagaaatattgggttagaaataatttctttgcttctgtaatacatgtgaaatagaataagaatatgaaggcctagttcagtctgtcgattgaggcctcaacatttaatattccataattttactacaagttgtggttattctacaagtctttactcattaaaattttctccaattctctgtctggcccccaacaaagcaggacttcaatctaaaatcaaaactttttttatagtcattttgaatcataaattcagccaacacctacaaaaattctttaactagctgttctcatatttctgggcagtcagcattttactcatttcccacttaatctgagtgttcactcttaatcactgccatttggctttctgctacttctttcctctttttgaacccagcatagattttctcaactctaccctcaggtgatcaaccaactgctgtgtctctcagagctcatctctggaacatctgtagttaattaaaatatatattttttaattacatttaaatttttcagattttaaccaggctgtgttattattgctaaattgctagtaatttttaagggatccttagtagattcttggttgtaatccttggtaaaagtagcgtattatgaatttcaatattcagatcatgaaggatttattttagtaaatttaaaaaagtgaaagaagcaaaatgctacactgtggaaagaagccagattgttcagtgtagctcacttattgcatttccttgccttaaggaagggtacggtgaagccaagcagtgggaggtgggaaagtatgcttatctccataattgacttctcttccctctttctgcaggcttttcaacagagcacagctgcttctctcaccagtcctagaagtgggaatcctggctatatagttgggaagccactcttggctctgactgatgatataagttactcagtatcctttttagagctgggtggcctgttgcagcctaatgagaaaagctgcaaaggctttcaaacttatgttagactagccaaaggtgaggaattttttgttcattataatgaggtacttatatactaatatatggttaatcatttttggaatctagttgtctctctgtggttttctgaggaaaaaaatcacaaatttgtgactcgaacattatgatagtaatacaaaataaatagcattaaaggagaatgagaacataaattttgcaatgctgcctcctttttttttctgttatgatgtccttgatcatcacttttccaccttggatgaccctcttacagagccagggtaatggaagttgctctgttaaaagacatgaagtgcagtttggagtgaatgcaatatctggatgcaagctcaggtagttctttgcttccgcatcatttcctgcaatttcgggaatatgtagggaatatgttgatatggtaacttttatatttttaatgacagttcggaaaatgctagtcaggaatagtcttttagtctaaatagtgttgatattgctaagagttttctggcaattgttaatacctactaaggattataccctctggtctattttatattatttccaatgtttggtttaacataccgtactaatataggtatattattatgttagcattggactgcagcctccatggtgtttaattataggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagtaaggagagaaatatactttctgatgaagactcatttttacccctttgtaaatcttggatagtaagtttaaaaccagccttgtctccatagataatgcatttgtcatagaaggaagagtataagaaatcatgcccacttgaagcctttttttttttgagatggagtctcactgtgttgccctggctcgagtgtggtggcatgatctcggttcactgcaacctccaccccccgggttcaagggattctcctgcctcactcagcctcccgagtagctgggactgcaggcacccgccaccacacccggctaatttttgtatttttagtagagatgaggtttcactatattgaccaggctggtcttgaactcctgaccttgtgatccgcctgcctcggcctcccaaagtgctgggattacaggcatgagccaccgcgcctggcctttttttttttttctaagtcaagatcttgaactcttacctaggctggagtgcagtggcacaatcatggctcattgcattctcaaccttctgggcccaggctatcctcccacctcagcccctcgagtagctgggaccacaggcacatgccagcatgcctagataattttttgatttttttgtagagacaaggtctcagtatgttgtccagatggtctcaaactcctgggctcaagtgatcctcctgccttggcctcccaaagtgctgggattacaggcataagccactgttcccagcctgaagtagttatttcaggttaggtttaaaatacctaatgtattttccttacttagaaaaaaatttgaaggcagataatctacagatttctgttgttcaaaaatctcatatatttcaaatattttatattcttgaatatttggtcagcacagagtttcatgaggttaaaattgtgctctttctattgtaattataaaaatttacatttttacaattatttacatgaaaatgcattatctggttaaaaatcaaaaccatatagaatgatatgcctttctgcattttgcaattaatcctcctggagtactgcattaggtataccatatttctattctggaaactttcgaggctctctgatggcttccagactacttggatgcacttcataatctaacccttacgtatcatcttctttgactttacactgctcctgtattcaaatcctttactttagccacatgatctgctcaagccagtgcctactaagcagctcacacataggagatactcagtaactgttatttagattaatcaaggaagccaggtgccatggcttacacctgtaatcccagcactttggaaggccgaggcgggcagatcacttgagatcaggagtttaagaccagactgaccaacatggtgaaactctgtctctactaaaaatacaaaaattagccaggtgtagtggtgggcatctgtaatcccagctactggggaggctgaggcaggagaatcgcttgagtccaggaggcagaggttgcagtgaactgaaatcacaccactgtactccagcctgggcaacagagcgagactccatctcaaaaaaaaaaagatcagaggtcgggtgtggtgggtctcgcctgtaatcccagcactttgggaggccaaggcaggcaaatcacaaggtcaggagttcaagaccagcctggccaacatggtgaaaccctgtctgtactaaaaatacaaaaataaaaattaggtgtggtgggcacctgtaatcccagctacttgagaggctgaggcaggagaatcgcttgaacctgggaggcaaaggttgcagtgagccgagatcgtgcccctgcactccagcctgggtgacagtgcgagacttcgtctcaaaaaaaaaaaaaaaaaagatcaggaataataacatagtcttattgtgaacttttgtgttcttccactaagctacattgccttccttattactgaataatgcttaagaaacaatggcttagtacttggtgattgactataggcaaccatcaggcaattcaagcagatgcttctttacccttctgcaggctataaactgtacttcctgctgtctcataccagtttccctggagatccaggtattgtgggcatatgtaggtctcctgtccaacccgcaagctcatgtatcaggagttcgattcctataccagtgccagtctatacaggtaagtcatggctcataaaggatcactaaaccttgcaaagcctagattgtcttatcagtcatttgttaaccaaataattttttaccttccaagagctaatttatgttagcaaccaatgtttgtttaaagtgagctgacataatttgtcaagtctattcaccctgcctgattactgaaattaacatgatgtcatgaataccgcttatatccttttttaaaaaaaatctgaccccagattatagtacaggttaatttcttttcagtaatcctaccattattactattctgattgattcaaccacagaaaacaccttccataattgttcaatctgtcagccacacagttatatgtgagtccctgagcctgttgattgtgattaaagttaccgctgtgactagtttatagttaccagctcttggttgtatctgctccattaaatgaacacttttaatctgtagcaaacatatacctattgtttattatgcgccttaggagagctttagcatctgccttggtgtttaaaccaatctttagctatagaagtttaaaaacatggtattttcattttacttagaaatgacggccgggcgcggtggctcacgcctgtaatcccagcactttgggaggccgaggcgggcggatcacgaggtcaggagatcgagaccatcccggctaaaatggtgaaaccccgtctctactaaaactacaaaaaatagccgggcgtagtggcgggcgcctgtagtcctagctacttgggaggctgaggcaggagaatggcgtgaacccgagaggcggagcttgcagtgagccgagatcccgccactgcactccagcctgggcgacagagcgagactccgtctcaaaaaaaaaaaaaaaaaaaaaaaaaagaaatgactaggtcctagtgaaattattcacatataaactggcatgccaatttagtaacttataatgaaaatcaaacagatttaaattcttacctgttgcactgtacttacatcccagaaataaagtaaacttgagactacatttaggtcagaagtaaaatacctttgggtctccctcacaacagggttgggcaagttatttctctttgcctagaaatggggtcaacactcaggttaccagaaactgtattaatgagaacattcaattatattttttggttactgtgttgtttggaaagatacccacaggactgttcactgtgtatttccacatctctggttcctttaggcattgaagtcactcagtgccttttttttgtctgggtattttaactgatagctttttctagtatttagcaaaagttagcttttcaggttagtttgtccccgctacaaaaccacactacagtcattcactttaactggcctaagtgggcgagagttgagaattttagctgtgcttcattcatacataattgaagaaacattatctgttccaattattaagtaaaaattaattgtttgaatgtattaatatgtggtatgatatacacaaaaccacgttcctttactaagtgtgatttgagggatttgcaaaggtaattttgtgtaaaaattttcactttatgggctaaccagctcatccccatgaaagacgctatgctcctataaaagtataaggagttataaaatgatacttatatcttatagtgcttacaataagcttataataaaacatcttaaaagtatcatttcatacttatatgaaacttatatcataaaagtttatcaaatgcaagcatttccttctataataaattttttttacttcttcaatcttgaatgcaaattttctccagaagtcagataaacatactcactttttctttatgcatttatgattatttgtccttaacttgaaatcacttctccgtccacacaggcttttgtctaggacatcttgtgaaatttttttttttttttttttttgagacagtgtttcactcttgtttcccagcctggagtacagtggtgtgatctcggctcactgcaaccttcgcctcccaggttcaagtgattctcctgcctcagccttccgagtagctgggactacaggcacctgcaaccacgcccagctaattttttgtatttttagtaaagacggagtttcaccatgttggccaggctagtctcgaactcctgacctcaggtgatccacccgcctcaacctcccaaagtgctgggattacaggtgtgagccaccacgcccagcctcttgtgaaatttttttctcagaatagcaatagcttatccaaagaaagctagtgtacatcttccaaagcttttaaaataaaaaagaggaggagttacacttgcagaatgtatatcttctgggatgcttctccctactccactggacactgtttgaaagtttgtagtttataatattcttacctaggctgtgttggtcagcttagaatatctaagtgataggataaaactaaagctgagtggcaaactgccagtctatatactgcatttagtctataggcttgttttgtttggcccacaaagcattttattatttaagtttatgccaacatttaagaatcaagaatttcccagacattcagatttctgacttcaattgaaaatctgacagtataaaccctattatattcctgcatggcataaaatcttcagttgctgaatggtgatatccacttttagaaagagtactctaccctgttctgcattcatacaacctaagccaacccgcccttcaccatcccacttctctttcaggttatctgcttaggctggtaggcatttgtgtttataaaccttgaactcaagctgctagatggtcagttgcattgtgaactgaactatctgaatgatttttcattgtaaatatatagctatagaaacactttaaattcctctttctataaaaagtgaagtagcaaaatttttggaccattcccaaggacaaacaataaaatagagggaaaatacagcaaaaaaaaaaaaaaaaaacaaaaaaaactgtagacttcactatcttcttgtatgattattataatatataaacatttattgaacatttactgtgtgaccgatactagtggtatttttaatcagtgttttttgtaagtgttgaattctcacaacaaacccatgaggtaaacagcatttgtttatatggtattctgccacttacaattttatactatttagggttctaaagggatctttaaatttgagaattaataaaacacatcatatgtcatgtctacatataaaccctttaaattaaaaaatatatctctaggaagaaacaactagttttaaggaatatgcagtatcaattgaaaccaaaacaataagtgaatttaaaagacaatgtagcatcacaggatcatggctctaaacctttctaaaattataatatttaatttgtgtttatcaccaagtgaatcatctactctttagattatctaggagatccattgtctgcagtttatatggtaagcatgggctttgagtcagacagacctaggtctaaatcaagttattttacttctctaaatctgttttctcttctataaaatggaaattaataatactcattgggttgtacagattaagtgagatcattaaagtaaaacagcacagttcctggtacgtagtatatattcagtaaatattactcttgatatcattattatcaattttatcatcattaacttttttggttccaagcttctatagaagtagcgtatcaagaagttttgaggcaaaacagaaaagagaaaagcaggtattaaagcaatgtttttcaacctttgttgactatcacccatggtaagaaaatatattttatatcatgaccgagtttgcaacacacatgtacataaaatagacacaaaagttttatgaaacaatgcccttactatacccagtgcacccacaatttgtgattttcagtatcacaacagaaaatgtgatattttctggccgggcgcggtgactcacacctgtaatcctagcactttgggaggccaaggtgggcagatcccttaagttcaggagttcaagaccaagtctggccaacatggtgaaaccctgtctctactaaaaatacaaaaattacctggaaattactcaaacccgtgagacggaggttgcagtgagcaaagatcctgccactgcactccagcctgggtgacagagcaagactttttctcaaaaaaaaaaaaaaaaaagatattttctattctggtttattctggtttgtttttgtattttaaatgctagacaaaacccactagtgggtcacaatttgcaatttgaaaaacactttcagaggatacatctctgactatatttcataactaattgttttatttaataagcatcttttatttattataattgaaagttggctatgttttataccacagtcaaataacatatgctagaaaaattgccaatctagctgtctgtcttagtggttctgaatcttatggaccccactgagagaatctatttaacactattgacttactagaagaatgcagacatgcaacattccttatattgttccagggattattgatttttcgaagccaggctaagaacctctgccacaatcttgtaattaaacaggcagcatactaggaaagataaggaacaataattaagagtaattcaacattagattttagaaataattgctacagtagaaggggctaggaagtgacaggattagtaagaagggattctctttctcctttttgttaatgtcttggagaatactaactgacttctctttcaataagggacagttgcagcaccaccagtagacttaataactatgactcagtagtttctgtcactgaaatctttctttcacaaggatcagtcaaccactatttgcttttatctcttaatgaactattagactatagaagtactttgcctccttctgtggtttcctaatagctagcattgaagaaactgacctagttcattcagctggggtttattttttaattattttattaccttttttttaaaagaacttttcaaagtttgcttaatgtttcctatgttaaaatatataaccggccaggcatggtggctcacacctgtaatcccagcactttggaagccgagacagatggatcacttaaggtcaggagtttgagaccggtctggccaaaacggcaaaaccctgtctctattgaaaatacaaaaattagctgggcatggtggcacacgcgtgtaatcccagctactccagaggctgagacaggagaattgcttgaacccgagaggcggaggttgcagtgagccgagatcgcgccactgaactccaacatgggtaaaagagcgagaccctgtttcaaataaaataaaacatataaccacttgaaatctctccctgatacatgacatttaaccacctttatcctgtaacatattcattctcaatgactcctttgaaaatttggataacttcattgacatctttaaaataagttagggaatttaaagattttcagtagcttctctctcaaatatgtttatccctaaggaaaaaaaaatggagatatttaaagaaaaattacctttacatggacatttacaacacactttatttattcattcattcattcattcattcattcattctagagatggggtctcgctctgtcactctggctggagtcaaatatgctttattaaataaagtctaacattcataatagaaatcaccatatctgattgtgttaaattaaaagagacttgtagatataacatacagatacagtttatgtttttggataggagtctgatttggacaaagaaatgtaaagcaccttttgggatagttaaggaaacttgaatatggactatattttagataggaaaaaaatgttattgacatgaaaaggtagacactattttttttaaagtagattacaagacagcctgtacagtatgatctcgtggttaaaaatatacatatggatatccgtgtgtatagataaaatatagatattaataatggtattcttagcggtagaaatatggttttattatttttatttatattctttaactttattatttactgcttttgtaaaattaaacttaaagtcactaggaaactctaaaaataactagatgttatttaaaaatgaatttattcagtttcatttacaatatcatggaaaaattacttaggaacaatttagcaaaaagatgcaagacctcttcactataaaacattactgagataaaggagatctaaataaatggttcatgaagaggacttaacattaagatttctatcctcaaatggatctatagatttaatgcagacccaataaaatcctagaaggtatttttgtagaaattgatgagctgattctaaaatttaaatggaaatgctaagggcttagaatagccaaaacaattttgaaaaagaacaaagttggagggcttacagtacttgatttaaagacttactctaaatctcagacagagtggtactctagtataaagatagacagaccaatgggacagaagagagttcaaaaataggttcataaatcacatcaattcaatgggaaaaattttaaaaagtatgtatctatttacttcttagagacagggtcttaaattgtgttacagcccaggctggagtgaagtggtgccatcatagttcactgcagcctcgaattcctaggctcaagtgatcctcctgcctcagcctcccgaggtagctaggactacaggcacatgccaccatgcccaactatttaatattttgttgagatgaagtctcactatgttgcccaggatggtctcaaactcctggtctcaagtgttcctccaaccttagcctctcaaagttctgggattacaggcatgagccacctgccctgaaaaaaaaaaagtttctttttttttaacaattggtgctgctgaaatctcagaattcactattaaagagctcatccctgtaaccaaaaaccatctgtacctcaaaaactattgaaattttttaaaagttggtgctgggacaactggatgaatctggaattactgggtaaacatatgggggaaaaatgaactctaacttgtatctcagtccatacatagagtacttatgtctggatcatagaccaatacataaaatccagaattataaagcttctaaaagaaacataagagactgtaagtttgaagaaagcaaagatttcttagacaagaaacaaaaaaatcattgaccataaactttaaaattgataaattagactttagcaaaattaaaaatctctgctcaccaaaagataccattatgaaaatgagaaaacaggctagtttgggagaaaaagtttctcaatagtttatctgacaaaagactcatatctagaatataaaaagaccttttacaaataaacaatacaatgacaaactaaaaatgggcaaaagatttgaacagatacttcagcctggtgcagtggctcactcacacctgtaatcccagcactttgagaagctgagatgagcggatcacttgaggtcaagagtttgacaccagcctggccaacatggtgaaactccatctctactaaaaacacaaaaatttgctgggcatggcgacgcatgcctgtagtcccaactacttcagaggctgaggcacgagaattgcttgaacctgggaggcagagattgcagtgagccgagatcatgccactgcgctccagcctgggcgacagagcaagactccatcttaaaaaaaaaaaaaaaaaaaaaaaaagatttgaacagatacttcacaaatggagataaacaattgatcattaaacatagaaaggtattcaacatcattatcattagagatatgcaaattaaaaccgtgcgctactacttcatgctcacaagaatggctaaaacaaaaaagactgacaatcatgttccaagaatgtagaacaactggaattctcatacattgctagtagataagaaaattggtctaaacttttacaaatgcatcttccttatgaatccacaattttactcctaggtgtttacccaagagacattaaaacatatgccccaaaaaaggcttgtgcaaggaagtttataacagccctattcataatcactcaaaactggaaacaacccaaatatccatcttgaggagaatgggcaaattatgatatattcgcacaatggaatactacttagcagtaaaacagaatgaattactgatacacaaaacaacatagatgaacgtcagaaacatttatctttagtgaaagaagccagacacacacacacaataataataattaatttttaatgataaaagtcagaaagtggttacttctgggaaagggacagagaatagactggaaagggacatgaaggagctctgaaatgatggacatactccagaccttgctttgcgtattggctataaagcatatataattggcaaaactcattgaactaaatatttaaaatgtatatattttattgtttataaattatacctcaacaaaaatattaaaaccaaacaaaaaaacatttaaaaaaacatgagaggccaggcacagtggctcacgcctgtaatcccagcactttgggagaccaaggcgggcggatcacctgagattgggagtttgagaccagcctgaccaacatggtgaaaccgtgtctctactaaaaaaaaatacaaaaaattagctgggcaaggtggcacacgcctgagtctgtaatatatgtgtctgataaagttcttatatatgtaaaataaggaactcttacagctcattaatgagttagacacttgtaccaaagatgaatttgttctagttgatagtctgaatgcagctacaaaaacacacctaaaagttagtatccacaattttttctttaatagtttttatttgtactgattttacgtagggtattaacatataatggtttaaaaatcgtgatcatacagatgtaatgtatagggtgtacttcttattaccaaagcctaacgtaacctaatccaagtcttcatgttgttacaaagtaaatcttattttgggacaaaggattttattgtactgtaaattgaattgaagcaaataaccccccaaactttacaaagtgttaaaacaaaattgctggtggtaatttcttaagtaaacatcatgaaatatagcttaaagtagaaataaattaagtcaaccatacataacagaactggacccacagtaaatgaagtgtgctgactgggctatgtatcttttgtctgtcttgataaaagaaatgaggtgaccagattttgagagagttatttttccccagtgctcttcctgttgcacacactaaataaacagtgaattctctaattttgcctatctataacttttaaaacacaaatggaaaaatttagacttgagaatcaaaataaaacactgaatatactcaaagaaccttgttcttcatgtgatactaaaactcaaattctaaaatgggtcaataggctggtgcagtggtgcacacctgtaatctcagcactttggcaggctgaggtgggaggatcacttgagcctaggaattcgagaccagcccaggcaacatagtgagaccccatctctacaaaacatcaaaaaattagctgggcatggtggcatgcacctgtattcctagctactcaggaggctgaggtgggaggattgcttgattctaagaggtcgagggtgcagtgagccgtgtttgtaccactgcactccagcttgggcgacagagtgagaccctgtttcaaaaaataaaataggccaggcatgatggctcatacttgtaattccagcattttgggaggcggaggcggatggattgcctgagtccaggaatttgagaccaggctgggtaacatggcaaaaccccatctctactaaaaaaaaaaatatacaaaaaattagatgtgcaaggtggcacacgcctgagcctcagctacttgggaggctgaggtgggagaatcacctgagccagaagaggtcaaggctgcagtgagccaagattgtaccactgcactccagcctgggcaatcagagtgagaccctgtcttaataaataaataaaaataaaaataaaataaagtaggtcaataacatttggtattatctggttacctagtaagtgcaatgtaagctccttttaattggagtatctactaggctgcatttactccaaacttctatacaattatggaggcaattttaaaaataaatgcagaataaacatttcatttgaaacatttgttaataaatacatgaattaattaagcacaaccattaagatcctaattaccatgtgatgggaaggaaaaagggtcaaatagatctgtaactgctaactctttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgctaactcttaaatagctgtgacatactttctactttgtgatttattaatctcttattatgttagttccctacctccaaaagaaatctcccctcatttgtttaaaaaaaaaaatctttattgagtgcttactctgtgccaagtactatgcctggaactagttatagagaggtgaagcagatagacatcatccatggaaggtctgagacacccctgaggtgaacagttctaatctgtgtagaaattcaccagcagatactgaaggcctgaacttgggtgggagtttggagggctttgagaagtgacagaattcagatttagagatgccacaggtaagacttggctatgtagatgtggaggttgagggggaaggagtcaaggatccatgtgttattttgataaattcatacactatgtgatgatcaaatcggtatttaggatacccatcaccttgaacatttgtcatttctttgtggttgggaacatttaaaatctgctcttctagctattttgaaatacacaatatattgttattaatacagtcgccctactatgctgttgaacacttagttatccttgacttacctgtttcacagataatgtattgactttctatttttgtaggtcggttattttcctcctacccccccactactctgccagtgtatttgcatcagattattaaatcagtattcaatgtttcatcatgatgtttatgtgaatatgcatgctgcggcaagtattcaatttttgtggaactttttatttttctgaaattaataattacctatttcactcttagttttctttgagctaatagctaaggcttctcacactcttcaacagctctgtaaaatttctgtcaatgcagtttttcaaatagttgaacttgccatattatctatcagttccacattttcctgcatattttcttcatggagacctccataaccccataacctgatgtagtgtggactagttgctgccccgcagtggtcgtgggactttcttgtactgccatctagggaattattcttacttgtcttagattcactgtttactggacactacttcgtcctttttcttggtttattctcttgtatttatggagcttagagtctaataatttggggggggaagatgcatgtaaagtattttttttctttagttcacattgtctgaaaatatctttattcaatcatcatcatccatcatcattatgcttaaatgatcatttggttagatagaacattctagattgaaaattattttcactcacaattttgaaggcattctttcattgtcttctagtttccaatattgctgttcagaagccattttaagatctttttattcttaatagtctgaagttttcaaaagtttatgccttgagtagatcttttcttcattcattataccaaattttttactctgaaactcagttctgagaattttctattattattacatgattaacaatttccttcccactcttttctctgatatctctttttttttttttttttggcactcctattaatctgttagggtgtcgctagattgaatctctatttttcttttctctcgttgtctatctccttatctttttgttcttcctaaaaaagattctcaactttatcttttaacttttttactgaattttttattttggccatcagatttttaatacctaaggtctgtcttattctgtttcttttcataatatcttttttcatgtatctctgaagatactaacaactttgcatcttcatctttcattgtctgtgtttcctcagagttgtttattctgttcatttggtacagtttttctctttattgtgagaaactttccgcatgtttgtcaatcttcaactctcaatccaaaataagagtaagctgttaagctgactgaaagctctgtgattgtgggtgacactgactgacttgtggccttcactgtggagcagttagtatctttatgtctttgctggaactgttaattttttccagagaaaactctagtctcctgactgaagggtatgggtgtaaaaccatcttcatctaaaatgaagtaagcattttagagctaaattagagaagggataattccccatttttcattccatgcctcactctgtccttctttatgcccaatgtccctgaatccagaatttctctggcttaagtggtttagtctcttgttgagggggagaaggaatagttgcctgattgcattgaagggatatcattcagtaatgattttccatctgcccctcatcccttcctctgttacctcctgtcactgagtctttagagttccacagagaaaatctgcttgtatctagtctctgaaaactttcaggtttggccttctttctctctgttaaaccttgctgccatctgctttctgtttttgcatattatgatgtctccccattccagtgaacatggagtttttgtatctgtttcttgttggattggagtggttttaagatatagagggagaagacatgtctttatgctgctgtcttcaaatctagtagtagctcttaatgagcacatattctgggtgactccgaaagaacaactcagttcgaacaatttttgtcatgtggggtttctcagccactgaaacaccactagaaagatattaatatatatacttgagcagacattggcctaaggtttgccttcttgggttaatagttatattagagttcaattctgggtatgggatgacctcaaggatacagaaattccctgatttgggagtttgaggaggctaatgatactctttttccctgcctaagtttgaaaccaattaaaaggagtcagataaagataatcaaatatcagttttattactaattaatgctaggtggatatgatttgggtgtatagcagtgttcaataccacactcttccatcatgagaccactatcccaattccaaccacagctcctttgggaattctcctgggactgctagtgggcagtttcaaatctgcccccctcctaaaagctctgaaataacttagaataacacattgattcaatcaacttctagacgacactgacccatagctgaaaaatcattccctattccgtttcccatcccaaagtatttctcaccatttcagccagtataggtcaccaggcattttgcagtgagtttacataacaatattaacatgcttcaataatgtcagctataaagatttgctccaaaaattgaatatatgtcctctccccattataaaattcctgaaggaaaactaaagtcctaatagtaaatccttttgtaagtttaagtcaaaagaaagtttattatttattcataggtaatatgttcttatccattttctttctctgattagtctcagccagtcttcgatgcctggctggagttaggaatccctcggcagcttcagcccaggctggccatccttgtaatgtatgtggttctttcagtgcctcagaagttatatttatcctatgccaagtccctcatgagcctcactatgttaaaaaaaaaaaaaaaaggctgggcatggtggctcacacctgtaatcccagcactttgggaggccgaggcgggcagatcactaggtcaggagatcgagaccatcctggctggacactgtgaaatcctgtctctaccaaaaatacaaaaaattagccaggtgtgatggtgggcacatgtagtcccagctactcgggaggctgaggcaggagaatggcgtgaacctgggaggcagagcttgcagtgagccgagatcacgccactgcactccagcctgggcgacagagcaagactccatctcaaaaaaaaaaaaaactacagaattaatttgaatgcaagattagcacaggactgactcaatacccatttaaaaacaaactttgggaagctgaggcaggaggatcacttgaggccaggtgtttgagatcagcctgggcaacatagcaagattaacatggaaattttcctaggactataaacagctattttgttaaacttgaagattttcttcattcaccctccttcattctgatgcacatattatgcatcagagagggcagtttcaaataagccctcctaaaggctctgaaatgagttagaatagcacatttattaaatcaacttatagacaacactaacaactgcctctacaaaaaaatataataataaaaattagccaggccgggtgcagtggctcacacctgtaatcccagcactttgggaggctgaactgggcagatcacttgaggtcaggagttcgagaccagcccagccaacatggtgaaaccccgtctctactaaaaatacaaaaaaattagctaggcatggtgatgggtgcctataatcccagctacttgggaggctgaggcatgagaatcacttgaacccgggaggcagaggttgcagtgagccaagattgtgtcactgcacttcagcctgggtgacagagtgagactccatctcacacacacacaaaaaaaaaatttagccaggtgtggttgtgcactcgtatagtcttagttactcaggaggctgaggcaggaggatcacttgagcccaggaggtcaaggctgcagtgagtgatgattgcaccactccactccagtctgggtgtcagagcaagaccctgtctctaaaaacaaacaatcaagtgacagtccctaggagagttattccaggcaaaactatgttcccagagcttggtacttactgttgccaaagaccacagcaaatgcataatatgttcatcagagtgaaggagggtgattgaagaaaatcttcaagtttaacaaaataattatttactgtccaaaaattataatcaaaagtttgcttgttgagctgagtcaaaacaaagggaattcattttagataaacatgattccagacatcatcaggctgcagccatatctaccaaagctacatctgttaggtcagatacttgagtcagtctgacaagatcccttcttctaggaacatctgttttatttggcatgaattggtgggtggtggaaggatccttccaaccctgagagtctgtgagtgacctttctttctgccattggagaaggaatagaattgctactactactttcacttgtacatatgtactgtttcagagcctggagccttctgatagagtagagctgctaagcacctaagagcagcagttttgccatgtggcctctctgatatcaggcagctccccagctaggggaagctagagtcagggtttaggtaggtgtaactgttcagttctgctatcattgactattgctaagatattcatttccttgtgtctcactgaaagagaactacataggaccaatatgagataaaggtatatcttgcttagaataattcatttctctcttcagggaaagtaataataacagccaagttagagtgctatatgaatgggtaccaagcgctgacctgtcattgactttcttcccgtaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgaga

SEQ ID NO: 37628 - DNA, 57348 bp, Homo sapiens
agatgctgaggaatatggcaagaagttggggttcaaagtctgatgccaaagctagcaacccgagaaataaaaccgctgatcaccagctccccactcaggcccagcccccttttagagcccccagactccccacgcagggccctagccccctagtcttccccgtcaatgccctgttggcaatacagccatcaggttctatcagagtgagctgtttttatatgattattttcccccctgggaagacggctttgtctgtgaaagtccccccaaccaggcgccttataaacgcctaaaacagacagagttgaggagaaaggaggggaaaggaggagggagcaaacccggaggggggccctgaggttcgcagcgggcaggatgggggtatgaggccggagtcggcggctcccaggcccccagccccgtcagggcgcccccgtccccaggcgccagagccggggtccgcagccccctagcactccctggacggccgcgggcctcccacaggcctcgaagtccagagactgatcctgcgaccggaaacgcccccctgcccagcaggcccagaccgcgcccccctttcctgccgcccccttcccgcgggcccggctgcaggccccggatccccgggctcgcgtggccgccgcagccgaaaggggcggcccgtcgggcggccccgctccccggccctcgccgcggcccctccaactccgggtgctgcggggccaaggacaacacaaaaggaaggggggccctgccagcgacgcccctgccagcccccgagaccccctgcgcggggtcggcaaagcatctggacaccccagaagctccggacgccgaagagagaggccccacgaaaatttcaagacacctcctgggggctgcaggggcggccaagtctccccagcgccaggtgcccccggccacacggtaacttttaaactttggggcagggcacggggaccgggatccccaaaaaggagcaaatggggttttagagacgatttattttttgcaaaatcccactttccaggtggcccggcgcgcggccccggcctggaaagggctctcttcgcctcttccccagccctgcccggcccgggcgtccccgaaccctcgcgcgcgggcggctccggacgcagtgtccccggcctctgccccgcggggctcgggccgcgccaagcactcacctccgccgggctgcgctccccgcgggcctgcgccgagcccgataaatggtatgctatgactagaggtatgattacgttattattattagtaataataagagtaaatgctatttaattacgggcggccgcatcctgctcccggcgccgccgccccggcagctccgtccatgtggctctggagcgctttactttcatttccagcccctcggctggccgctcgcggcagcacccgctggaggcactgtctccctgcagctcttcctcctcgggtcctagagagctcggctcccgtcgcctcgccgcgcccggggtgggcggcgcgggctgcgcacctggggagaagggcggggggcgtgggggcgagtcggggaagccccattccccgtcgaaagctcatgcctggaattcacctttattttctttaaaagtgtcctgccttttaggggggtttcttttggcagttctgcatttctgggctgatgctgctcaaacccagcgcctccgcccttccccatctgtgtcaaaagtccccccgccccccttctccggcttccaggtgctttcatggaaggctgcccaaaaccctggttgcgttgtgcccttctcatagatgggaaccggagacacatagaagaatcaggacctcacttggctggagttttatgtataggatgttaaaaaaaatattgaatgacacttgttaaagactacaaggccgactttattggcatcatgatgggtgtagggaccactgcagtgggttttgcggtcagggagagtatttgggctcaattcagaaatcagcatgggcaactgggaatttatgaggaaggagaaaggatccactgattgagcgccagtgcataggaaactgcatcagagatgagaggattctcgcttaaacccatctaacaagattcttgctgaaggcagggcaaggtgatcagacatcacctggggaatggtggaaaatgaggaacctgattagatattgacaatcagggctgggtgcagtggctcacgcctgtaatctcagcactttgggaggccaagacgggtggatcacctgaggtcaggagttcaagaccagactagccaacgtggtgaaaccccatctctacaaaaatacaaaaattagccaggcgtggtggtgggtgcctgtaatcccagctactcaggaggctgaggcaggagaatcacttgaaccccagaggtggaggttgcagtgagccaagatcatgccattgcactccagcctgggcaacaagagcaaaactgtctccagaaatatatgtgtgtgtgtgtgtgtgtgtgtgtgtgtgtgtgtgtgtgtgtgtgtgtgtgagttcccaataccccctaggcaatttacaatgaaacacccttgacaacttatcacatttaccaccatggttattatcactctcatttcatcgatgaggatgctgaggccagttggattgctgcattttgcctcaagtgaactagatggcaaatggtctggtgattccaccaccccaggttgctggtgaaataatgaacacatattcttgaagaggactgtccatcattcaagggggattcagcaggacaccagcctcttatctcttcaagttggtaccaacttgttcaattgtttgggctgcctaagatggtaaaggggtctttattacaagaccccaaccagaggtgaggatgctttggagaaaagggccaggaggaggccgggcgcggtagctcacgcctataatcccagcactttgggaggttgaggcgggcggatcatgaggtcaggagatcgagaccatcctggctaacacggtgaaaccccatctctactaaaaatacaaaaaataagctgggcgtggtgtcgggagcctgtagtcccagctacacaggaggctgagacaggagaatggcgtgaatccgggaggcgtagcttgcagtgagccgggatcatgccactgcactccagcctgggcgacagagtgagactctgtctcaaaaaaagaaagaaaaagaaaagggccaggaggctggcatcggtaggctttctgggaagccccatgttgtcagtcccatgttgtcacagtgtgctctatgtccccatgttaaagctgaaatagcagtaacagccaccgcttctttactatgagccaaacactttgcatatgttgattcttttaccctctcaaaaaccctgtagctcggcacggtggctcacatctgaaatcctagcactttgggacgccaaggtaggtggatcacctaaggttaggagttcgagaccagcacggctaacgtagtgaaaccctgtctctacaaaaaaatacaaaaattaggccgggcgcggtggctcaggcctgtaatcctagcactttgggaggccgaggcgggtggatcacaaggtcaggagatcgagaccatcccagctaacacggtgaaaccccatctctactaaaaatacaaaaaattagccaggcatggtggcgggcgcctgtagtcccagctactcgggaggctgaggcaggagaatggcttgaacctgggaagtagaggttacagtgagccgagatcgtgccactgcattccagcctgggcgacagagcgagactccatctcaaaaaaaaaaaaattcatatgttgaatctctaatccctgatttgatggtattaggaggtggggcctttgggagataattaggtcatgaaaatgaagccctgatgaatggaattagtgctcttataagagacactggggagattatctctctctgccaggtgaggatacagcaagaaagcagccatctataaaccaggaaggcggccctcaccaacaacctgaccatgctgggaccctggtcgtggacttccagcccccagatcagtgagaaataaatttctactgcttaagccatccagtccatggtatctgtcatagcagcctgaggtgactaagatgggggtaatgtgagtactgtactcgatggggtacacccaaaatcccaacactaggaggccgaggtgggcagatcgcttgagcccaggagtttgagaccagcctgggcaacatgacaaaaccctaactctgcaaaaaatacaaaaaattggccgggcgtggtggctaatgcccgtaatcccagcactttgggaggccgaggccgggcgtggtggctcacccctgtaatcccagaattttgggaggccaaggtgggcggatcacctgaggtcaggagcttgagaccagcctgaccaacatgttgaaaccccatctctacgaaaaatacaaaaatgagccaggtgtggtggcacgcacctgtaatcccagctcctcaggaggctaaggcaggagaatcgcttgaacctgggaggtggaggttgcagtgagccgagatcgcgccattgcactccagcctgggcaacagagtgagactcagtctcaaaacaacaacaacaacaaattagccaggtgtggccaggcgctgtggctcacgcctgtaatcccagcactttgggaggccaaggcgggtgggtcacgaggtcaggagttcaagaccagcctagccaatatggtgaaaccctgtctctactaaaaatacaaaaattagctgggcgtggccaggcacggtggctcatgcctgtaatcccagcactttgggaggcagaggcgggtggatcacctgaggtagggagttcgagaccagcctggccaacatggggaaaccttgtctctactaaaaatacaaatatcagccaggcgtggtcacgggcgcctgtgatcccagctacttgaggctgagtaacaagaaacgcttgaacccaggaggcggacgttgtagtgagccgagatcgttccactgcactcctgcctgggtgacaagagcgagactccatctcaaaaaaagaaaaaaaaaaattagctgggcgtggtggtgtgcacctgtagtcccagctgctctggaggctgaaccaggaggatggcttgaacctgggaggcagaggttggagtgagccaagatcacacaactgcactccagcttgggcgatagagcaagactcggtctcaaaaaaaaaaaaaaaaaaaaaagccaggtgtggtgatgtgtgtgtagtccccagctattcaggagggtgagcccagaatcctcaaagcggaggatccttgagccaagaaggtggaggcagcagtgagccatggcttcatcactgcactccagcctgggtgacagagcaagaggttgtcttgaaaaaaaaaaaaaaagtactgtacccaactgaaagggtctgtgatggctcatgatgtgtccacttgcctgggccacagggtgcccagatatttggtcaaacattctgggtgcttttgtgggggtgtttccagatgagtttaatatttaaatctataaactgagtaaagctgattgtcctccctaaggtggatgggcctcatccaaccagttgatgacctgaatagaacaaaaaagctgactctcctgcaaagaagagagaattcctcctccatgatggccttcaagctgggacattgacttttgctttctttttttgagagggagtcttgctctgttgtccaggcaggagtgtagtggtgctatctcagctcactgcaacctccacctcccaggagttcaagtgattctcctgcctcagctttccaagtagctggggctacagatatgcgccaccacacccggctaatgtttgtatttttggtagtaacggttttcaccgtatttaccaggttggccttgaactcctgatctcaagtgatctgtccgcctcggcctcccaaagtgctaggattataggcctgagccactgcgcccagtcgggacattaattttttccctgcctttggatttgacctgaaccatcagctcttcctggctctctagcctgctgactgtagatcttaggacttctcagtcttcatacttacatgagccaattccttaaaataaatcactttgtgtgtgtgtctctctctcatacgtacatatatctcctgctgattctatttatctggagaactctaatatagggtcactgcaaggactgagttattatatgcatagcattgatatatgtgtgtgtgttttttttttttttttggagatggagtctcactctgtcacccaggctagagtgtagtggcacaatctcggctcacttcaacatccatctcctgggtttaagagattctcctgcctcaccctcctgagttgctgggattataggcatgtgccaccacacccggctaatttttatatttttagtagagatggggtttcaccatgttggccagactggtcttgaactcctgacctcaggtgatccactcacctcggcctcccagagtgctgggattacaggcatgagccacctcacccagccttgtttgtttgtttgtttgtttttaaattcataatcagtgtttttattattttcgatggtggctcatttctaagttaagtgatgtatactgtctacatttcccatctataagcttttgtttttcctggacttttgttacctaattttgatttgcttaggttattatttttttaatctatggcatgtcttcctatcactatgtacaatggctttcagtagaactttttacatcttcaaactcatcagataactgtgttttaatatctttttctgaggacattcctcccaaatccctctgttctgctccacttggggctgataggtccttttctgttttgagacagggtctcactctgttgcccaggcttcagtgtagtggcacgaccttggctcaccgcagccttgacctctgggctcaagaggtcctctgattgttctttattcttgttgcacagctgttgtttggggacttccctttgccatcatcctgggatttccctttacctccttcctgtgtgatctccggtttcctaaaatccctgtcttcctctctgttaggttattccctgttttggtcagtacatcatccaagagtttcctgacaaaagagatgggaaggtaatttgtttctccagaagtagatttttctttcttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccattcagccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaagccgccattgtcatcctggcctgttctcaatgagctgctgggcacacctcccagacggggtggtggccgggcagaggggctcctcacttcccagtaggggcggccgggcagaggcgcccctcacctcccggacggggaggctggccgggcggggggctgacccccccacctccctcccggatagggcggctggccgggcgggggactgacccccccacctccctcctggacgggttggctggccgggctgggggctgatcccccacctccctcccagatggggcggctggccgggcggggggctgatcccccacctccctcccggatggggcggctggccgggcggggggctcacccccccacctccctcccggacgaggtggctgccgggcggagacgctcctcacttcccagacggggtggctgctgggcggaggggctcctcacttctcagacggggcggctgccgggcggaggggctcctcacttctcagatggggcggccgggcagagacgctcctcacatcccggacggggtggcagggcagaggtgctccccacatctcagacgatgggcggccgggcagagatgctcctcacttcccagatgggatggcggccgggaagaggcgctcctcacttcctagatgggatggcggctgggcagagacgctcctcactttccagactgggcagccaggcagaggggctcctcacatcccagacgatgggcggccaggcagagaggctcctcacttcccagacggggtggcggccgggcagaggctgcaatctcggcactttgggaggccaaggcaggctgctgggaggtggaggttgtagcgagccgagatcacgccactgcactccagccttggcaccattgagcactgagtgaacgagactccgtctgcaatcccggcacctcgggaggccgaggctggtgcatcactcgcggttaggagctggagaccagcccggccaacacagcgaaaccccgtctccaccaaaaaaatacgaaaaccagtcaggcgtggcggcgcacgccttcaatcgcaggcactcggcaggctgaggcaggagaatcaggcagggaggttgcagtgagccgagatggcagcagtaccgtccagcttcggctcggcatcagagggagaccttggaaagagagggagagggagaccgtggggagagggagagggagaaggagagggagaggagtagatttttctaactgcaggatgggctgtttgtttgtttttaacgaaaaagttaggtgggccaggcacggtggctcatgcctataatcccggcactttgggaagctgaggcaggagcattgcttgatcccaggagtttgagactaactagcctgggcaacatagtgagaccccatatccaccaaaagagaaaaaggaatttttttaaaaaaccaagtattttaaaaattatttcttttctttttttttttttttttttttgagacagagtctggagtgcagtggcgcgatctcggcttactgcaagctctgcctcccgggttctcgccattctcctgcctcagcctcccaagtagctgggactacaggcgcccgccaccacattcaactaatttttttgtagttttagtagagatggggtttcaccgtgtgagccaggatggtttcgatctcctgacctgtgatccgcccacctcggcctcccaaagtgctgggattacaggcgtgaggcactgcacccagcctaaaaattatttcttaatgctcttttgcatttatactaaacagattattgacagttttcattttatttatttatttatttacttttgagacaggttctccctccgttgcctaggctgaagcacagtggtgagatcacagctcgcttcagccttcaactcctgggctcaagcaatcctaccccgtcagtctcctgagtagctgggattacagatgtgcatcaccgtgctggttaactttttgtataattttttttttttttttttgagaggagtctccctctgtcacccaggctggagtgcagtggcgcgatctcggctcactacaagctctgcctcccgggttcacgccattctcctgcctcagcctcccaagtagctgggactacaggcgcccgccaacacgcctggctaattttttgtatttttagtagagacggggtttcaccatgttagccaggatggtctcaatctcctgacctcgtgatccgcccgcctcggcctcccaaagtgctgggattacaggcgtgagccaccgcgcccggctagacaatttttttgtagagacagagttttgctgtgttgcccaggatggtctggaactcctgggctcaagcaatcctcacacctcagcctcccaaggtgttgggaatacaggcgtgagccactgtgcccagctcagttttcattaaaaaagaaaaaaaaaattgtttccattttggaacaagaggattatttatttatttatttattttgagacggagtctcactctgttgaccaggctggagcgcaatggcatgatttcggctcatgcaacctccgcctcccgggttcaagcgattctcctgtctcagcctcccgagtagctgggattacaggggcccagctactttttgtatttttagtagagacggggtttcaccatgttggtcaggcgggtctcaaaatcctgagctcgtgatccacccacctcggcctcccaaagtcctgggattacaggcatgagacattgcacccggccacaagaggattattaaaagagaagatgaaggccaggtgcagtgactcacgcctgtaatcccagcactttaggaggcagaggcgggcagatcatctgaggttgggagtttgagatcagcctggccaacagggtgaaaccccgatctctactaaaaataccaaaaattaaccaggcgtggtgttgggcgcctgtaatcccagctactcgggaggctgaggcaggagaatctcttgaaccaaggaggcagaggttgcagtgagccgagatcgcaccattacactccagcctaggcaatgagagcgaaactccgtctcaaaaaaaatgttttaatattaaaaaataaattgaaagtaaaatacaatgaaaatacaaaaattagccaggcatggtggcacgtgtcagtaatcccagctactcaggaggctgaagcaggagactctcttggacccaggaggcagaggttcaagagaacctcctttcaggaagccgagattgcaccactgcaccccagcctgggggacagagtgagactccaccaaaaaaagaaaaaaggaattattattattattattatttttgagacagagtctcgctctgtcgcccaggctggagtgcagtggcgcgatctcggctcactgcaagctccgcctcccaggttcacgccattctcctgcctcagcctcccgagtagctgggactacagatgcccgccatcacgcccggctaatttttttgtatttttttagtagagacggggtttcaccgtgttagccaggatggtctcgatctcctgacctcgtgatccacccgcctcggccccccaaagtgctgggattacaggcgtgagccactgcgcccggcctattttttttttttttttttaagatggatctcactctgttgatccggctggagtgcagtggcgtgatctcggctcactgcaacctccacctcctaggttcaagtgattctcctgcctaggcctcccaagtagctgggaccacaggcacgtgccacagtgcctggctaatttttttgtatttttagtagagacagggtttcaccatattggtcaggctggtcttgaactcctgacctcgtgatctgcccacctcggcctcccaaagtgctgggattacaggcgggagccaccgcacccagccgatgaaggaattattaaaagagaagataatctgccagaaaccatttggtaccgggaaatcctccataaacattagagcagaatttaaaactcctccatagacaccatccttttcaatctctttcatcactggatttttcaggagctggaacagtgcctattggaacatagatgtttgataactatttgtagaacaaatgaattattgtaatgatggttatttatcaaggttaaatagttgctctagtgggatgcccttggtttgagtcctgagaaagatgtggttcgactgtccttcatagatgatgcagccaacccactcccaccagtggaggggaccctgggggaggctgccttgccctgcaggtgggctgacccatctctctccaggggctgcaggcgagcacccagttgggtgttgggaatttccctccacattcctcacatgtctggcatactttagccatttgtttttgatctgactaaatggcaagtcagcagccttggtctgttttcaggaatccaacataaatattattatttattccatttacaattggcaattaagttcgttttcaggcaccagaatggaatttaaaacactcagttaagtaaaccagactaatcagaggcagcctgcttttgtctttgaaacattctttacaaaaacaacaaaaaaaggctgcacaacagagaaaggcctggaacactctctgcttctcctgattcccccttaaactcacctcgcactcacaagtgaagtgtatatgttgaaaacaaccctagaaggccggaaatggtggctcacacctgtaatcccagcactttgggaagccaaggtgggtggatcacctgagtcaggagtttgagactagcctggacaacacagtgaaaccccatctctactaaaaatgcaaaaataagctgggcatggtggtgggaacctgtaatcccagctactcgggagtcttaggcaggagaatcgtttgaacccgggaggcagaggttacagtgagccttgattgtgccattgcactccagcctgggtgacagagtgagactccatctcaaaaaaaaaaaaaaaaaagtaataataataatagaaaaggaccctagagacctgtcttctattctctttctctctctctctctctctcttttttttttttctttgagacagggtcttgttctatcattcaggctggagtgcagtggcctgaccatggctcactgcaaccaacctccacgttctgggctcaaggatcctcctgcatcagcctccctagtagctgggactccaagtatgtaccaccatgcctggctaattgtttttagtagagacagagtctcactatattgcccagactggtctcaaatcctgggctttagcaatcttcctgccttggcctcccacagtgctggcattacagttggttgtgagccaccatgctcagccttgtctcatgtgtaagtcacactgtaacttgggccttagttcttcatttgttgaaataaggaacaagatagtcttggatgacactatccatctgtcaaaggccatgattacacttcttgggccaggcagactagctctcaggtgataacttgaaagagagaaagctggagaaagggctggaaggagaaagagagaagataagtgtgttgcttggaaacagtgatgattcttttttttgaggcagaattttgctcttgttgcctaggctggagtgcaatggcgtgatctcagctcactgcaacctccgcctcttgggttcaagagattctcctgccccagcctcccgagtagctgggattacaggtgtctgccaccatgcccagctaattttttgtatttttagtagagacagggtttcaccatgttggccaggctggtctcgaattcctgacgtcagatgatccacctgcctcgccctcccgaagtgctgggattacaggcatgagccactgtgcccggccagaaacagtgatgattcttgattcttctgattcactgggcacccttgggcaaaccccctgttccttttcaaaccccagtctccccatttgtaaagaggtttaagatagattcaggaggccggccacagtggctcacgcctgtactgtactcccagcactttgggaggccgaggtaagtggatcaccaggtcaggagtttgagaccatcctggccaatatggtgaaaccgtctctactaaaaatacaaaaattagccgggcgtggtggcgtgcacctgtagtcccagctactcgggaggctgaggcagaagaatcacttgaacctgggaggcggaggttgcagtgagctgagatcgcaccactgcactccagcctgagcaacagagtgaaactccatctcaaaaaaaaaaaaaaaaaaaatcaggatataggagtgacagaatccagattgctagggggtgctgtcaggctgagtttgtgatttttagcttcgaatgtgaacaccttcaggcagaacatccactctctaactccccccaagccccaccaagccccgacaagccccatgacttcctgttacctcccaggtccttgaaggccactgaatttctgttgtctaagaattcccttccagttccgaaaacccaatgtcctatcagctggatgaggacgggatcagctaagatgttcccctgcccaccttcctcttccctttgggaggtctctgtgtgagggccaaggaaagtctcaagaagtaaaattggaaaagggagcctgcggatcaccccaaggaaaatccagactgattcgatcagtcctagctggaagcagcacaggaatagcaggaagcctatgactcattttaagcaaacatccggtaacccgactggtatctggttcaaatggggaaacctgaagcacctatgacaggccaggcccagagaagatactgcccagatggatacagcgtctgctctggagaccctcccaggctgaggaggaaactgccaagaacagtgttaactctgtcaaagagccccagagtcccaggccaactgctgtggggctttgcatcttgctgtgggcacctgcaggagggagagactcatgaagtagcatttgacatgggccttgtaggtaaaaaggagagggaaggtggaaagaggatccacatctcaggaactttgagaactgggagagttacactctgtctagagcttcagttttctcatctctgtgctgggaagggtggtaatgatgcccacttcccttgtggtggtgaagattaaatgagctgtgtgtaaaaggatatggcatgatctgttaattaattaattaatttatttatttatttagagacggagtttcgctcttgttgcccaggctggagtgcaatggtgcgtctcggctcactgcaacctccgcctcccgggttcaagcgattcttctgcctcagcctcccgagtagctgggattccaggcatgcgtcaccatgcccagctaattttatatttttagtagagacggggtttctccattttggtcaggctggtctcaaactcctgacctcaggtgatccgcccgcctcggcctcccaaagtgctgggattacaggtgtgagccactgcgcccagcctgcatgatctgtttaactttttttttttttcttttttcagtttttgagacaaggtcttgctctgtcgccagggctgaaatgcagtggtgcaatcacggctcactgcagcctcaagctcccaggctccagatcctcctgcctcaggcccttagctgagactacaggcttgcaccatcacgtccaactaatttttgtattttttgtcgagacagggtttgaccatgttgcccaggctggtctcacactctctcgcctataatcccaacactttgggaggccaagatgggcaacaagagtgaaactccatctcaaaaaaaaaaaacaaaaaaaaaacgctgtttgtgtttttatgcttaaattcacacctacagaaaagttgcaaaaatgttcaaagaactcccatattcttcaaccagattaactgattaacattttgccacatttgtgtctctgctttctctatgtatatgtataggtatatttcttttaaccataaaggttgcagacatcatgtcctttttgtccctaattatttcagcatttttttccaagaacaagggcagtctcttacataaccctgtaccataatcaaaattaataaatttaacattgatacaatactattatctaatatagtcaagttttgctgtttcagtattgtcctttatagcaatccccacccaggatccgatccaggaccatgtcttgcattcagttgtctttttcgtttcctgtaatcggcaacagttcctcagtttttctttgtcttacataatacagacatttccggaagggtacagatcagttattctgtaccatgtccctcagcttgggtttctcatgattagactaaggtcatgcattatagaccggacggtgacgccgtgtttttctcagtgcatcacacagaaagcgtgcgatgaatgtcagcttgtcctgctgttgatgttaacgtggccgttcaagtggtgtctgcggagcttctctacgatagttactatttcccctttttaattatcaggtaatttgtgcatatttatgtggaagccttcgaatgccctttcagtttcatgggacggaaaagagtcttttctttcgggaaatggatacctgtgtcttgcccaagagacccagcagccagcagtacctgttatcaacaaagttacgcgaacaaaacctttccggaagagctgagggacctgggtgcaacgcattctgggaattgtagtctctgggcgctcccggctgaacacctccctgcggtctctgcgagaaagagccagaagccaccaggggagggcgaagaggagggcggtggaggacgctctgcgcgcggtgcgccatgggacgggtagttcgcggtgcgcgccccatcgcgctcccagatggggaaccggactactctacccgagaggccgcgcgagcggggcgagggcaagccggccggggcctcgaacaaatcaaatcgaagcaaagaaactgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacggtagagtcagggtccctttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaagtgagtgtggaggggtgcatctctgtctcgctctctcttggactgaggaatgggcccccgttcagctgagaagttctgtccctattctatctggaggcttcaccaccaccttttaccctcaaattgtcccatctcagaactgcaagagatgctggggtttcaggttaatttttttgttggtttttctttaaatttttttatctttttagagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacaggtgtgagttattgcactgggctggtttctggttaatttattttttgaaacagggtctccagaagtacagcagcaagatctcagctcactgtagcctccacctacggggctcaagtgatcctcccaccttacatcccaggtagctgggactgcaggcacctgccaccacacccagctagtttttgtatttttagtggagacagggtttcggcatactgcccaggctggtttctaactcctgtgctcaatcgatccgcccacctcagcctccggaaatgctgggattgcaggagtgaaccattacacccgactctggttaattttttttttttttgagacggagtttcactcttgttgcccacgttggagtgcaatgccacgatctcagctcaccccaacatctgcctcccagattcaagcgattctcctgcctcagcctcctgagtagctgggattacaggcatgtgccaccacgcccggttaattttgtatttttggtagagacagggtttctccatgttggccagggtggtctcgaactcccgacctcaggtaatccacccacctcagcctcccaaagtgctgagattataggcgtgagctaccgcacccggcctggttaatttttattttattttattttattttatttttttgaggtgagtctcgctctgttgcccaggctggagtgcagtggcgcaatctcagctcactgcaagctccacctaccgggttcatgccattctcttgcctcagcctcccgagtagctgggactacaggcccccgccaccaggcccggctaattttttgtatttttagtggagacgggtttcaccgtgttagccaggatggtctcgatctcctgacctcgtgatccgcccacctcagcctcccaaagtactaggattataggtgtgagcctttgcgcccggccctggcctggttaatttttatgcaatttcaactggtcgtttcttgagcaccttctaaatgccaggctctatgtggcaagtagagtgatcctgtcaaaatgtacgtcagatgacatctgctttctgctaaaaacttcagtggttttccttgtcacttatagcgaaagccactgttcttcaaatgggctttatgacttgggccccttgttaactgtctcttctcttaccttgtttttttcctctctctctgtgcttcagccccactggccctgttgcagtttctccaaccctctgcccctacaagagccattgcatttgctattccctttgcaggaatcatgttcccccagatgtgtgcatggcccaatccctgatatctttatttaactatttcctaataatgcctttttgttgttgttgttaatgcctttttgttgttgttgttgttatttgtttgttttgagttggagtcttgctctgtcgccaggctggaatgcaatggcgcgatcttggctcactgcaacctccgcctcccgggttcaagcaattctcctgcctcaacctcccgagtagctgggactaaaggcgtgtgccaccacgcccagctaatttttgtatttttagtagagacggggtttcaccatgttggcctggctggtcttgaactcctgacctcgtgatccacctgcctcggtctcccaaagtgctgagattacagccgtgaaccaccactcccggccccccaaccccccccttttttttttaaatcacatactaaatgtgtcatttagaacatatgcttcaagaggtcagggtttatgcttcctttactgctatactgctgacctggaacaacatccagcacacagtagtaatcaatgtgtttttgaatgaatgagtggacaccttacccaggataataattcatgcttattgataaaggcagacaaaccagggttataagttagaacccagaggaagcctaggggtgggaggattcagggtatcacaactgtatctgagaatgaggaggttgtaggaggaggcctttcggatagcaccccctagttctgcccctcatatctgcttccttggtctctcctgattacttgctgtttcttttctttttttggagcatctcacagatacgtttattcataccacaaagtaaacactattcaggtatgtagtgatgttccacgttcctgtctaatatagctggcttcaatttataggcagtacacattgagacatttaatctcacatgtactccaagtaaagctggagtaccatgagcaggcgcaggagttctcaaagctttacttgttttaaaaattttcatttattggccaagcgtggtggctcatgcgtgtaatcccagcactttgggaggctgaggcgagtggatcacgaggtcaggagatcgagaccatcctggctaacacacggtgaaaccctgtctctactaaaaatacaaaaaaattagctggacatggtggtgggtgcctgtaatcccagctactcaggaggctgaggcaggagaatgacatgaaccttggaggcggagcttgcagtgagcccagatggcgccactgtgctccagcctgggcgactgagcgagactccgtctcaaaaaaaaaaaattctttcatttatttagttacttttagagatagagcctcccgctgttgcccaggctggagtgcagtggcagtcatagcttactgcagctttgaactcctgggctcaaatgatcctcctgcctcagcctctccagtagctgggactgactacaggcacgtgccaccacacccagctaatttttatttttatttttatttttttgagacagggttttactctgtcacccaggctagagtgcagtggtgagatcatggctcactgtagcctctgtctccggggctcaatcaatcctcccacctcagcctccccagtggctgggattactggtgcacaccaccataccctgctaattgtatttatttttagtagagatgggattttgccatgttgcccagactggtcttgagctgctgggctcaagcgatcttcccatcacagcttcccaatgtgctgggattacaggtgtgagccactgtacctggccagctttacttcttttaccagcactcctgattttataaatagtgaggcttatcaaccccatttctacccaaatcttctggtagacttgagtatagtagggcttcataggtagcagccctgtccctgtcctattatgatggtagctgttgtgatgtggcgatctctgatctagaaacccctgaggggccattgtggcctgcccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcaggtgtgtgcttgggccagactctgcagcctttggtttgggacttgactgccattcactgaaggggcccaggaaatgggcagctcacatggtgttgctgggtgtccagctgcggcagtttagcagaggaggacttgtaatgagatggtagcttcttataggctaagacatgatttttctgttcttttactacctcctgcaccttctagaactgttccttctctgatgctgttttcctttcttccagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatggtgagtttctggaagttgtgcactggtgtgtccaggggaggagagggagtgtactgaactcttactggttgtcaggctctttctgctacattgtctccattatttgtcccagcagctctgtgaggtatcattgggcctattctaacaatgaggctcagagatcatttgcccaggagcaagctcccctgcactttccatgtttgtattgggcatccctttgtgccctgccctttctttctcaggaggggatgataggtaatgaggggccacagttagtgccagtcccaagatacagcctctgactctgacttaatatccggtgttgtccccacccttgcccttaacccccatgatcccaggcaggcctgggaatagctgcagctttccccagagctgaggctctggtggagctgcattaaaacaacctgggccctcttgggagatgctggttcatgcaaccagatgtacctgggagagggatggctgtctgtgtgtatacaggtattgcaaccacagaaaactaggaaccagagagcagaccctgtcttttcatcccttgtcaaggcttggctgccactgaccaaccctgaatcacctggcacctgcaagtgaaggcacctgcatcaagtgaggcctcctgggattctggcccaaccaggggaactggtctggacatgcctggttgtcatgttgtgtaggcagccttgttctcctctccaggtcggaggctgcttgagtccttgggtagctgggagcgtgctgatgcatgttcctaacatctccataaggtctaacgtttatagacttcctccctgtgcatttatcactttttttttttgagatggagtctctgtcacccaggctagagtgcagtggcacgatctcagctcactgcaaacctctgcctcacgggttcgagcagttctcctgcctcagcctcctgagtagctgggattacaggcgcccaccaccacacccggctaatttttgtatttttagtagagatagggttttgccatattggtcaggatgctctcgaactcctcatctcaggtgatctgcccaccttggcctcccaaagtgttcggattacaggcgtgagccactgtgcccggcttttttttttttttttgagatgagtctcactctgccacccaggctggagtgtagtggtgcgatgttggctcattgcaacttctgtctcccaggttcaagcgattctcctgcctcagcctcccaaatagctgggactgcaggctcacaccatcacgcctggctaatttttttttttgagacatagtcttgctctgttgcccaggctggagtgtggtggtgcaatctcagctcactttaacctctgcctgggttcaggcaattctcatgcctcagcctcctgggtagctgggactacaggtgtgtacaaccatgcccagctaattttcttttctttttgttttttttttgagatggagtcgtgctctgtcacccaggctggagtgcagtggtgcaatctcggctcactgtaagctctgcctccctggttcacgccattctcctgcctcagcctcctgagtagctaggactataagcacccaccaccatgctccgctaattttttgtattttagtagggatggggttttaccatgttggacaggctggtctagaactcctgacctcaggtgattcgcccgcctcagcccccaaagtactgggataacaggcgtgagccactgtgtctggccttcagcctatttttgtgtttgtatttttattattattattttttttgagacggagtctcgctctgttacccaggctggagtgcactggcatgatgttggctcactgcaggctccgcctcctgggttcatgtcattctcccacctcatcctcctgagtagctgggactacaggcgcccgccaccacgcccggctaatttttttgtatttttagtagagacggggtttcaccgtgttagttagccaagatggtctcgatctcctgacctcatgatcctctcacctcggcctcccaaagtgttgggattacaggcgtgagccaccgtgcccggccccttatttttgtatttttagtagagacggggttttgccatgttggccaggctggttttgaattcttgacctcaggtgatccgcccactttgacctcgtttatcacttttgatgcttgcgtcacccttgtgggagatagattggaatgttgctgttttataaatgagaaaaaggaatttaggagactttaagtaacttgaccaaggtcacacatttgataaatagcagagctaggattttcacagaggttcagtgaaatccctattcctgtgcttctaattagacattgagctccgtttaggaaacagagatttgatggcaaatgccatttattgaacaccgtgtcagataagggtattaagtgccagataaatagtatctcagtttatcttcacaaaatcctttgagatagattgcatttccattttgcagattggaaaactgaggtttagggaggtggtatgacatgcctaagggcacagctttaatgagtagagctgggattagaactcaagtttgggccaggtgcggtggctcacgcctgtaatcccagcactttgggaggccgaggtgggcagatcacctgaggtcaggaattccagaccagcctggccaacatggagaaaccctgtctttactacaaatacaaaaattagccgggcgtggtggtggacacctgtaatcccagctactctccggaggctgaggcaggagaatcgcttgaacccgggaggcggaggttgcagtgagccgagatggcaccactgtactccagcctcggtgacagaacgagactatctcaaaaaaaaaaaaaaaaaactcaagtttggctggctctgaaatccatccagttaacttctttactctcccagcacaggctgaatgtggtgtctcccattttgtaagtccccaggggtgcccagcttacccagctcctaagaagcagcaaatctggaataggaatgatatacccaggtaactaagtgaaggcaaaatgtgaatatactctatgaaaacaagtgaaaaggctctgggaagtaaggcagggagaggtctcacttttactttaagagcacccaggaagtcttttcatcccttgccaaggcttggctggcactgaccaaccctgaatcccctggcatctggaagtgaaggtacccgcatcagtgagccatccttgggttctggcccaaccagggaaacttggacccaccttggacaacttcttagggagcccctgctaggttataagtcctttctcaagacccttcttgaccagaaggtcaagttcaaactttatctcccatacccatctctatctcttccctcccacatgtcaccctactccatcctgtaccagccagactcaactttttgtttcatgtaagttttggttttgttcagattatacaattaatgcaggtttattatagaatacagaaacattcaaagaacagggaaaaaatatatcctcactttcggccgggcgcggtggctcacgcctgtaatcccagcagtttgggaggccgaggcgggcggatcacgaggtcaggagatcgagaccatcctggctaaaacggtgaaaccccgtctctactaaaaactacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaatcctcactttcatataaccccagggatataactactattactttcagggcattttatttctaacacagtctttttttttttttttctgagaaacagtctcgctctgtagcccaggctggagtgcagtggcaagatctcgctcactgctacctccgcctcctgggtcccagttcaagcaattatgcctcagccttccgagcagctgggattacaggcatgcgctaccatgcccaactaatttttgtatttttagtagagacggggtttaccatgttggccaggctgttcttgaactcctgaactcctgacctcacgatccgcccgccttggcctcccaaagtgctgggattacaggcgtgagccaccgcgcccagcctagtctttttttttttcctgaacatagctgagttcattttgttttgtttgttttttgaaacggagtttcgctcttgttgcccagggattagtgcaatgccacgatctcggctcactgcaacctctgcctcccaggttcaagcaattctcctgtctcagcctccctaatagctgggattacaggcatccaccaccacacccggctaatttttgtatttttagttagagacagggtttcatcatattggacaggctggtctcaaactcttgacctcaggtgatcctcaggcctcagcctcccaaagtgctgggattacaggtgtgagccactactcccagcccattttgtttttaattgggattatattatagatcttttaaaagctgctatataacctgatatattgagaacattttacttcaaatagttaaaaacacacaatcacccattatcctaccagctagagagaactgctatagcatttggtttctatgtttctagaccttgttttatgcacatgtgtgcatgtgtgtttgtgtgtgaatacatatgtttttaaagagtgatcagcccaaatgcttgagtaacctaatttttcacttattgctataacagatttttccaagtcagaaacacctgtgtcatctttcatagcagtgctggtataactatttgtgtaacgtgccacagtgaacctctgtcctcctctctgtcttcctgtctctctttttttgtttgttttgttttgagaaggcagggtcttgctctgtccccctggctggagtgctatggcatgatcatggctcattgcagcctcaacttctcaggctcagctgatcctcccagctcagcctcccaagtagctgagactacaggtgcacgccaccacaccagcctaatttttttttttttttcttgagacagagtctcactgtgtcgcccaggctagagtgtagtggtgtgatctcggctcactacaacttccgcctcccaggttcaggtgattctcctgcctcagcttcctgagtagctgggattacaggcatgtgccatcacgcccagctaatttttgtatttttagtgaagatggggtttcactatattggtcaggctggtcttgaactcctgaccttgtgatccgcctgccttggcctcccaaaatgctgggattacaggcgtatgccaccatgcctgacttttttttaagatggagtcttgctgtgtctcccaggctggagtgcagtgacatgatctcggctcactgcaccctcctcctcccaggttcaagacattctcctgcctcagcctcccgagtagctgggattacaaacacccaccaccacgcccagctaatttttgtatttttagtaagacagagtttcaccatgttgcccaggctggtcttaaactcctgggctcaagcaatccacctgccttagcctcccaaagtactgggattacaggcgtgagccactgcactgggtcttctgtcttctcttgatggacatttaggtggtttggaatgtttcatcaaaataaaatagtacagtagtggacaaacaccccacacatgaatcacttaacaatgaaagcctttgtgccatcgtgcctgctggccctctggcttgggtgccgtttctctgcttggcctggtacactgcccatctttggaggctccacacacaccacctacttggcaaagtcttctttgctgtgagcatccagttgctcttttccctcggctcccaagcctctctacatgcctggttttaacactcattacagagaaatcatctgcatagctctgtactctggaccatgagcctgtctgattctctgtaagccaaggctcattgcatggtaggtgcaccatagactgttgagtggcaaggtggttgccaacctctctcctatcttagctgtttgtgattccaaaagcctaaggttctgctctttggtccctggcagctaaagatgtgattaaagagattgaagactttgacagcttggaggctctgcgtctggaaggcaacacagtgggcgtggaagcagccagggtcatcgccaaggccttagagaagaagtcggagttgaaggtgagcagagtggggcgagtaggcccaggctggtttgaacaagcttctgttcacacttccacaacccctgcctgtgtccagtctcttccaggcccctgcctgtgtggctgtaccccaagcagctcctcttcctctggcctccccagggcacacagcattggctagggaccctctccctgtagtcagcagaccttgagagggtgttggggtgcaggaggattattggcatgacacctgtgaaagacaaagtagggagagccttctcataatgcagagctgtcacatgtgaggtgggaaggttgcagaaataaccagcaggagcctctgactgtgaggctgctctgacagacccaccctctgggagtttcagagcaaagattgcccatttaaaggaatctcatgttgggcagaagtggccaggcctcagctcaaatgccgcagcaataggaaggtgctgtagctggagactgccagctccctacactcctcgcagcagaggcaagttctctttttttgttttttgagacggagtctcactctgtcgtccaggctggagttcagtggcgcaatctcagctcactgcaatctccgcctcctgggttcaagcgattctcctgcctcagcctcctgagtagctgggattacaggctcccaccaccactcccggctaatttttttttgtatttttagtagagatggggtttcactgtgttagccaggatggtctcgaattcctgaccttgtgatctgcccgcctcggcctcccaaagtgctgggattacaggcatgagccactgctcccggcctttttttttttttttttttttttttttgagatggagtctcacactgtcacccgggctggtgtgcagtggtgcgatcttggcttgctgcaacctccacctcccaggttcaagtgattcttctgcctcagcctgccaagtagctaggattatgtgcactcaccaccttgcccagctaattttttgtatttttagtagagacggggtttcactatgttggccaggctggtgtcgaactcctgaccttgtgatttgtctgccttggcctcccaatgtgctgggattacaggcgtgagccactgcgtgcggctggcaagttctcctgaaggttagatccaagtggtgccctttttggccaacgcaaagggcaagtcaggttattctagccccgtgttccccaaacaggttctcctaaacaccagtcttctgatacgctctgtgagaaaagcaagagtgtcatgttcaaagcgttgggagatgtcactgggtattcccctctctttgaaattccaaagtcatgagggagagagaccagagttccagaatggcattgtctcttcatatgtgcatggctggggttgggctgggctcttctgcatgtcattgcctgctcacagcaaccagggaagagactgggttgagtctccatttataagtcaagggaactgaggctcagaggggctcattaaatagccacgatcagtcgggcacgatggctcacagctataatcccagcactttggaaggccaaggcccagaagttcgagaccagcttggacaacatggtgaaaccccgtctctacaaaaagtacaaaaattagcccggcatggtggtgtgcacctatggtcccagctccttgggaggctaagatgagaggatcgcttgagcctgggaggcagtggtttcagtgagccaagattgcaccactacactccagcctgagcgacagagcaagaccctgtctcaaaaaaagaaaaaaaaaagccgggcctggtgggtcacgcctgtaatcctagcactttgggaggccaaggcgggcagatcacaaggtcaagagatcaagaccatcctggccaacatggtgaaatcccatctcaaaatacaaaaatttgctgggtgtggtggcgtgtgcctgtagtcccagctactcaggaggctgaggcaggagaatcacttgaaaccaggaggcagaggttgcagtgagccaagatcacgccactgccctccagcctagcaacagagcgagactccatctcaaaaaaaagaaaaaaaaatagcagagatgtggccaagccacacatcacactcctgagatcagtgttctctctgtggtgccagtttctgcaggaggaggaatatgggactgggggccatgagaggattcacgccggaagggcctgcaaactagtttacaaagtggcactacatatttgtttccttaggaaggtcatggtcaagttaaccaccaagacagtgattgtttctgctctcctgcctggggcctgtactttccctgagcataagctgggatgttttccaaccaaagaactcagaactcagccctccccgagacctgtgaagaacaggaatgaaggagccatgggcctgaaggctacaggactcagcaggagctgagcttgctttcggcacatgggatcaagccctaacagcaccaccttgtttgccgtacgtggccttgccctgcgtgcagctctgaggctgggctcttatatgaaataggagatagagcccttccttcttcctcagaggttgtcctgggagagcctggccggtaggagtgctgcatgcaccttcccgcctgctacagatgcagtggctcgagtgaatcactgcacaccacctcctaggccctcctctgtgcaggaagcagcccagggcaggggcagggtgggatctgcccttgatggcccagtgttccgggcgtagtgctgatgccagaggggttctctctgctgctgcagcagtgtgcaagtgaggagtgaggtcttgacgggcgagagaagtgtagcccagagtcacacaactaggagtaggctgaggtggagtccaggtgtcagcccaagctcttttttttttttttttgagacggagtctcgctctgtccccaggctggagtgcagtggcgtgatctcagctcactgcaagctccgcctcccgggttcatgccattctcctgcctcagcctcccaagtggctgggactacgggtgcctgccaccatgccggctaattttttgtatttttagtagagacgggtttcaccatgttagccaggatggtctcaatctcctgaccttgtgatccgcccgcctcggcctcccaaagtgctgggattacaggcgtgagcctctgcacccggcgtttttgttttttttttttgtttttttttagagacagtttcacgccattgcccaggctgtagtgcagtggcatgatcatagcttgctgcagccttgcactcccaggctcaagtgatccttccatctcagccccccaggtagctgggaccatgtgtgtgccacaatgcccagctaattttttttttttttttaatgatggggtcttgctttgttgcccagtctgatcttgatctcctaggctcaagcagtcttcccactttggccttccaaagtgctggaattatcggcgtgagccaatgtgcccaacccaagcaagctcttaactgctttgctgttctcgtgggagatcattaggacctaaaacctcatttcagagataggataccagaggctggagagggggagtgatggctggagtcagctaaatcaggattggaagccaggcggtgtgccctagagtcctatgctgactgttcagctcattagagttaggtttggggagctttgttccgaatgacctgccggtatctgttgtgagggactgtggcgctccggctccggctgcctgttcctggccctgtggacccacgtgcaggtggaactactaagcagatctggtgtagagcagacagctgaggccccaggtgtgttcatggtctgctttattggtggatatgcggatttttctgcaaaaaccagcttccttagtatgtacggtgggagcagatcacgtgatcccaggagtttgagacaagcctggacaacatagggagattcccaactctacaaaagatacaaaaattagctgggtgtgttggtacacacatgtagtcccagctacttgggaggttgaggtgggaggatggcttgagcctgggaggtcgaggctgcagtgagccgtgtttgcatggctacgccccggcctgggcgacagagtgagaccctgtctcaaaataaaaaataagggagggctgggcatggtggctctcatgcctataatcccagcactttgggaggctgaggcaggtggatcacctgaggtcaggagttcaagaccagcctggccaacatggtgaaaccccatctctacttaaaaaatatataaaaattagctgggcgcggtggcgggtgcctgtaatcccatctactctggagactgagacaggagaatcacttgaacttgggaggtggaggttgcagggagcccacatcaggccattgcactctagcctgggcgatgagtgaaactccgtcttaaaaaataaataaatagataaaataggccgggcacggtggctcacgcctgtaatcccagcacttttggaggctgaggtgggtggatcacctgaggtcgagagttcaagaccagcttggccaatatggcgaaaccccatctccactaaaaatacaaaaaattagctgggcgtggtagcgggcacctgtaatcccagctacttgggagactgaggcaggagactcacttgaacctgggaggcggagattgcagtgagccgagattgctccactgcactccagcctgggtgcgacagggtgagactctgtctcaaaaataaataaattaaataagggtaattgaggtatccatcaccttaaatatttatctttatgctaggaacattcaaatttttctcttccagctttttttttttttttttgagagagtctttctgtgtcgcccaggctgctgtgtagtggcgcaatttcagctcagcacaacctctgcctcccggttttcagcgattctcttgctgaaatgagtggcctctagagtggctgggactacaggcgtgcaccaccatgcccggctaatttttatacttttagtagagatggggttttgacatgttggccaggctactctcaaactcctgacctcaggtgatctgcctgtctccgcctcccaaggtgctgggattacaggtgtgagccaccatgcccggcatcttctaggtattttgaaatatataatagattaatgtaaacaatagttaccctgttgacctattgaacactaggtcttatttcttccaactttatacttgtctccattaattaacctttcttcagcctcccctccctctaaccttccaggcctctggtaactaccaatctactatctttatgaattgcctaatactttctttgaatcataccaggagtggtgtcacatgcctgtaatagcaggtactgtggaggctaaggtgggaggatcacttgaggccaggaggtcaaggttacagtgagctatgattctgccactgcactccagcctaggcgacagagtgagaacctatctcttaaaaaaaacgaagaaaacagcaaactttcatgtaatttcaaagcacttctatgaatggaaagctgacattccttacaataaaggaaataaaatagtgttactgaattattatttgatgctgttgctgtttaatggctctgagcctgaggcttgctctccctttgttaaaaagtccccgtcactatgctaatttttgtattttttgtagagaaggggttttaccatgttggccagactggtctggaactcctgacctcaagtgatctgcccgcctcggcctcccaaagtgctgggattacaggcgtgagccactggccctcaacgtagaattctgtgttgtttatgttcatgtttctctgtcatccataaccacgtcacacgtccacctagagggttgtacaagtcagggattttcctgacacttgtgagcccccaataactcttggaggcctcttgatttgaggactggcctccaggtcccaccaactacagccagaatgggtccagctttttacaaacaaagctcaagttaagtcttgggggccaggtgcggtggctcatgcctgtaatcccagcactttgggagaccaaggtgggcagatcacctgaggtcgggagttcaagtccagcctgaccaaaatggagaaaccctgtctctactaaaaatacaaaatttgccaggcatagtggtggacgtctgtaatcccagctactccggaggcttaggcaggagaattgcttgaacccgggaggtggagattgtgatcagctgagatcgcgccactgcactccagcctgggcaacaagagcgaaactccgtctcaaaaaaaagaaaaaagtcttgtgatgctctggtagttcaaatccaccaggatgaggcttcactatgggcctccaggggtctctctcccgctaactcttctcttctttccgttgcagcgctgccactggagtgacatgttcacgggaaggctgcggaccgagatcccaccagccctggtaagcgaactagccgctcttcccctccacgcgcaaggccctctttggcaattcccagggcttttctcatgctttattctttctggagcctaagattagccctgtgggtgactgagctgctggaatggaagcccggcaagtccagcacgtgccctgtgtcctgacaggaggggagggtgggagcacagagactgacaggggaggaaccctaagggtggggacttcagggaggtgggagagctgagaccatgcactcctgggtcctcctgagctgcttggcttggttgactgtggatttcaccccaatatgattgccccgcctttcctggcaaccccttcctgcacctcgcagtcctgctccttcatgacttctctgcacacagcccatgtagccgtccccatctttctctggctcctccctttctccgtaccactgtctgctttggtttgtgcccgtcatgggtggcttcccatttcttcattcccagggctcagactggcttgggtcgagttcccagtctctgagtgcatatgtgtggaaggaaatagaaagaggcaacacagaacacagaaaggcatgcctggccaagggaagagggcagggctggtggtcggcagcctctcagtgtgtcctcctggcacggggctgcacacggcaggccctgagggtgcaggtttctggtcagtgatgagtgtgcacattgatgttactgagcccctcaccctggttgcgcccaacctccttttatttttttttaaagacagggtcttgctctgttgcccaggctggtcttgaactcctgggctcaaacagtcctcccgcatcagcctcccaagtagctgggattacaggtgcgtgccactgcacctggcttgtgaggctaggatttggaatgtaggttaagaaaattcatttctggccaggcgtggtggctcacgcctataatcccagcactttgggaggccgaggcgggcagatcgcttgaggtcaggagttcaagtccagcctggccaacatggcaaaaccccgtcttactaaaaatacaaaaattagctggcatggtggcacctgcctgtagtcccagctacttgggaggctgaggcaggagaattgcgtgaacccaggaggtggaggttgcagtgagccaagatcatgccactgcactccaacctgggtgacaaagcaagactccgtctcaaaaaaaaaaggaaattcatttcagtgattgcatgttaaagaatttcaagttaggccaggcgcagtggctcacgcctgtaatcccagcattttgggaggccaaggtggggggcggtgcacgtggatcacctgaggtcaggagttggagaccagcctggccaacatgctgaaaccctgtgtctacaaaagtacaaaaattagctgggcgtgatggcaggggccttgtaatcccagctactcaggatgctgaggcggaagaatcacttgaacctgggaggtgaaggttgcagtgagctgagattgtgccattgcattgcaaccttgggtgagagaaagcgagactccatctcaaaaaaaaagaatttcaagtcagaaaagatggtgaagagaactctcttttgcatactcactgtggaattctcactgtgcaagttttgcctaaattttagcatttcatttccctgagctttcagaaggtattcttttggtttttgttttcttttacttgactctgtaggaatggggaagagaaagtattcttatctctatgttcccaatcgtgagaataaatcttaagagggggataagagaatttggggttagaagatggcatgtggtggagtaggcacagggtgtttgagcagctagaggtcagttgaggccagatcgccaggggctaggctttttttttttttttgaggcggagtctcactctgtttcccaggctggagtgcagtggcacgatctcggctcactgcaagctccgcctcccgggttcatgccattctcctgcctcagcctcccaagtagctgggactacaggcgcccgccaccatgcccggctaattttttgtatttttagtagagatggggtttcactgtgttagccaggatggtctcgatctcccgacctcgtgatccgcccaccttggcctcccaaagtgctgggattacaggcgtgagccaccgcacccagccaccaggggctaggctttctgtgggtagggcaacgagaggacacattgccttttgcttactgagtggtgggaggatggtagaaactgcctcatctgccatatctgtggccagggtgagggcagaaagtctcccttccacattcctgcccccatggaccacctgctcagccccatttctgacccagtctctggcagagcctcctctctgaccatttctcctggtggggtgagggaatgtagctctccccagcccaggaggtttccaggagagcttcaaatcaccctgtcaaagctgatcctggccgtggcttagagatggccacctccatctgccagtcaccaccagaaaccctggaggcatttgtggttcctccctccctcctcctgcacgaacagggaaccaacagcttctgcatgtcccctgctccatgaacaggcagctcctctcccacacttgtcacaccggctggcaggtcccctctgttgccagtgtcgctgcctcacactcctgggtgggcactccagcccccctttctgtgcatctgctcacctcaggtctggggatattaattccatatccctcagccacctcaaagcccactgctctcaggctgaggctcacagtccttggcctggcattcaaggctcttgcctgatctgacccctcacttcccttccacccaaagcccatgccacggcttcttctggagcctacccacagctttcctccaggctcacagcctgctgcttcatgcttatgtctctctgctcctgttttttcagctgcctggagtcttttcatgttgactagctgattctcatccagactaagtccaaatgccacctcttacaaggagccttcccgggccactccaggcatacgcatcccccactctccagctgttaggagccctttgcagggtttccagtcttaagaatactgaaatggtttgtgtctgtgttggttctgcaccagccggggtgtccttggaaggcagagctgggcctggcacagaagcagcacccagcacagaagctgggtgtctatgaaactgacacgagcttcctctgtgcccagatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtgggtgtggcagccccctccccgcagagtcccctggtccatccacatccgtctgacatatgtgccctggcccttggccaccaccatctgggatggtcagccgttgttttcaaaagagaaaggcctcaaaggcaacagcctgtggccggagggtagaggcgtccatgagggtggggttgccaagcaaccatccccagttcttgggttggcttggcaacgcagagggagtgccactgcatacctgctccagcctgctggctctgcaaaactcagggcttggggcatccctatactcactgtacccgcagagcagctggtagagcctggcacataggcagagggagtctgaaaagaggagcatatgctcagggggggcaccgtcacagctcacctttattcctagacagggccttgcccagggaggtgtcctcaggcaaggtcagtgtagagcttcacgttgggctggtcagtgtagagtggagcttctttgcttcccagaacctgcatcaagggcggcctgccgtattattctcttccaactccatcccagtgcctttagacccagggttggaggacactgagtgccaggctgcaacccctacacacactttctaaccaaagggagaaaagggctggggacacagaagtaacagcagttggggatatcttatttgaatatgcaataccttaacttttcccacccacactgaaaggtggctgatgccatcccagtttttccacatgactcagcataggcttagagagatggggtggagtggatcacatagctagtgctgtgaggcccatggagccccaggctgaggagctggagtggcctcccctgcagagggtgcctgtgtccctcggcctgacgtgagggtgagcaggggcaggctctgtgcctgccttagccagccctcccccaagtccacttgggcaataagctatccctgtgttaagatgtaaaaatgggccgggcacggtggtgcagtggctcatgcctgtaatcccagcactttgggaggccgagtcgggcagatcacctgaggtcaggcgttcgagaccagcctggccaacatggtgaaaccccatctctactaaaaatacaaaaattagctgggtgtggtggcaggtgcctgtagtcccagctattcgggaggctgaggcaggagaattgctcgaacccgggaggtggaggttgcagtgagccgagatggcgccactgcactccagcctgggcaacaagagcaaaactccgtctcaaaaaaacaaacaaacaaacaaacaaacagaaacatataaaaacgtttgcgtcagcacagaaagcaggcgtggcccaacctagagtgagtggcatacgctgggagagccagagactctattctagcaaaatgcttcggttttccttccattacttcccttctcctgcccagcagtgcctggaaactgaggctcagggagctttcctactggccaggagttgtctggcctgtcctatacttgtaatggggtgagttggggaatgagttttggacccaggaccagagggcctcctgggcagacaggcctaccctggagtttgattgatggttctctgtgcctccctgaccactgatttgattaggtctctgggtctcggccttgctgacctatgcctcttgggagctcagacgccatggtctgggtgtctaaccaaggcctgcaggtcctttggaatctttttcttctgggcagtgtgtttagtgtggtttctgtgccatgcaccatgagaatagaagggcccagaggagttggtggggcaagaggcatggccctgtgcttgagaactctccatacccaagttggactcctgcaggagctaaggccatcaccacgtggcctccagggaatctgggagaatgggggtgacctagcagtcggctgctgctgctgagtagcttcctcagaggctggtctttggcagaagtttgatgtctctaccctgagtgtgtgcgtgatcgtgtgtgcgtgatccaccatcaccaccgtggagtcaggcaggtgctggctcttctgttcctcaaggatggctgtgtgcagtctcatgccaggagttaggccaacccacccgccatgtgcggctttgctaaatacttaccgggtgaccttggccaattcactcatctctcagagcctcagcttcctcatctgtaaagtacggccaatcctgcctgcctcccaggctggtgttgaggttgaaacaagaaaatatgccaaggatgcccaggccctagcaggtgctctgcaaacatcaggtgttctgcaaatatcacttctctcggtgcactcgctcgtgattcttttatgtcgcatttaccatgggctctgattcccatcggtcagtctccgtttttcagtgcttttcctaatggtgtaaccagggtagaagctacttcctggcaccacaccagggacagggcaagctgggtgttaggtttttaccaccagcaggcaagctcctgctgtgcctggccagcttttaggcacaggcaggtgtcagacaggttcgtctggaccgtggacttggcagctggctcccttggacattgtggaacgtggaagagaagctggaagatttgggctttggtccagagtccaccacttgtttattgaccataagaaagtttccgttcctcttaccctgagtttcttcagctggaaaatgggagccatgattttcccacctagcagagggccttagacagtgaagtgagctgactaggaagtccttcccctggacctggctaaaagttcatccactccatgtggtctctccctttcctgagtagggcttggtctccccgtctcgaaagtgaagctaaacctctcaggctggtgtgacacagcattagagataaaaaccttgtgtaactgaagtgctggacatatttaaggtgtgactgttgagctgttagcagtcctgcgtcccctgacctgcaccgatgggtggcgtgggatgttgaagagcagttcagcagcagtggccaccccgctgggagaaggggctcctgcccatgaccagggccccttgcctttccccacagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtgagtggtttctgtccatcctgcccctgcagccttgaggtgcactcggcatagtaggctgacagttctggatgctaatcccagggctggcactcaaccaagagacctggggcgtcacgtgccctctccaagcctgttaacccatccgaaaatgagccagaattcctgtcgtgcatttctggaaaggtgtgtgactttccggaaaggtgtgtgactggctcccactggtgagccagcccctatggggcttcaggccaggcaggccactctgaccaaggagtgtcatctgccaggctcagaagtggtgaagtgagatggtgcgagtgctgacagtagcctggcccagccactggtgtggggcacagagaaggaacataccagacctccaagacagggagataggcaggggcagccgcagggctcaggtgccaaatgacgtgctctcaggtgaccttatccccactcctcttccactctcctctccccatccccgcaggacattgctgagtccccgatcgtgagtgccagcagaaggctacacttgcccctaacaggactgaaaactttggggtctgtctccctcctctctttcctgttttttttgaggcagagtctcattctgtcacccatgctggagtgcagtgcgtgatcttggctcactgcagtctccgcctcccaggttcaagcagttctgcctcagcctcccgagtagctggaattacgggcacccgccaccacacccggctaatttttgtatttttattagagacggggttttaccatgttggccaggtggtctcgaactcctgacctcaagtgatctgcccgcctgggcctcccaaagtgctgggattacaggcgtgagccaccacgtccggcccctcttctcttaatttaaatgttttcttcagcaaacagtatcctaggagcattgctcatacgggccggaatgtcctggctgcccatcgaggctgtctgtagataccctttgcctgcttcagtgccaagtgaacatcgcagagatctgccttgtgtctccctgcacccctggctgcaggggagctcctgctgcctcctctggagctggtgggggcctcactgccatccttggatccctccctgccgtcagcctgctgtcctcagtgcactgggaggagggggtgcgctgtggttgtgttgagccttcataggtgtcctctggtgggcttagaatgggggttcttaatcccccccagtatgtggatagaattcaggggtctgtgaacatggatgaggaaaaaataacattattatttattactaatgtagctaaaatatgtagtgtgacctttgattataaatgtagacaataaacctcacagcattagaaaggcctgtgactacccacataacaaacaagcacatgtagtccctgaacccaaaaaaaaaaaaaattttattgaggcagggtctcgctctgttgcccaggctggagtacaacggtgcaatctcagcccactgcagttgaagcttcccaggctcaagtgatcctcccacctcagcctcccgattagctgggactacaggtgtgcaccaccatgcccacccagttaatttttgtattttagtagagatggggtttcaccatgttagccaggctggtctcaaactcctgacctcaggtaatccactcgccttggcctcctaaagtgctgggattataggcataagccactgcgcccagcttaaaatttttaaaaaaataaaaagaaaatcttgtgactttatccccagtggaaatcacaggtatttcatatgaagttatagttactgctgatatatagaaatatttctcactacatcaaaattacagtaatagtggacccacccctagatcttgttatttggtgcattaacaagaagtttgtatatcactacagcatgcgtttggagttttttcctaaatgttttgataactgttccaactgagttgatttcctttgtaattctgtgtaatttatcttaaaattttaaaaaaacattttttgaggaggggacccaggggcttcaccagactgcctgaagggttcatggcacagaaaatactaagaaggcctgacctggagtgtgcccaggttggccttcctgtatttatttgtggaccacccgctccccccattgccctgtgctgcactgagcacctgaagacagcagaagattccttggcacagttaagccaggccaaccctcagtcctgggtcacagtggagactgggacatggccctctcctccaaagctcaggggccgatgggatgcagacggaatataggctttgaatgtaggcaggatgaggaccaccgtgatagaggagggaccaggtgctccgggagcacagaggaacgcacactggatcgtggctgggggaatccaggaagccttcctgggagaggaggtgaccaaaacaagagccctagaactcatatgagttagcctgtcaagaaaatgctgaatggctgggtgtggtatctcacgtctgtaatcccagcactttgagaggccgaggaagctggatcgcctgaggtcaggagttcaagaccagcctggccaacatggtgaaacctccatctctactaaaaatacaaaattagtcgggtgtggtggcgcacgcctgtaatctcagctactcaggaggctgaggcaggagaatcacttgaacctgggaggcagaggttgcgatgagccaagatcatgccatcacactccagcctgggcgacggaacgagactccgtctcaaaaaaggaaaaaaaaagaaaaaagaaaaagaaaataaggaggcagagagaatgggtatcaaaaggccaggctgtgatagggctgcatgggccagggaacaccctcctcatccctagagaaggacgccatgtcgaaggggttatgttgtgtaggtgggtgggctaggagggcccctaagaaagaaaggtcacatggagctatgtcatccagagaaggggcatgagtgcctgcccaccacagccagggtccccactgtgctgaggacaccagactgagaacaagaaatcgacctgctggatctagagctctgtgaccctgggcaagtcacttcgcctctttgatccctagtcttttctctggtggggatcctatcccaggcagtaggcctccctcaggaggttgtggaaagagttagatgcagccatgccccaaaatcccacagacaggcccctgccctgtgctggcggcagcccattcctgtgcctgctgtgtggaattgctctcctgcctgctggatgtcacctggcactcggggccccctccactctctgcctcctcttcacaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgaggtgaggcgagtgtggcagagccagttgggccccgccagatagaggctggctgctgtctttccagggaagctggggctccgtttagcagggactcctctaccccctgcctgccccctgggtgtgtgccccatggctccagctctttgaacatgtcctgaacagggttgcaggtcccaaggtaacccacgccctcctcgggcagctctgattcttcatgccaccttctcctgagccgcctctgcagcccccagcggctgccgctggtttgttctcaggctgcacaggagcagactgctccccacatctgttttcctggttgatttgttcagcagctgttgtttgttttgttatttattatcactttttgagacggaatcttactgttgcccaagctggtcttgaacttctgggatcaagtgatcctcccacctcagccttctgagtagctgggattacaggtgcaggccactgtgcctggcccagcagctgttttttgagtccccatttagtgcttggctttgtaccaagtgcaggccacatggggttgagccaaagaccccgccttcagggagaccctagctcaaggagggaaggaagctgccagtggtaacagtgctgggctctgaacgcagtggcttcttggctgccagggtcccgtggccccacagaaggctagtccggctgcctgtgtgttagcagagatgtgtgcaggtgttggggaacacgccagaaggaagttcaaatcagacttagggcaggcttcctggaagagatcacattttggctaagttgtatagggcaagtggtctttctctggacagagggtgggggatgggtgtttcaggcagagggatcagcttacgtgtggaagacccggatgctcagcaggaaccttgcttggttggtctcaggaagagttctggccgtaacatggggaggggtggaggaggtttggccaggggcccagaggccaacaagtagaagacggcaaagctggtgacttgcagaggaggacagtgtgtggtggctggcttgggatgtgaccgtgtggggcccccggggcttgctgagggctggggtgtggtctgcaccctcactctggacccttgcttccccctcacagaccttgaagaccttgcggcaggtggaggtgattaattttggggactgcctggtgcgctccaagggtgcagttgccattgcagatgccatccgcggcggcctgcccaagctaaaggtgccagcctggacgcctgacgtcctccctctggggtctgtgggtggtggggcggctgggggcacaggggtctggtctgaaggcaggtgggcctgtgtccatatcccagctcctccacttcgggccctgtgatgctgtgtgagcctccacacccctctgagccatggtttcttcatttctaaagcgggaggcagggagtggtgtacatcactgtcttgtgatttaagtaaacacagtacgtgactcatcgttggctgcagggcattatttttgttgttggtgttattcttcctgcccactttgccccacctggaggacagagcctgccatatcctcacttggggaaactgaggcttagagtagaacctggtgtcctggcccgggtttctgcctgcctccaacccttcctcttattttcaggagctgaacttgtcattctgtgaaatcaagagggatgctgccctggctgttgctgaggccatggcagacaaagctgagctggagaagctggacctgaatggtagtcggatgggggaggcctctgcacaggtctgctaggctggccctggcaccccggctgactgctcttccctccccttgagcaggcaacaccctgggagaagaaggctgtgaacagcttcaggaggtgctggagggcttcaacatggccaaggtgctggcgtccctcaggtagggaactcggggtggccccagaggtcggggtcaggccattcctttctttctttcttttgttcttgagatggagtcttgctctgttccccaggctaaagtacagtggcgtgatctcggctcactgcagcttccacctcctgggttcaagtgattcccctgcctcagcctcccaagtagctgggattacaggcacccaccaccacacctggcccctttatttgtttctacttgtatttattcagaaacgttgggtgcactcctgttacgtactaggtcatacactaggcatcagggctataaggatgggacagtcagggcttctgtctcgtggggtggagacagaatgagttgtccgttcaacagaggagctcgtacgggctgagcggggccaccctgtagagtggtggagttggggaggcctctgaaggggtgaggccagatctcatcctgatgtggtggggcctggggagtgatgggggtgggaggtgggggcagccagaaggggctgcactcgggattgttcttaagacgctgactctagaaaggaagagaccatggggcctggggagtctacctggaggtgaaggtgggtggccggggagtggccatctcctggatccaagtccggttgggccatcagcatcgggctccctgtgcccctcgcatctccaagtcggcctcattcgtgtgtcagatactcagtcgtgtctcctcggtgctaggccctgagctgaggctaggaactggggactccgaggtgggctgaacctcacaggtcccactgtccctgggaaatggtccagccttcctatggggcaaggacacccctactcttcttcctcccccacacctgtagcttcctgaggtcatgtggatgtgggcgcccctgccctggcatctcaacctgggcagtgttcctgccaagccctgggctctaggtgtgacaaagctgtcttcgttttctgtctctccatgaaacctggggctccttgaggacagggacaagatctgatttttttttgttttttttttttgtttttttgtgggggatggagtctcgctctgttgcccaggctagagtgcagtggcacaatttcggctcactgccagctccgcctccagggttcacgccattctcctgcctcagcctcctgagtagctgggaccacaggcgcccgccaccacacccggctaattttttgtatttttagtagagacggggtttcaccacgttagccaggatggtctcgatctcctgacctcatgatccacccacctcggcctcccaaagtgctgggattacaggcatgagccaccgcgccgggccgatcttatttttttgtgtccacagcatggatttccctggtgatccacctgcccctgccctgggagcaggtgctcccaccccaccaggctctctccctcctggctgaggtgaggtctctgggctcatggagccaggccttagagccaacctgggctgctgggtagagaggatctgcttcagccagctctttctgcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggtgagtttctatcatctgccacaatcagagccctggtcctgagaacgtgaaatcccgaggcactttcacaatggggtagggggtgtctccttaagcacagtagccacaaacatttttttttgattgcatgatattgagtaaaaaaaggaaaatggtcccagtgtaatgatagttacctatatttcttttttttttttttgagatggagtctcactcttgtcacccaggctggagtgcagtggtgtgatctcggctcactgcaacctctgcctcccgggttcaagtgattcttatgcctcagcctcccaaacagctgggattacagatgcttgccaccacgcctggctaatttttgtatctttagtagagccggggtttcgccatattggccaggctggtcttgaacttctgacctcaggtgatccaccctcctcgacctcccaaagtgctgggattacaggcattgagccaccgggcccagccatagttacctatatttctatttaccccaatataaatgtctatttacaggtagcagtgctgctgcattatgtatattataagatatgcataagggtttctgaaagaataaacaaataagcataaatagaaattctgattttttttttccccacccaccagaggattgtcttggtgacccttaggaaccactcccccattcctgggatggtggctgggccatgacctggcttgggcacttggtgtcccttgtctggcccggggctgcatcagggctgccacacctccagttcattcatttgcattccctgtcaggttcctaagtaaagctcctggagaacttggctctggacaaggactccccatgcttacgctgaattgggctgcttctctggtttatggaatcaattaaacaaatggctaggttcgcctcaattcagtttttcctctgggcacctctggtgctagcagggcttacccaggctggactgtagttctacggggacccactttagcccccatgtgcctccgtagtcatttctggggcactgcatgtcatgacgaggatccacttggccgtagcaggttttttgagtcccagggaggtagcttccccctcaccccaaaggctcctggaccaagagccatccagggccagcatctctgggtgatattgatagatgggaaatgcagctgagtgggaggaagaattctagactttgagcctagatgggctggagtgaagggtggatgtgctgggtgtggggatgggcacagctgtgtcggggagtctggggtccggaattctccagagcctctgtgcccctacttcccaggagccagctcccgtgctgtcctccccacctcctgcagacgtctccaccttcctggcttttccctctccagagaagctgctgcgcctagggcccaagagctccgtgctgatagcccagcaggtaataaccacccctcgacccccacgctgtacgtgctgtggcttctggagctgttagagaaaagggacgaacagctcagagacctgggggtgcgacgctgtcagctgggggcagggaggcttggcctgccactgttacaacacgcgcaaatgtccagggtatttataagcctccaggggttgcaaatgttccctccccactcagcctacagaaagtacagcccgccagttcccatgctgactggggttagggaatttccttaagagccttgcatgtgcccaccccctccttggcttctctctgcgtgttccgtcagcccagctgcttcgagaacaactctgttgcccagggctcctttggaagtgacgtgcctattgcaggatgggtgccctcactccagcctcacttgttggttggctcattcattcattcatagatgatcttcggggcatccattttctgccaggcactgcatttgggcatgattttatttaaccctcttggcaacatgaaatgtagactctgctgcccttactttattttattatttatttatttatttatttttttgagatggagtctcactctgtcgcccaggctggagtgcagtggcacgatctcggctcactgcagactctgcctcctgggttcaagcaattctcctgcctcagcctcccgcgcccagctaatttttgtattttttagtagagacgaggtttcaccacgttggccaggctggtctcaaactcctgacctcatgatccacccacctcggcctcccaaagtgctagggttacaggcatgagccaccgtgcccggccagcccttattttgtagataagaaagcggaggctcggaggttacagagaaataaaatgggcccactctcagagttggcttaacatttcggccaattgctttgttaggttttgcctgtattctttgtttcttttaacatgataaatcagatgttgtaagcctttctgtggcctatcactttggtgtagcaccattcatcactttcttgtgcccataaaactcttctcaggatttttattgcaatgtgtggatgtagcacttaaaagccaggcactgtttctgacgttttttccacttttccctgttgtgaggttgaggtaaacgtttctgcatgtgagtattgtctacatgctagattatttcttcaagttcaattacaagatggggaccactggatccctgaaatgatttttttttttttttttctgagacaatgttttgctttgtgactccggctggagtgcagtggtgcaatcatggctcagtgcaacctcgacctcctgggctcaagcagtcctcctgcctcagcctcccaagtagctgagactataggcacacaccaccaaccttggctaatttttttcctttttgttgacatggggtcttgctatgttgcctaggctggtctcagacttttcgcctcaagccatcctcccacctcagcctcccaaagtgctggggttacaggcatgagccgccacacccggctgggatgatttttcatccttgttcattcactcattcattccctctctatgctgcatatgtgcttgctgcaggccaaatccaagccagactctgaagggacagcatggggtaaggcaggacctgttcttgcccgccaggggcctttgtactgcccaggcctctcctagctagcgtcagagcccaggtacctctccaccacgtgccacaggccaaccattgtctcttttgtcctcagactgacacgtctgaccccgagaaggtggtctctgccttcctaaaggtgtcatctgtgttcaaggacgaagctactgtgaggatggcagtgcaggatgcagtaggtaatgtgggctgggtgagacctgggtgccctctgtcccttgatgctcgtgggccccaggtatccttcgtggttgccgtaactcgtcagccccagcgctctcatgggaactgctctttggccacctgagtttttcctccgtcagggtcctgccgtggagccagctggctgctcttctccctgtttttcaccactgagaaactgaggcctttcccaaatccacacagccatgtacagttagaacccatagcccgctctaggaagtccagatagtcacatctgcaagcccaatggacgcaggtctatcgggaggagggatggtgagagccaagcccttgtccacaccttggagcttctgtgctcacgtccactctacctggaggttccttgcacagaggacacctttccccataacattatgggggcttccttggagcaccagcccatatccctccagccctatcacaaccctctccccaccctgtctgtttcctccattccagcacctgtcaccttccaccctgtttccatgtgcttgactgagcctccacatctaacgaaacctgagccagttccggttaggcagaggggaggaagggccctgaggcgagggggacggttcctggaaaagatagaaaggggtggaaggacatgtggtgcctcttcccggcgtggcgtcgaagcggggagggcggctcagtgggaaatgaggctcggaaggaggtgggggccagacacaagcctgctccctgagggcccgcctgtgggcatttttgggaacaagttgccctagttctgtttcccaggaagcctagcacagtccctgcacatcccctcaccctgccaaaataacctgaatcctccccagtggtagcctgcctcaggaaatctccattcccacggtgtgaggtgggcacagtgggtgtcatccccatgcccattttatacctgaggccaggatgggcaagggccagagtgtcacagctggcagatggactgagcccatcccctgatgccaactgccactccctctggttcctgtgtctctgccgtccctctcgtgttcgcctcttcgtcagggcgaggaggcaggcgagcctgtgtctgcgcggtgttgggggaaccctgggtgccttggcccagccctctgccatagccagcagcctgcccctgctgcttctgccctacagatgccctgatgcagaaggctttcaactcctcgtccttcaactccaacaccttcctcaccaggctgctcgtgcacatgggtctgctcaaggtgaggccggaaggaacagcaggcccgggagggaggtgggtggggtctgcacagaagctgccccagccatgcccgccaacctccctcacctcgagtcctgagccggctcgcccacggggccccgaggcctgggtctgccccagcagccttggtcttcacgatgagattccggctagactcagttgtgggcactatcagcagagtctggatggtggagtccaggggcccccccaggtgactttgaagctcaccccgcttttcgctgtgttcctctcagagtgaagacaaggtcaaggccattgccaacctgtacggccccctgatggcgctgaaccacatggtgcagcaggactatttccccaaggcccttgcacccctgctgctggcgttcgtgaccaagtgagtgtggccttgtccttctgccggtgcctgccctctcgggcttctctggccaggtctgaaggcgcccggttccgggaggcccagccccagcccagccagcctgctggccccactcaggtgcatgagaggccctcatgcctcctgggctctcagcatctgcattggagtctcaccacccttgggaggcccactcccctctgcccagctgaggacagtggggctcagggacagtgagagaggagacatgcggcgcccccattgtgcagatgaggagcactgggttggttaaggagtttcccttggtcacacgctagcaagaggctgggccagtgtccagacccatgtctgctgagcgaggtgctgcggttggtgacatctccggagtggctttttgtccacattcacagcagcgcaggccaaaggggcctggtcacaccaggctctgcagccccgggccctctcctggggacacacattgccacgggagctgccaaatgcccagcaatgtgtgaaccttggccttgttctggagggtcctggggtgtcccggggcattgatggggtgatgggcacagtcaagtaagagaggcaaggccccaccagggaggggtcgggaggcttgccctctgaaggccctgtgtggcccctggccaacctgtggccttcatcaggcctcagtctccccatttgtccaaccggggggttaggtgagattgtctccaagcgccctgaccagccacacttccagtcagtcggcgccatccggggacatggggcaggcagaggagcaaggaagtccctttgctgggggagcccagagcccaccagctgaggcaggatacttggtgcatgtggggaggcggggctggcggagcgtgagcggcccccgctggcctccagcacccagctggtgccgcggcagccctgtccactccagtgtctgcatggcgccgcctccttagccaggccttaccttctggccgcatttcccccacaccagaccaccccttgggctgcagctggactggccttggtgaatggcagatctcactgttcccctcctctgccaggtgctaggtagagcctcactgtgaatctcatggctggccacagcctcaccccgaccccaccccaccccaccccagcacagtgtgctctccctgagcccctttccatagcagtgctgttgctgcagtgccgagctttgcccatgctgtccagagcttgtttggccagtggccccagcccccgtctgcgcctgagccctttgtgtccttcctgccccctggtcagagtagttccctctgtatccctggcagcccctgtgctatcctaagcctgggcatgtgcctcttgcccttgttggtcagagcaaaatgccttttcccagcttgttgcccaacctccagcacaggcctcagtctgccccctgggtcttgtccaaggtgactgattaactatgtagtgacatgcacggaccctcttccctcagctcccagccaaatggtctgggatgcccggcctggcgcagatcctggcctgttcactggcttcaggccagaggtgttgtcaggcctggtcctggctgcgtcccgcacttgcccagtcccccagagtcttgcctcagtttcttcctttgcagtgaaactaatgatattgagggcaacaacagccagctcaggcgcagtggctcccatctgtaatcccagcactttgggaagctgaggcaactggatcacttgagcccgggagttcaaggccagcctgggcaacattcgtgaaaccccatctctacaaaaaatacaaagttagccgggtgtggtggtgtgtacctgtggtcccagctacttgggaggatgaggtaggaggaccacctgagcctgggaagtcgaggatgcagggagccatgattccaggactgtactccagcctgggcaacaaagagaggccctgtctcaagaaaaaaacaaccagcctggcgcggtggctcacgcctataatcccagcactttgggaggccgaggtgggaggatcacgaggtcaggagatcaagaccatcctggctaacatggtgaaaccctgtctctactaaaaatacaaaaaattagctgggcatggtggtgggcgtctgtagtcccagctactcgggaggctgaggcaggagaatggcgtgaactcgggaggcggagcttgcagtgagccgagatcgcaccactgcactccagcctgggtgacagagcgagactccgtctcaaaaaaaaaagaaaaagaaaaagaaaaaaagcaaccaaaaaaacaatggctagccatttacttatgatccagattggactctagtgggccagtcctatgtggccactggcagccagtaaggattccctggcctatgtctgctggaagggcccttggagagcctggctgagggggccttcattctggccagctctgggctgtgtggcgttgggtgcctggctctctgagcctctcgcacctcccatccccacccacggtgtgcagaaggcagagggctaatgtctctcttgctgagtcgttgtgcaaattaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttc

SEQ ID NO: 37629 - DNA, 57348 bp, Homo sapiens; identical to SEQ ID NO: 37628

SEQ ID NO: 37630 - DNA, 2751 bp, Homo sapiens; identical to SEQ ID NO: 36048

SEQ ID NO: 37631 - DNA, 51529 bp, Homo sapiens
tgctatccaccccagctggaatttagaccagacttacaggctttctgctccttccttcagtgaagaagagtctccagggtccctctagtgcaggtcaaagaagtccagtccagctgagttcagctccctagggcctccccagccagtctcctggaccaagagctggctttgcaaggtaaggatccactgtcagcgttggatttcggagtggaggttgagatggagaatgacttcaacctagctcaatttgggggctgcttttaggtgtttagtgcctccttctcttccttattaactcccactcctactacaggttggtgtgctcaattgtatgtctatagcctgcctccatctcccaatctgtaatccagcaagtctgtcggggtggaggggtgtggagctccatgggggcaagatgataattccattcggttttcctgtgctttggagtttgcatgacactttaacgagtcttcttgtgcctatccttaagaaagtctgtgaagcctgatgtgcgtggctatcaatgtcatttacagctcttcatggtggggcttggaatagggcgaggggaggaggtgacagggagaagacctgggtaccctcagtagatgttctggagatgttgagagcatgttgtaggggcttcgatttgggaggttcagtgggagcccgtggaggtttcaggcatctaaggcaaaaagaaagaggggagagtttgggggagggagaacggattgtcaaaaacaccctctcaaaagcgtgttaaagcctgggagtggagggtggtctaggagagtcgggagggcagggtgggaggagagggggatgtgtggtggtggtggtggtggtggtggtggtggtggtggtggtggtggtggtggtggtgatggtggagagcccagctgcaaagatgaacaaagcgggcgctgtgcaggctgggggaggtgctgctgtgggaaagggtgggtggggggaccttgggctccagccccacaagggcgtcttctttggctggccaggcggacgggacgggggacgggggcggggactggcgggaggggggcgggacaggctcgctctcctcctacttagcgagctcccggggaaaagcaacggtgtcctcctaagcctgaggccaccgcgaccgagccgagccaggctaagggaccagtgtctccctgccccccccccacctctaggtaagagcgccccgtcccactacacttgcgggtcccattcgctgcggtgctaggactggataaggggaagtccccggggcctggcgagagccctgagatcagctctaggctagggagctcggcagaaacccgtgggggagagagggcaccccaggtgagtgcgtgggggcgaaaggagcgttatggggagttttcctgtgagcctcttgcttttgccttcctcggccgctgccaacgccaccgccagagggggccgtgacgctctcccccccttggagaaactctgatcctggccctatccagactctcccgccggcacccaggcggccgggcggacactcgcggggtatcgggcggcgagcgcgcgcgcgggttttcgtcctccagcgccccacacctccccctctccgcccacagcaggaccttggggcgggggtatctcctgtgacgtctccccgcctgtccccaggccggccgccttgatggaccaggaagggattcggagtccggctcagagtcttgagcgtctaggagggctgcctgggggtgtccaggagatgggaagcccgcctggggcctcccaggcactccccaaggccccacgtcctcgggggccggggaggccgcctggggcgccttgccacgcccgcgcggtccctattggaatccctagcggagttccccgagcggaggctgacccaagtcatccgggctcccccgggatagggaagtgcgggcgggcggctgggtaggggcgccggcgcagggtggccgagtcgcccgctagcgcttccgccgaggcaggctcgagtggggacttggccgggcgaccgcacagccctgccggggacccacggctctggggcggggctgcattctgggccgttagctcagcggtcctggagcctcccgaggctgactcatcgggcggcgggctcaccccccagccgtcaaacgcaaacgcaggcgccccaccacgccgggctcccacgcggcacacacgcacgcctccgcgacacttcgcacacctacgtccctgcgtcacgccacccagacacacccggacccgcccacacgccgaggccttcccacgcactccatgccttacgcctcacaggaaagcgccccgcgctcacgcagcccctcacacccgcagccccgcttacacgcgccccagctcacacatgcaccccagtcacacagcctacctcacacacgcaccccagtcacacacacaacccagctcacacacgtacccgtcacacatgaggccccagctcacacacgaagcccagctcacacacgcagtcccagctctcacacacacaccccagtcaaacacgaggccccagctcacacacgaagcccagctcacacacactgccccagttacacagcccagctcatgcaagcagcccgtcacacacacagcccagctcacacacacagcccagctcacacaagcagcccgtcacacacacagcccagctcacacacacagccccagttatacacacacagcccagctcacacacgcagcccgtcacacacacagctcagctcaatacacagcccagctcacacacacagccccagttacacacacagcccagcttacacacacagcccagctcacacacacagcccatcacacacacagcctatcacacacacagctcagctcaatacacagcccagctgacacacgcagcccagctcacacatacactccagctcacacacgcagcccgtcacacagccccagccacacacacagcccagctcacacacgcagcccagctcacacatgcagccccctcacacatgcagccccagtcacacacacagcccagctcacaccgcagccccagctcacacacgcggcccctcacacacattcagccgcccttcccgcagctgccaggctcggaacgggcggtgtctgtgggggccgccccgtttcccggccgcgcaaacaagcggctccttctctctgccccgccaaagaaaggccgcttgtcaggggcgggcgggcaggcggcagcggcaggcgcccaacactgcggccttgtcccacgcgggcagcctgggcaggagcaggccgaggggtgcaaggggccgctaccttgcggaaacctccctccctcggccctgcggaccgcggagaggcacctttccaccaccggacacccaagcaacagccctcgctccatccgcgctctcccggctccccctctcctcgggccgcccatctctcctctcttccgcctttggggtcccggtgggccccagcctccctctccttcgccccatctccccgcccgtcagcctcccctccgctgccctcgcgcatccccagtgttcccgtctgtcgtcgcctccacttgaggacccgcctgtcctttcttcccccgacccctccacctctgtgttcttcagtctccccgcatcctctgccctcggtcttcccctccccagcttgcattttttcccatctcttagtctgcctttcattttccccttcacatcccggtggctccccttccccgccccgtccctctgcacacccccattcatctctgtcaggtttttctcatccttaagttctctcgtccccctccccactcgggcgtcccccgctgggctccccgcctcagtttccttcccttcctgactccttcctctgacggcggccctttctcgagggcggatgtgcgcctggagggcgaaggcggcggccgagaggaccccagctcggcctggcgggcctctggccacagccatgcaccgcttgggccgaggccgaggccgacccccagggacacaggtgaggccgggcgacccgcggggctccggggagcgcccgagcagtggccccgcgaagggccgggtctggtgctctggggctggctttggacctctcgtcctgggactccgtgggagcccgggagctgtgtcagtgcccgttggtgctggagccagtcggcccttccttggcctccttcaggcgggggccaagacccccgagagttcactctgggtgctccactcggcggagagggcttcagactggtgtcccgcgtggctggggtgtcggcgcattcccgcgggggaggaggccgagggcccgggccggggtcacctgccggcgccccggccttgcgcacagagggccttgcctgtcgctcgtcaaatccagacacctgggcctccgccactcggctgccggggcggcactggggcgtctgtacccagcgtgcgggagggcacccagggccggacgcgcaccgcaggggtctttttttggccgcggggccgggcgggcgggtaatgacagccgggttgctggggagccgcgggccagatggaagcggggccgcaggtgagggacgtccctcgcgtagcgccactcagccgccggggccagagcgggagtcaaggtgagggcgcccccaggtggccgctctcggccgcggcgatcgccctttgggaaagcaccgcctgagtgcagggcaggttggcctggtgtctctttccacttctcttggatcaggttactgtgctggggccacagcctcgcacctcccaatctctccatcttttcttatcttctccccacacctctctccttatctctccctttactttcgcctccttattctcttctctcctctaatcactcttgttctccatcggccttactcctttacaatctttatctccacttgaagttcttgggtgtaaataaatgagcacaccacagctgccccacacggcgatagtgaccaatactccaatatgacagataaataaactaacgcccagacaggtgaactgccttgctccaggtcacacagctcataataataaacggggccaggcgcggtggctcacgcctgtaatcccagcacttcgggaggtcgaggcgggcggatcacctgaggtcgggagttcgagaccagcctgaccaacatggagaaaccccgtctctactaaaaatacaaaattagctgggcttggtggcaggagaatcgcttgaacccgggaggtggaggttgcggtaagccgagatagcaccgctgcactccagcctgggcaacaagagtgaaactccgtctcaaaaaaaaaaaaaaaataataataataataataaatggcattaagtgctttgctttcacagaatgccatttaatataatacctgaatttcagacagtcctttttaaaaaactgacagctttattgaggtataatttatatactataacatccacccaatttaagtatgcaattaaaagatttttagtatatttacagagccatgcaatcatcacaatttaatttgaaaacattccccccaccccacccccaccaaacttgtgcccttttacagtcactcctcattccacccctagccccaggcaagcactgatccagacagtcttttttatttttttccattactctagttttatagaagaataacttgataatcagagaagttaaataacttgtctaggatcttatagctaataaataaataaagtcagggtagaatttaaggctttatatatcccagtctaaagttctttctaccaaaggatgatgtttctccttcaccattatttattattttgtttttcttaaccccttttttacataaactccccattcccaacccactctcttgcccctcctccctcagaaaatgctgagggatttccctgagtctaaggaagcagtacagcaatctttgtccttggaaattcttctccatggccaggaattctggggaggtgccaggccagcttggggctttgcataggttaatggcgttttccctcccctcttccctggcagtcttggggtgggccccagcctgggttccggcctctcttccgccagcttgggtggaaatggtgacggagatgatgcagtccaggtccggaagggtggaagctgggagggtaaatttagtaacaccatagctaaggtcctcgggacccactgccagggtcagacactccttggaatgcgggctgctgcccctacttcctttccaagtcccctggtagatggcttgaagagagagtggaaggaaaccctgtttccctgggtctgcctccttacccctcagccacactcttagctttccccagtaacatttcagcagcaagtgggaagtttctcagcttagctagttggccaagggatgggcatgggggcatacattagtacacaaaggtcctcacatctcagataccaaaaacatgagccagggagagagggatgcatggtgggtgaggggcagtggggtggtggtggggagtattcaagttctggctctggaatctgtcttactcctggttctaatggtttaagcttcctatagcacctagccaattaagaacccaagagttgagcccaatattcccagtattagttatcactaaagttttttgtttttaattaaaaaaaatttttttagctgattgtgttgggttgaggttgctttctggggaagaaaaggtgtaggagttgagacatctggagatagcaggaatggctgagtttttcttttgtgtctcctttaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggtagattttccccaccctgcttaaggctccacagggccaagggtcttcagctgtcaaaacccgggttctgagtagcatagggcaagaaagcacagaagtatagattgggccctatgggactgtttgtgcttacagtggcagggggcaggactggtatccatgctgtggctggctggagacttggcactgctcccagacaactcccacccaagctctttagctgcctctatttcccttcagcatgagcatttggggaatgatggtgactggtgacacctctgccctgagaaccctgccacagaacctacttctttccctctcctgccctggcctccccactcaccacctttctgctgtgtccctaggagctctggagccttaggaccatggacgctctcaataggaaccaaataggccctggatgccagacccagaccatggtgcaggtgagtgggatcagggctgtgaggcaagagagatataatagggatgggatcagctcttctacccccttgtggtcccagcccaaggatgaaaggagcaattctgttcctctctgcccttccccaggtcccaagcctattaacagctcagtctttatctgaatcaggttaattggttcacccagaaactacccatcgaaagtccgaaagcagtttacagattgaccctgggctgtatcactctccttgatccatgcctctatcttccctgtacttgagcttagcaggggcaagcaatggccacgtggatagccatggacaagtctgcagggagcttgattggccttcctctacagtacccctgctgcttatccaatgccacccccaccccccacccctttctccttgcttctgttttaatagacaaaaggcacagttaagccaagacttgcgataaatccagtgggatgagttagtggcctagattcagatctaattacaatttagtggaatcatgctctgtgtaagattttgtgctaagcctttcagcaccctcagagcccttcggagaggggcgagggctggagagagtgctggtgtgactggtttagggtggtaaggtgctgaatctaatgatgcttgtcctccacccgtactacctacagaaaggacccttggacctgatcgagacaggcaaagggctgaaagtgcaaacggacaaaccccacctggtgagcctgggcagtgggcgactcagcacagccatcaccctcctgccgctggaggaaggtaagtgtgaacagggcatctcactcaccacccctctatccttataggcattcctgccctggaggcccacctcctgcatgtgttggggcccttctactgtctgctggtgctcgcctccccacaccaccagcttgcttcccttgtctctgcctccccagactgcctgccttccttggtagatgatctggttccacgactgggcttaaagatcagcttagaaacaaggaggagaggccaggtgtggtggctcacgcctgttatcccagcactttgggaggctgaggcaggcggatcacgaggtcaggagttctagaccagcctggccaatatggtgaaaccccatctccactacaaatacaaaaattagccaggcgtggtggcacgggcctgtagtcccagctactcaggaggctgaggcagaagaatcgcttgaacccaggagacagaggttgcagtgagccgagatcgtgccactgcactccagcctgggcaacagagcgagactctatctcaaaaaaaaaaaaaaaaaaaaaaaagaagaagaaaagaaaccatgaagaaagcactgagagaaacaggagaacacattgctcttagcaaccaatgtggccaagaagaaaaagggccccgctccagggcattgtcttgcatgggagggtataccatagatggagaatggagagatgggagtcagggcaagatctcccaagatgaggccctggcacagcccccttcacctttcagcttctgcccgccctctctactctcctggctgcacttgttgcctgggtgatactacattctccacattctccaaataccagtcccaggggctctgtcagcgggaggggctgttcttgctgcagttaggggagagcctgcactgaagagagaggttgcactgaagagagaggttagcaagggagacgaagtgttgcaggtagcagaagcgggggagagaagaaggagagaaagggagatttagaagaaatgaggagtaggatgaaggggaaaaaggataaaggacaatagggagaggcagttgggggaataagggaagatctgcagaaaagcagtcttccttctccatctgtggagtctaggtcctactgtgtgctgtctgggtcttcccatctctgggcctcccattctcaggcagagttttctctgtttgagaacagcgtccatcacttactgtatagaccaggctcaggggcctagtaggggtggccagtggtgggcagagattctccctggagtaggaggtggaaatatgtttccactgtggccctccttgccctgtcactgcctcctcagcctggacaacccctctgattcagtttgcctcttgtctccagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggtaaggctggacacctccagatggagggggcctctgtttaaaggcttgtgtgtattaggcacaggggaggctggctgtggtggttgccatggtaactgcctgagtgaccatactgggaatggagtactcaggtgcatctggatgtgcctaaacaacatcccaaaccctttcagcatccagacatgttttcaacctgcttttcttctctggtcacccccaacctgtctccacatactatggggagagaagaggttctgattcccgccatcagagggcctggggcatgatggcgttgttaatggttgttggggaagagcaattggagcagcagtgagagggtatcaatggcattgttccatgatgccaagaggaagttgttttgagaagctggagaggaggacaatacttcctgatggggatggggcaagggtaaatctcaggacatgcctgctcctgttacaagactgctgacagtaacttttgggtcacgaatataacccaaagcaataggccattctgttgtgtaaggtagctctaaaaactaggcccctggctaggcatggtggctcacgcctacaatcccagcactttggtaggccgaggtgggtggatcacttgaggacaggagttcgagatcagcctggacaacatggtgaaaccctgtctctacccaaaatacaaaaattagccacacgtggtggcacacgcctgtagtcctagctactcgggaagctgagataggagaatcgcttgaacctgggaggcagaggttgtagtgagctgagatggcaccattgcactccagcctgggcaacagagcaagactccgtctcaaaaaataaataaataaaaaataaaaataaataaaaactaggcccataattactatggttagcaggcaggtaagcggttggcccaggtagcactttgacagaccaggtgtgctcaccctggaaacagggttctgggcatcagttcatacagtgagttgtcagattaggagaatgagaaaaacagatttgggtggaggttagaggtgaagttaaaggctaacagcaggacaggaactttgggctaagcctggctctgagcaggctctgatggtctggcattgttttctgggggctcttactgcctagaagccccttggaagtggccatcctactcactccactgtctccttctctcctcttcatcctccttaaggcctttcaatgtcacttccttcacagctgatccaggagacctgacatttcccccgtctttttttttgatacggagtctcacgctgttgcccaggctggagtgcagtggcatgatctcggctcactacaacctccacctcctaggctcaagcgattctcctgcctcagcctcccaagtagctgggattacaggcacctgccaccgcccggctaattttttttttttgaccccagtcttttcttcctgccctcgggtagggggcagggcatggacaattgacttcagggaggcaggtccaccagcagcagtacgtaggcccttgccttctccagggattcaaggtctctgactttggatgagaggaggaacccccaaaaattggggcttggctatgatggcagtgggttcctaacagtcctgttcagtctcagagagagcatcttctctaagatttgggagcatggagatgagacaatagagcagcaaggagaggcagggcaaagttcaaagaaggcccagcacttaccacccccgccccaaacccatcacattcatcggtaagaacattgttcccctgcatgttgtgagcagggtatgcttctgttgtccagtctttccaatgcatcatttagctccctgagaaggggagagcctagggctaagatggaattctgaagcatttcctgtggccccagtgacccttcccgactcttctccagccagaggcctacccagccaagtatgtaccctcccactctcttctgaccctaaaccccttcccattttccctccccaacccccatagccttcttgtctgggctcgcctgtctcagaagcttggcagcctgtggaggggtaggcagaggcacaaaggaatgggtgttcttctccccagtcctccccctcccctgggctccaggagctgagggtttccttgtctcatctctggagcaaggcaccaagcccagccctgcctggccccactccggacattcttgggagtgtgtttccctggaaactgggtggctcgggggtgcatgtgctatctctgtgtgtctgtgtaaccggagtgtgtttatgtagctccggatgtgtttgtgactctgggcttacgaatcctgtgtttgtgtctttccttgtgtttatcgatcagtgtgttcaagtgggcggcaggggtgaactcaggactgatggtaccaaaatgtctgtgtgtgtactcctatgtgtatatgagaccccactagtcatatgcctatctgtgagcatatatacaagacgatcattttccctaccttgttcccctaatctggccttgtagacgggaccctcctctttcaaaaacaagggctactctgggaataacaaggagtgtgctttggccttagatgcatcattctgggcactgtgcccagccataggcaacttggagagacacacttcatgacaagcagagatggcagtgacaggctcttccagcaggaatatgcctgggccaggggaaaggggaggcaggcagaaaacagatgccaacctttagcacagagctatgaacataggagcatgaagtgagggagccaggaaggtcctgattccaccccctgtacccaggcatctcggcacatcccacattgccctcttctctacagagcaaggggtggagctgggaataggaccaagggaatgaggaggaatctcaatctgggtctaggctgccccaccctgggaccacagcgccagaccacatgaaagatctgggagggaaccaagcaggggaggacccagaaagccaccagctcagggcccaggctgtctagacagtaggtccccatccactcctagcatttcctccgagccctggtctccagtctccttcattccctaagcctctcactggtgggtaggggcttgtgtgagggccagcagaggagtgtggctggggagccggatctctgggttatccagctgcctctctctgggatctaggacattcagcctcttttttttcccacccagttattccatctgtaaattgggagtgaagccttcaacctttttctgttatgagactgataacgatcttgactaataaagctcaaaagaaggagggcagagcaaggctcccagcttcccacttctttgtgtctgcctcctgccctatttctcattggcgggcatcctctgtgtctgcctaggtctatccagctggccctcacagtttccagaccgatgaatcactcttcctgaggagattttttttaaagcctcccttcattttgcatttgaccctatatggttcttcctttttcctcagaagggaataagatacgtgtgcacatgtgagcgtgtgcatgtgtatgcatatagttggcagcatgggtgagtgggctagtgggctgtttagcaagaatggaaaacttgcctgattattcatctaagaggttgattttatttcagagtttctccagggactaagtgaaaggaaagctatgcctgggtgagtgtgtaactaaaaggagttgtctgggggatgtgtgcatgagaataaaggtgtgtgagagacagtgtgtttaatgagggtgtctgtgtgactcagagcatgcagagatgaagtagtgtcagtgtgactgagcaagtgttggtgtgtatctgagagacactgtgtcaggctgtgtgagctgctgagagcataaaacattgtgtcccgtaaggctctggtgtgcaggggccaggtccctggaacaagaggaactctctgggggacctggctggatggtaggtattaatacctgactgggccgggtgcagtggctcacgcctgtaatcccaacactttgggaggccgaggcgggcagatcacctgaggtcgggagttcgagaccagcctgaccaacatggagaaaccccatctctactaaaaatacaaaatttgctgggtgtgtggtggcgcatgcctgtagtcccagctatgggaggctgaggcaggagaatcgcttgaaccccggaggcggaggttgcagtgagccgagatcgcaccattgcactccagcctgggcaacaagaatgaaactccatctcaaaaaaacagaacaaaacaaaacaaaacacctgcctgactcagaatctcagcctgactttgcgggctccagatatctgtttcccaagtaggatgggtaccttattggggtcggagggctctttgctgggtctagcacaactggatgttgtggctggggtgcgggctggctcccaggggcccaggaagtgggctggccggaaagggcagtgccttggtccactctgggtcatgagttgagctatggggagtggggccggaagaggaggtgtttagggtggagacaggaggtgggctgagtgcttgcattgtacagagcactgctttggcctgaactcccagcccagggtgaccttgttacagtggcagcctgagggccagagcaggacccagtgacctagctggatcctgtagagcccctgctcttttcctctccctctctctctcagatatggacccatggaatgtcagagttgactttctgtagataaggaagccgaggccagagggtgtgactggcccaaggtactacagccagtcagggccggccagcccagctgccactgacctcttaccacagggggctgggaatgagacctgtcctttgcttggcctcactcctgcctcctggctcttcactctggcctctgtacttacctctcacctttccttcactcagtcacctcccttgaacctttccttcccgcccacttttcttcctgccctcgatgcaggatcccaagccggctccctttctgcatcctcccgccccgccctctccatccagctctccactcgtctcctccatcacttcctcttcccctcctcctctcctttgtccctccctccctggctcccttcccccgccgctggtggccggcccgcccctccccgggcattggcggctgctcgctgcctcgctgctcgctccgagcctagagccggcagctcgggaggtcggcccgccccctcaaaggctccgggcgggcccgggacctggagggcccgagctagcgggggcgagcggtccggaggtccggtttcggcggtgagtcctcagccccgggccagccacagtccccaagcagccaagcttggagaagctcagactgggaggggcgtcttgaggagggtgggcgggaggaggtgcatggggtcctctgaccttctttgggagcttgaggctgagagactcgattgtgtgtgttccctgaacatttctaaatggggattctgggcttgggggcacttctcagccggtagaccttatcttctccagcgctccggcagtcccctccttaggacccacctccctcagatggggttaaagagtcctggttagaatgaggggagtctaccttatggccaaggagggtctctgataggaaggaccaaggcccttcctcccatattcccttcactcggtctccctttggacaatccattctatttgtgtgaccaggagggcagtgacagtagctctgagagtgtgtgagcatgtacgcccataagtctgttgtgttactatgagtgtgtatgagtgtgagcctgtttgtgttggtgtttctcctctgcatctctcacagataggattcaccctctccttcgcccagtttttcccctccagatgtgcagctcctccacccacctgcacacagctggaccctgatcccccctgggcatgggggacactgatcatgactttggcaggatgggcagggattcctgggctccctgaaagggctggcctttgcgggttggggtgggagtgggcagagaggaggcttcttcccagaaacaggctggccagacccctgggggctgtaggggccagcatcagggcaatgcctgaagcttctgcatgcaaatagaaagttaatttgggcaggagctgggctgctctcagtcctgctgccctcctgcccgctctattaatacggatccagctctgctgcctggcatcactatttatagcccagaggcagcatggccacacccccttatgccggggagggtgaagggctgaggagggggcagaaaacacacagctataggggcccaggcagaggatccctagatgcctacatcctacttgggtgggcctgggactgctaggctggaatccactcagactccctgcctccttcccagcctggactgtgtggtcaggctcctgatccctaccacccacgaccctgggttgagtggctctgtctagaccctgtgaactcatcaccagtaggcttgttaaatggctaaatggagggggaggggcttgacagggctctttctgaaacagctgtggttgtaattaggtggacagtgtggttggctattatttattccagttttgaatactctgggatcctcttctctgattggtgacttggcagggaaggctccctctctctcctttagaattgttggtgtctggctgcctgggagggcctttgtgtatgccaggatagtgagtggctttatccactatggttatctgccatgggcttctcagcctactaaacccccaacccaagcaatgcccaggatcccaggaacaggctcctgagcttctcagtaagggacctgccaaggtactcacgtggcctgggatgcctcttgcccttgcggcctgcctgagctgaactgtctcagcgtccaggaatgtagacttctctgccagtcttagctcagactggcgtgaagcttggggtgccaagtggcaccagattgggtagacaggaggctgaggccgggggccaggggtgtggacaaattggaaggattggtggtagagagcaacagggctctggcttctcccaacatagtatcttctgcagtagccctccagcacctggtgtggctgggaggtggagttctgctagctacagttaggcgcctgtgggcacatctgccactgtgcacactccaggtgcccctggctacattttccagctcccacatgccctccccctccaggtactcacacttcccgggcaggactgggcttgtgtctactgcctgggaatgtgcttggctgaggccgggcctggtggcctagtcttggcctgatgccaggggagaccagggagcatgcagagggtgcttagtcagaaagaaaggtggtggtcgctccctagacttgcagtgcacagctctcctaaggtcacaaaacaagaaagagtgggagcaaattcaggacccccccggttcatctgactgatccatggtttttccccttgttccctatctcagtttttttttgtgaccctggaagttgctgcctctcagactgactcttctacccttctacccaaggggcagatagatggatcatggatacaggctggggttgggggacaggtgtgtctgtgttctctgaacatttgtgtgtgtgtgtgtgtgtgtgtgtgtgtgtgtgtgtgtgtgtgagagacggagtttcgctctgttgcccaggctggagtgcagtggtgtgatctcggctcactgcagcctctgcctcctggattcaagcaattctcttgcctcagcctcccaagtagctaggactacaggcgcacgccaccacccccagctaagttttgtattttgagtagagacggagtttcaccatgttggccaggctggtctcgaactgctgacctcaggtgatccgcccgccttggcctcccaaaatgctggaattacaggtgtgagccaccatgcctggcctctctgaatatatttttacagagtactttcacatacactgtcttattaaccctacaagatcagtggtattgtccccatttttctgattaagagaactagattcagaggtgaagttacttcacccagagatctcacagctagtaagaagaggaattaggacgaggactcagatcttgggactcactcaccagtgctttttctactctgtcttgtgctgcggagccctggaggtgcccatctcaagcacaggcaaggtcaggtgtggactgtgtggactctgagagcagatgaggatgggtcttagagctgaggtgagcctgctagtgctgtgaggtggggtaacttcagtcctgcctgcccttccaagtgttttctctctttcttcccttcctttttttttttttttttttttttttttgagacagagtttagctcttgtcatgtaggctggagtgcagtggcatgatctcagctcactgcaacctccgcttcctgggttcaagctattctctgatctcagtctcctgagtagctgggattatgggattacaggcgtccaccaccacacccggctaatttttgtatttttagtagagacgggacttcaccacattggccaggctggtctccaactcccgacctcaggtgatccaccctcctccgcctccaaaagtgttgggattacaggtgtgagccaccacacctggtcttcaagtgtttgctttctctgcaggctgcatgttgtgcctgggtcagtccaccttccttcgctttaaccacccggctgaagccaagtggatgaaaagcatgattccagcagggggccgagcccctgggcccccctacagccctgttcctggtaggtaccgacgggggcagggtgctgggttgatggtgttcctgcagcagtcctcctccttgctcacttcagccacacttggagtgttagggcaagacaatacctaaggtctgggctcactgccacctgccatgggcgggtggagaatgccaggcagtggggccactgagagctaaccaaggcagtgctgcttagctaaaattgggaaattatgtgcctcgagggatggcaagctctgccagcttgtaccccactgccctggaggatgccactcagtgtctggaactctggcccacttgtgtcaccacagggagcctcaccctctagggtaccctgaggggcagaaggaagcattaggttgaactccctgtaagctgtggtggggatcatgtccttgggcctcgcccaaccctcactccatgccctgcccgctgatgactcagtggagcagctgtattttgtgtgtgaattattgatccccagaagagaattggtgattgttctggggaaccaacacaggccccctcagcccagctgcacaggggggcaggaggggtgcagaccaggaggctattatgggtttaccatctcagactttgcactggcatttagatggctatggggtgacaggtgctgggacagatggacatggatgtcaggtacacctagtggggtggtatcagcagcctaagtggatagcctggggacctgaagaaaggtgagtgatcactgggattatcagtatccatggcatcccctctgactatatcccacacagtctccataattttggacccaaactcagtcttgcaaaggctttcccttctcttttccctaccctcgatcttttccagtcctctgggggctcagaagcctgggttcccagtctactccctagttaattttaccctgcccccaccccagccttgtcatgtcactcccttagctgtttggggcagtggttccagggactcctatatggttgactagtgctggggcatggcaaaagcaggctcttgctggcatggcttaatgggataattggaggcactgagcttcacctccttgctggcagcctggcttccaggaaccagccattagcactagctccctcccctgcctctgattggacgaagtggtgcagcacacacccctcacccagccctgcaggcttttttctttttctttttttttttttacccctgggcctctggttcctacattgggaggccctgacatcctattagactaggagcccctggaacttctggccagctctgcagcaggcgcccatcttctttgtataatgccttctgttttcttttttctttttttttgttttgagatggagtctcactctgtcgcccaggctgcagtgcagtggcgcgatctcggctcactgcaacctccgcctcctgggttcaagtgattttcctgcctcagcctcccgagtagctgggactacaggtgcatgccaccacacccggctaattttttatttttagtagagatggggtttcaccatgttggccaggctggtctcgaactcctgacctcaggtgatacatccatttcggcttcacaaagtgctgggattacaggcgtgagccaccacgcctggcctcttttttttttgagacagtcttgctgtgtcacccaggcagttctcagctcactgcaacttcctgggttcaagcgattctcatacctcagcctcctgagtagttgggattacagacatgtgccaccatacccagctaattttttgtatttttattagaggtggggtttcaccatgttggccaggctggtcttgaactcctgtcctcaagtgatctgcccgccttggcctccccaagtgttgggattacaggcgtgagccaccgtgcctggcctacgtgcccttcttgaggagggatataggatatagattggaggagtctagtcttggggtgaattgacaacaatagtcttagaagtgcctatcattgttaactgttttaagtcacaggcaggaaggccctgccgattcccttcctttacagaaggagaaactgaggacaagtgacttggctaaggttgcatagcaggtcagtggcagagctagctggtaccagaaccacatctcctggcttcttctccagagccttgttagcctcactgtgctaggaggaggggggctagtgctctggcttttatgcatatgcagctccctaaagtcaaagacctttgcatttccctccagcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggtgagcgggtgccagggaggcttgccactgtccatggcagagtctctgccagggctcgagcaggccagctggcagagcaggagaggccctcaaacagggcttcggcttctcaaggttccccacctccaggatacactttagtgatcaatatcttatggttctggtgccgtgaagaagaaattcctttgaaatctctaagactttattttaaattcttgctaattttgcatttattcaacatagcatttgttttaatgttaaattaaatttcacattgtttacctgagcacagtgaagctctaggaaaacataccacaggtatggtaagacctcgaacctcccagtttgagaagcagttggtgatcatgagtaggctgaagctcagagaggggaatggctttgtccaaggtcacacagcaagttctggcagagctagaattggaacccaggtcccctgtctgactctttctgagacttgttctttagaaaagtaccttgtccttcttttttgcttgtctttggcctctacaagtgggtgggagctgctcatcctggcccaggcagtatcatctaggagtgcaggtggcagggtagagggacagagcaggataggcaaccctggcctgaccgttagccagcctgtgtaattgtgactgtgtgtgtccatgtgcatgcacgtgggtgcatgcaggggctgggtgtggctctaggcagctgtcctggagatggcatctgagctgggtgggggccaggattccccagatagctcagggagcttaaggggctctggctggtgtgtacacagtcgagcccatgtacagaagaatggattctgccctctgtcccttacgagcagaacagggttctttggaaggtgggcaggaaccctgggattggtttgaggaagagaaccagaactgatgagaaccagaactgaagcatctggagatgcttttggaagaggttgggacagttttggatgagggtataggattgtgtgtttgtgttggatgggggtgagatgaggcggatcccatcttttcctttgctgcatcttctcttcactgtttttgcattggtctagacgggaatgcatggccattctaagctggggtctcatcctggagagggggcagtgagcctggcacaggcagagtggcaggcacagcctcccccaactcctccatcagttttcccacccccattcccacacataagcacacatcttaccactagtcctgacctgcctcacctgccactttaagtcttggaggctgcccgccctgcccctcccacctcaaccaggctgcttatctgggtcctggggcaggggtggaggcactggcccagcctcccaggtgccgaggctctgttccggtttttttttttttttttttgccatggaactgggcaagcaacaggagggaagctgggtaagtgtatgagaacacctctccagccttctctccacttcctgcggtttgggttcatggccaaactgtaagtgatgagagacacttgaggaggtctagggaccctagagagccatggaagcctcacaaaccaggcttcaggcctataggtaggcctgcgggagaaggcaacaaagaccaggaatgtgattgtgtcatccctcctttacctcctaggcccctgagaggtgactgtatctgggtgggtgtgtatgtggagaggggtggatgaagtggtagggccatgggagtactcactcatgggcctgggcattcaaggactggcagcagcccatcctgctgataaacagccaagggctgcctgagggtaacttggagctgaggtggggacaaagagggccgtgtccttggtctacctcttctccatgtatgtctgtggttgggtgtctggtccctgtgggctcatgggtctgttttccagcactgtctgtctgcatacgtgcccacctgtctgtatgctagactgtgtttatctgtgagtgtgcatcagtgtgcatttgtgcatgtcagggctggtgtctctgtacttgcctattaatgcagggccagggcacatgttgtatccttgtgtgcctgtgcatcagtgctggtgtgtcagtatgtgtccttgtgtctgtagatctgtgtgtacctgcgtcaggacgagcaactgagtttatctgtgtctcattgtggtctgtagtctgcttaacagtgtgtttctgtatgtgtttagtgtgttactgtgggtccatttggtgtgttcctgtgtgtcctggggtagactgaaaaaagaaaggaacaggaagatggaaggggctgtcccagaagtgggcaggaagaaccaggctgttatgccatgtgggcatgtggcacaacagcctcgttcttcctgcccacttctggggcaccttgtttccctctgcctcccctaggtcttggggtcaggcctctcctgacttgacactgatgtcctagccccctgtaaccctgctctccctcctgacaggatactgaacctggctctatccccaccagggctcagcttcctccccttcatgtcctgctctgtccatcctccccaggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggaggtgagatggaggggtaggcaagacaaagaggctgaagttggacctgctgggggcagaggaggctggtgtatccaatgccaaggtccagtgaggggaaggatcaagtttgggaagagattagagagcagaggtgcagaaatgagacaaggaagagaagggaggtgttgatgagcttcccaagctgtaaatatgctttatgacctgcctttccatggggccccacccaggcctggcactcagtggtaaatattctcttccgcagagcccttattgctcccctcaaaggtgggggttgcgggggggcagggaattagcctcctgtctcagtccagctattcctcagcaagtgcctggaggaacaggtgatccattttcttagtctgattccaaaaggctctaggcttcctcagttgatagcttccctcccctccagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggtgagccgtgaagtccctagctggactcttccctaggccaactgaaggccccagagaggggccacagtcagctgctttgatggggaccctggtgtctgcccccaggccgaaatggagcgggcactgctgcagggagagagggaggcagagcgggcactgctgcagaaggagcagaaggcagtggatcagctgcaggagaagctggtggccttggagacaggcatccagaaggagagggacaaggtaacccacacctggcccagcttagtgctgggtaccagtggcctgggagagaaggagaaatgtcttctctggggccctgtacccttcacctcatcatccattctgcagtacaagtggtctctgtggctttccagagacagagtgacttctcctcctctgtggaaggaaccagcttggagggcactgccaggggctgggctggtgtctggggtctcctctgtctgggtctgtgtgctacctctgggtgcctgccatcctaggccctttatggcccttctaggaagtgccaaagccccttcttgggcagtgagcacagcccaagggactgacattggggagtgattcaagttcgggtcccaccatctggagaacatctccctccaagcatgccacaagtgcttacgttgtgatctttgggagatggccctcgggcctctgcttcccttgagccttcaggatctgcagcctcccatcccaggtgatcctagctcctgcccctgcccctttcagatttcgtgccagcctgcaggggccactcccagatgcccaacaccgtgccaaaagctctgaagtggagaggggtcatctatttctggatctgacagtatttttccaataatttaattttccttctggattttttgagtttcttcctcctgccctcaattttgagaatcttaaaaattctttgaccctttttttttttttttggagctttggctctggcccccaaaaccacactcccaaattctgtgccaaattaactccacgcttgccaactaggcctacactaacgtcccttctaatcactgacttgggctttccgcatgcccctaactgccagtgccacccaggtagggctgagccatgcccgcttttgcactaactcagtgggtgcctctgtgcccctggcctctctcctctaatgctgcctccttcttttcttggtgtgggaccccagagtttttatatgaaaggaattggcaggaggattggtagctcaactttactcaagggggcattggcaggaggggtatgagggtgggggaaatgcttggctgtggagctgctcagactgaagagttctttccattggaaatgcctaggctgctgtcttaggctactgtctgaggacagcatgagataacccaaggaagcttcctggcagcttcctgcacagcagagtaggctgtcttccacctattcccctgcctgccctctggagccaaggagtaaggaggcccagttgtgggcgtggtcttggagggcttgaacaggacctctctgccaacatagtggctacccttcctagctttcccttggggcttcccaaattcagatacccatcagaggttggtaatgggtagcccctactcttctcctcactcctgagccacctataacacagggtattttaaaggctgagtccaaggatgaggaagcacctagaccccaggaactggcctgattaggtcctcctctctggggatgggtagatgagttgggtagagggatgggagtgactgggttcagcatagggcctcactcccagggataaagctcagcatttcagaaggaacctgcctaacctcatttcccactgacctggagttttttggaggcctagacttcgctttctctgtggggaagagaggttattcgaggctgtggtagtgatggtggtggtggtgatggtggtagtgatggcaatggtgtggagggttcacttggcttccctcccctgccctcagcccatggctccactctggctttggaatcagtaaccacagtttctcctctgcctgtcctttgaggggtgactcaccaaaccctcccctcgtcccccttcccaccctcagaggtgtcatctcaccccagaaagaaccgtccaccccctctgtacccactcctgggactcattaccatggaaacagcccgaactaattgcaaccctcatccctgaagttcagcctgcagggccaacaccccaccccgaccctgggcaggaggggagggaggccaagggtgttgggttggggtcccctctgccacactgctttaacatcctcagctcctgattgacgcccaaccctggatttaaccctcaccatcactaccctttttccctgggttaaattttggtctctgggctgtagtagaaggggagggatgagagctggaggctctgtgatgcagaaccagccttgactggtttggagagaaaacagagggccttttctcgagacctacccaacaatttcagttcaagggacttcaggagaccaaaatctgtgccctgcccccacacctctgcctgtgttacctcatcccctgcacctctgactgccgtgttaccttcagctcctggccttgggccctctccctcttcacctctttccctcctcactttccctttctgcccttttctttctcctcgcctggttattctcctctttgattctagcctttttttctcctctctcaacccccattgccgacccccattctgtcccgccctggccgccctcccgcgctcccctcccgccgctgccgggccggagttgaggagtgtgtgttctgtttctcccctgtgccccgccctctccctcgccctcccgccgaccaggagagggcggagctggccgcgggacggaggcacctggtaggcccgccaggcgctctacgccgagctccagacgcagctcgataactgccccgagtcagtgcgggaacagttacaggagcagctgagaagggtcagttccaccgccccccctcccccggccccgcgggccacgccccagaaggaagagaggagagcggtgggacgggaccacctggcctctgcagtacctgccggacaccagggtcggtgctgcggtttggagggaaccgggaaggttggggaatcagcgctccaggccatgatgcccgcaaaagggcaaggccaagtacagcgggagctggggggaggcaggtttcttacccaatttccccgggtccagccccatacaacgcatgcccctgtggcctggtcttccaggcccagagtggcattgcaagcaccacccaaccccctttgtcactgtcgttgaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggtgtgccccacctcgttccctgctgcgtgctgttggaggccagtgacctgggtttgaatcccaatgacctcacaaaagttaacttcgtcttttgtgcctggatttccttgtctgtaaaatgagaattacaacaggttgttgtgagaattaaacaagatgtaaagacagaataggatgtgattgtaatgagcactcggtgaagaataactattattaagctctgactcccctcagtcttccagtggaaagtggattctgctcccattcagagcttggcactggcccagcaggaaggtgaaagatggaggaggaggaggcttgcccctgtgcttgcagagctcttgtctggtggaagtgctgggacacacagaaagatttgagatctggatattagagccagctaggggccctagaaagggcattcatttcggttccagccatggctcagccctgccttggctgagctataaaacaagggttattgggtattgtggcctggccagctgtgacacgctagctagatactgtgatcacctgctcttgatctcagccagaccacaggatggtggcacaggtgactgtgtatgtttggggagtaaagctgggaggaggtatgtgttagtaagggttgggaagaggtgagggagggattggagaggatggctcaagcagcttccacccttatggctgaagcttgtggccatgcacatgcacacatgcatgtacattttgcttggctggagttagtgtgggggaagtgagggtggtgagattggggaggggtgtctaaaattggtgacgcaggggatttgctggttagcctggggttggtggtaagtggggagctgctggactttccttgagtccagatcccatgcttctctccctgagctgctgtcttacaaacgcactttctggatgtaagactgactgatgaaaggagggaagaaaattgacacacctaagcacatgggtgtgtgtcaggcaccttgctgggagccttccttggattacctcaatgctgtccttaggacggtatcacaagacaagtgctgttattcccattttatagacaaggaaactaggagtaggagaagctacacattttgcccaaagcctcccattatataagcttcagagtcagaattggaacccaggcctgttggcccaaatcccacgttccttcgactgtactgcactgaggctaggggcgggcacttctctagcctcttcctctttctttctggagggaatgcggtagggagctgtagatcagctaatctcatccctttggggttctggtgagtataagctccagggagtttgggagggcttggcagtagtggattcctcttcccacacccaccctgcctcctgggaaaccggagctcagcccctaggacctggggtgtcacattcttccccatgctcctccttaggaaccttatccagctttcatcctcagaccctagtgtcccaccctaggctctgtctgccctggtgccctgtgctcccctgccctttccactctgattcagagtgactcagagtactggtctgggagtccaatagatgattctaatccgtgctctaccacttagctggctaagagatcttagctcctaaatatgttggtgttctcacctataaaatgggtataaatgcacctgcctcataaaggagcttattaaattacgtaacaaatgcaaaacatttagcagagttcctggctcctaatgggttcttagtagatggcagctcttgcggtgaggattactgcctagcctactttgttgttgttgttgattttgagacagagtctcgctgttgtcgcccaggctgggttgcaatggtgtgatctcacctcactgcaacctccacctcccaggttcaagcgattctcctgcctcagcctctcaagtagctgggattacaggtgcccccccaaccccacacctggctaatttttgtatttttggaagaggtgggatttcactctgttggccaggctggtctcaaactcctaacctcaggtgatccagcctcctcagcctcccaaagtgctaagattacaggcatgagccacagcgcccggccagcctactttggtcttttcttggactgaccccaaatttaggacatctcccttctttaactcttcctttcccatgatttgttcctaaagatggtggtttaaggccgccttcttcaggaagccctcctgggattaacccagcccatttttcccatctctcatccttcccccttacttactatcttttcatttccttttagcacatgattgttgagccaggtactgttctaaaagccctattgggggtataaagacagaaaagacaatgtggatcttacgtttggggcaggctggtggtggtggtaacagatatattcacaaataacaataataaaggcagatggtgatacagaagaatgtgagcacagaggaaggagcaaagaaatcggcaatcaaggaaggctttggagaggagatagcatttggtctagtcttagatgataagtaagctcttgataggtagagaagattggaacagctctcctggcctaaggaagcgacataagaaaggcctgagagtttacagctacacagctgagtgtacagtgtggctgagctgaaaggacatggaggctgtaagagggaggggagctgcaaagggttcgggagccccgaatgcctggtaaggagtttgtgctttatcctgtgtgtaatgaggagccactgaaagattttgaggagaggcatgatctgaccttacttgtggatttttaaaaaattattcaagtaatattcctttttagaaagtaatttttctttttagaaagattagaaaattcagataagcaaacaaacctcaaagtcatcttaggaagatatttgtgacagtgtggagtggatcaggaagttgagagagtggaagcaaaggctggtgagaaggtccagaccagggaagcagagggcctggatttgggtggtggcaagtggggttgggacagggagaatgaggcagatggagtgtctctaggctttgggacccattggttgtagggtaagggaagggagatttgaggatctgagtggtgtgcctaatggcacaggggtcattggtcaagggagggagggaggcccgagggaaggagcccacatggcagcctgttttcttagggtgagttgaggccaagcagaagagctggttgatccccttcacctgagccttgagtgtctgggcaggagagccagctagttctcaccttgggctcagccctgtctccccagggcctgatcaaccaccccatctcctttaggagcgcctggccatcctggacagtcaggctgggcagatccgggctcaggccgtgcaggaatcagaacgcctggcccgggacaagaatgcctccttacagctgctgcaaaaggtagggtccctgaggttgggccgggagatttggagtagggtaagtgggaggggagtgcagaaggactggggtgtaaatgtgctggggtggagcacagggcccccctcacacagtctcctggctcccactcctctttgactctgccattctgggctcgcaggagaaggagaagctgactgtgctggaaaggagataccactcactcacagggggcaggcctttcccgaagaccacatcgaccctcaaagaggtatcatgattggattagccccagcttcaggcccaaggcgtgtcctgggaggctctgagtaacacatggcactttcaccccagtagctgaggttgtgtgggggcatcttcctgaatgggagagatttgaggaggaatggccccaagctctgggatttgattttccatggctgccagctgcctctgtttagttgcctctggggttcccaggagcccacagatttcactgtttttggtggctgaatatatgtggggggactcaggggcctgggttgggtgggtagacagctcagaggcttggtaggggccgggctggatggactcaccttgaaggggagcatagggatataggggtgctgatcctggggctcttgggcttcagtcctgagttaggcatttgtctcagaagaggatattgaggccccttaagtggttcttccccaagtctgtatgtctggtgtgtgaattccaaatagaacatatctggtttaccaacttcgttccctccctccctccctccctgcctcactacacaaacaatttaggcctgcggtggggaactgggccaagtgtgagggatgcagcccctcaccgtgtcccctctctgtaggccgagctgctcatctccgagtcctcagagatggggctggggactaaggctctgggccttttcccagggtcttctcaggctggggcctcctctgtctctttaaccccacctgcttccactcttctctgccccaaagcacaagaggtaatcacagctaactgcgtgctctgctttgcccactgcctgtctgcctgcccgctgagcccctgcctacagctcctcccagggcttagctgaagggcatgtggtgatagtttcttggctggccagagtttgggagagtgtgtgcgagcatgccatgccgccattccatagagtgcctgtgcagcccattgaattgcatatttatttgccatgcagaatataattctgcatgccattcattagttctcacaacatgctggaccctctgactgactttccttttccatgaccccagaggacaacctggttctagagctaggcctggatgggccccttgggtagagcaggcttatgatcctgcgctttgattcagcatgcattgtggaggtctaccatgctcccagcacccagataagctcagtttctaaggacaggtgatgaatacgacagtccctatcctcccgacccacagttgaatgtgttggcatctttccaaggactcaccttgggcagtgggcccatttttctgctaggcttttagctgttcttgctaaggcctctttctcacagcccatcttgctcaggccctggtgatgtctccaccttcccccacctgtttctagctcctgcccaggctgatggggtgtgaggggaccctggggaatggtgtgactggtgctcaatgctgcatgtgtgtgccccactggggactgccaggttgttggggacggggagggggtctctggaagctgggttctgatcctcagtgaactcttagaaggccttctgtgggcttctttgcctgcccccagcccagggcgaattcaggcatgggccttcagggtctgcttggggcaggactggatgccaaagtggctctttaagagtggagggcaggaggagccttcagacagttggttctgctgcccttttctggtctctgtcactccctgcagccatctatgggcatagcaggcaccctacccctgccttggattttgtattgacatggagtgatggccctgtggcctggcgtggagtttggggtgttgggcaccttattgaaccctgttaaccccttctttgcccacccctaccccttctactgggcaccccaggaatatgtgaccctggcagaagttttccagctgtgttcccgcttggacccctatgcttctgccacttcccccagtgtgctcgcccagcccctgcctgacagtgaggtaccagccaccgagggtgcccaccaatgcccaaggacctctttatggatggcctagattcccccttgggcctgggtggagctagggggacagaagggtctgtgttcgacagtgagggagaagggcagcctgcataaggggaggttgggagtggtttctttttttccctggggccttgggagctttctttagctcctatggcctggggaggggcacgccttctgctctaggatgagggtgtcgagttgagaggactctggctttcctaggctgcaggctctgtactttctgccctttccctcccttcccctgtgggtagggccatctcatgtgttctggttccattaacctcttatattccctcctgcgtctggccttgctccaagtacgtgatgcttgagcagctaaaggtgatgcggggcacctcgcccatgcccccagcccctgtgccaggcctttctccctgggcctccgcctcccgggacctggttcccaccacctgccttcctcccatgctgccctcctcctcgttcgcttccatcacgccttcacctaaggttggtggtttgtgagttcttgctacccccacccatgactggtgtgctctgtgtgtgttttgctcctgctcacctggcctcttggctctgggccagcccaaggggagtgcccagtgcctgcaggctctgtctggtggctggtttcatggctggtgtagcacatgtctgtggtctggaagttgtaccctgactgtttctctttgcccttagtacattcagggcaactgttgtctcactgtttttctcttctttttcttgatgctctcctttctcccttccttcctccccttcttccttcaccttcctgtccatttccctgatgtggccttcctttttaaccttccccttccttcttcctcttctttcttctttctcccttctcctgccttttcctttccctttatttcctggcctttcctctccatcctcccctcctgtccccttttcccctccccattcccacctccagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtaacccctccttcactgcccgtcctccccagcctttgcacctgtccactctgatacctcctgccaatccatcagccacacagtaccaccttgagtggaggcgtcagcccagtcagggcaatgagggcacctctgggccctgagagggtcactccttgggcagccatcctggcatgtgggcaaccggggggccagcctccatagtctaaaactatctgattgagtgtctggtggaagaggattctggagctgtggtcagtttgggatctgtttggtgccctgtgctgagctaggctgtgggtctggcctatgcttggcagcccccaacacctggagcttctcacccagtctgggggcctgacaggctcttgggcctgtggcaactggaactagtgtgtcctgggaagaactgccagtattttgttctcctggtctctccagcagtgacacttggaagcagaaaacaaagggcaaagactctgaagtgacagcctaagcctcctcagagttgccatggagggcgtgggcctacctgaacctgcagcaagcaactgaccatggggtgggaaagggggctgggctagtcttctcctcaggtttcctccactgaccagctgcagtgcctaagattgaccatttaagatcaccccttgagtgaaggcactgcatctgtaagactgtgacctcagctaaaatttcatgtttccttggggaggagtttgatcatgtaagacttctactgtgtacccagctggttagagattttaacgtgttttgattctctgatcatcatcataggcctttgaggtagatgaagttaactcattttatagatgaaacactggggcctagagaagataagtaatctctccaaggccacacagctaggaagtagcagagcttatgccacgtcagggtttgtgacactaaaggccatattcaccacatgctagtgctgcaggggagcttggccattatttagtctagtcctacccccttcttttgcagataaggaagccaaggcccagagtagggaggtgtgtggcccaaggtcacacagcctgttagtggcagagctaggaccagagggaacccagcttctagttggtctcctgcacaactgcctgactgacattaaatccttgcatgggtctgtttacaggtcttttcttagacccagggttgggctagggattggcccagggaggaacagcctggaaaggagaattggcagctgccaatagcatctggccattgggctggctcaggaggcttgttgtcagagccagaaggcctcagaggcctagtgccagggcggtacgtcagatcacagcagactaggtgacatgggggaggtggccaatgggggagccaggaatcactgggcactatcttttctttccaggtttaccgctccaagatggatggcgaggccaccagcccccttccccggacccgcagcggccccctcccctcctcctctggctcttcctcctcctcctcccagctcagcgtggctaccctggggcgtagcccctccccaaaggtctgaggacagtgggtggggctgcacatgtggctggggatggagacttccaccctggggagaggccaagaccttgggaatgggggtaagggccttctgagcccaggtccgaactctccattcctctgcagagcgctctactcacccagaatggcacgggcagccttcctcgcaacctggcagccacactgcaggacatcgagaccaagcgccaactagctctgcagcagaagggtgagtgactgccccgccagcccacctgctctcctgaggggaccctgggtagttgccatgcctcctctatgctcacacctttcacaggatgtttttcctttaattgggatctaggcaagaccagaaaggatttagagtgggtacctaaagaagagcttcctggatatttatctaaagccttcagggcaggagactaagggcttagggggctgtgacatctttcctagagagcctagccaataagggaactgcttgttgacctgagtcgggttagacattgccctctctggagggaggggatggatttgatgacttctagaaatggttgcctgagatattggctctggggacccaggagtccttgttgcttgtgtgcaatttggttgttttgaaagcccatgtctgtgcctctctctcctcttaccccctctgtgtctctaccgtaccctctgcctggggtcccccacgccagtcgagtcgcttcccgccgagcccctcccaaccgacgacccagcaggtagaacgttggtcatagagggcattgctttggccaggcagcccctgccctggcatcagcatgatgtgtcctgcccaggtccccactgcctgcaggcagggtcccaggctgagctgggttggggtgtctgctggcctcacccctccagctggcctctcttctgccctcagctgtgctctaccgtgtctcccctgccttctttcttgcgtttgttgcttttgcttctgcattgcaggggggtctgcattggcagtctgggtgctcatggggtttctgccatctcttccttctcccttctccagcaggcagggtgggtgcatgtatcctgcctagacctacttaggccttggttgtgagctggagccaactggctgtcgtgctgccccagcactacttgggtaggtttggtgtcctatatggactcagggtgcgaaagagcactgaagccagactgtgcatctgtggccggttgtgcaggcgactgaagcattggcagagcagccaggcctggagctgcaggggccttagggaagctgcggggagagggggctgctctgtgttaacctctccctgcttgcccctccctctgtgtgttgtgctgccagtggcctgctccttagctgcgtggggagcccactgtgactcccatctgtctctccttcaggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccaggtacacccgacgcctgggcccgcagcctccctcagccaccgcctcagctccttgatgcacttcctcttccccttctctccccagcgcgagtggtctggacatggggaagatcgaggagatggagaagatgctgaaagaggctcatgcagagaagaaccggctcatggagtcgagggtgagtctgacctggatcggggaggcagaaggtgttggggcacagagctacctactgcatgtcaagggcctgtgctccaccccaagcccttccacccacattagccttgccacattcccttggggtagaaaatgttttaaaaggttgtattctggccgggcgcggtggctcatgcccgtaatcccagcacttcaggtggccgaggcaggcggatcacgaggtcaggagatcgaaaccatcctggctaacacggtgaaaccccgtctctactgaaaatacaaaaaattagctgggcgtggtggcaggcgcctgtagtcccagctgcgcgggaggctgaggcaggagaatggcgtgaacccgggaggcggaggttgcagtaagccgagatcgcaccactgcactccagcctgggagacagagcgagactccgtctcaaaaaaaaaaaaaaaaaaaaaaaaaggttgtattcctcaaacaggcttagggaggcttggtttgattacaacttcatagctcttaggaacagagaaggcagcatagtaaccattctctaaccaataatttcctgtatggaaacttccagtttttgcatgtttacttctgtagactttttggcaactacaggaattttgattcctgtctacccgtatggcaggccattcctcttggggctgattaggaaaagcaggaactatgagtgaagtatagaccagaagaggaggcagatgtccaagtcagtgtagaggtgttggcaggggaaccttgggagcagagagggctgacagctccttcacttgggcacggagctgggattcagcaaagagggacccatggtttatcctgggcataggcaggctgatgaaatgtgtgcctaggaaggaggataaataaaggatctgcagaagctgttctgtgtccaccattggaggcactctgcatatttgagatgagagtgggacgcagagagtaaggtcagcagtttgagggatttaataaaaaacagatactgacagtctgaatggaggaccagccagaaaagaatgcctcctatcttatttatgtctgaatatggcaaatgtataagcatctcctggcaaatgtggggaaaggagattctgctaagttttgagctgggaagaaatagtaaatgggagttaatggtataggaggtctttattagtaattaagacatataaagcatcactgacatgctctgtatttaattatttgttttaatgacttctaaaatccttttatagtggcttttataagttcagttctgaccttagtctctagtcacttttttcccataaagtttgaagttcaatagcaaatgtttctaatttgaagtttcagaaggccttcagttagtgattgggaaaggactatatattagctgtcaaaaaaagttgtctagataacccatgttgcgaggattcagatacaattgtaagagccccatttattttttgagtgcgttccaactggaatcagtgatgggcatttatctacatgatctaatttcattttcactataattccaggaatgggcattcttaacttcatttcacagatgaggcaactgaggcttaaaaagtttaaatggctgggtgcgatgactcacgcctgtaattccagcactttgggaggccgaggcaggcggatcgcctgaggtcaggagtttaagactagcctggccaacctggtgaaaccctgtctactaaaaatacaaaaaagttagctgggcatggtggcaggcacctgtaatcccagctacttgggaggctgaggcaggagaatcacttgaacctgggaggcgaaggttgcagtgagcgagataaaaaaaaaagtttaaatgattttatcaggatcacagagcccatagtggtagcggggccagggtttgaagtcaggacagtcatgcttaaagcatttctctttaaccagccagggctcttggagagggtgggctttgaagatgatgcctcctcatgccagactaccctgaggtggattcctcctgcagccctgcccaggtgtgaagagggccagtggggggaagaggatggccataggtgctgaccccttggctttgggggcaggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggtgaatgggcagtggggcacagtggtggttggtttgacggtgagggctgtagagaagtggggagatcccagggtttctgtgttgggctgtaaaacctgttctactccagaaaagattgctgttggcttaatactagcagaattctacctgggactcattgaccccaaaacagcacccaccaggactattcaagttgtgtgtgtgtgtgtgtgtgtgtgtgtgtgtgtgtgtgtgtgtttgtgtgctggggtagtgggttgtaaggatgtggcaggccaccttgcagacatccggggtcagagaagagggtctggacaggcatcccagagatgggagctggtagtcaagaatcagagtggctccccttggcctctctccagggcctcagatccgcttcatgagcctgcgctgcaccttcccgtctgcttcccctgctgcccctcctgcatgtggaacttcagggtgtgctggcccacaccccacaggacctttcagctccagtccccaccatcagtggatgacctcactctgacttttggtttacatctccaagacagaattgtactagtttctcttcgggacagaaatccttccttgcccaaaagccagccctaccctttctccttaaacaggagacttgagcagaacaattgaaagcagaaggagaaattggtttgggctgggaaatctgcccatgtctctggtcccaaatcctaactcccacaaccccccatgagaatctgtaggacttagatagcctgtcccttctgattagtaggcttccccaggttgggagtcccctggaatctttcccaagcagtgatcacagttccctcatttcctacagtgcaacaaaataaatcctaagggataggtcatctggattgggtttgggaaataatgagaaggggctgggcacagtggctcacgtctgtaatcccagcactttgggaggccgaggtacacagatcacttgagtccaggagttcagagaccagcctggccaacatggcaaaaccccatctctacaaaaaatacaaaaattagctgggcgtggtttcacacacctgtaatcctagcttactctgatggctgaggcatgagaatcgcttgaatccaggaggtggaggttgcagtgagccgagatcatgccactgcactccagtctggatgatggagtgaaattctgtctcaggaaaaaaaaaaaagaaaaaagaagctctgtgaattttacccccgtggttggaatatttgtaaaatgcttggcttccctttcctgcttcagtcagtgactgttctgggagtctctcttctagcccctgtcctggggctcaggcattgctgcagtggccactggtgtctggtgtgggagatgggtagaatcagctatctgtggggtcgtgtgttttgtttttttctttaaataatatatgatgtttcctggccattttaatgttcttctgggacaggaagagtagaaaaatattccggttgactgagaattctagttagtatcagaggtagagtagaccttagtaattatctagttcaaagccggcgttttacatggaaggaaactgaggcccagagaagggatgtgacccaaacaaggtcccatgcgaagtcagaaactagatttcttattgggcttttcttcccagaccacgttcatatctggcctcttgctgtattctctttggctcaggagggaaaggaggggcagggcaagacaaagatgccgtgtcttggtcataggtgggaaaactgaggcacagagtgacttcgcagtttgcccggccctaggtagagtcaacataggcatggtaggtctccacttttgccataagccctgtggagccacagtgaccgccatgggttagggaggtgtgatgtcaggctgttggggtttagaagtgaagccaaggggcctggacaggggaataatgagggaagagaggagactctcctgaccctccctcttgctcccaggcacgacccctgacccgctacctgccaatccggaaggaggactttgacctgaagacacatattgagtcatcgggccatggtgttgatacctgcctgcacgtggtgctcagcagcaaggtacaaggcgtgtgtggccctggggtgctggggagagggagaatcccgtggtgagaggcacctcctgggtcgttggaatagtggcgtcagtctctaccctcacctaaccagatctctgtcccaggacctggtgtgctggcctgaggagatgttggggacaatcccccatgaatacaggcacaggcgatggcacacacttaaggcttaagggctgcatatttgggtccttccttactcctgcttcctaccaggtctgccgtggctacttggtcaagatgggcggcaagattaaatcatggaagaagcgctggtttgtcttcgaccggctcaagcgcaccctttcctattatgtgggtgagttcccacaaggccaccctgggggccagccaggatccctgggctctgttacccaggacggctggtcttctagaaggaggccaagcttccaagtaggggaccagagtcttgggctaggctttgccctccttccctgaaaatgtacacaatgtacctggttcacctccatttttgtgttcattcattcattccttcattcagcaatgttactaagcatctagtaagttctaggcactgttctaggctctggtgatgagtaagatggccacagcgctctcatggagcttataatcggggaagcagacaagagtgataaccacgcacaatgggtatgctgataggagacatccaggcactgcaggagcatggggtcttatggtcagagttgggctgggaactcccccttggacaaattccatcagagattccaagacaagcagttgaacagtgccaaagagtgctcaggatagcccaggaacaggccgactagaccctcttgctctctcagctctctccgttccagcatctagcctagtttcccatccctggaactcccttgtacttttcccacttggagcgtgggatgctgtgttataccctagtcaggaggaggtaaggtatgctgcagtaacaagaagtcataaaatcccagtggctggacaggtgcagtggctcacacctgtgatcccaaaactttgggaggccaaggtgggcagatagcttgaggctaagagattgagaccagcctgggcaacatggtgaaactttgtctctactaaaaatacaaaaattagctgggcgtggtggcatgcacctgtagtcccagctactcgggaggctgagcacgagaattgcttgaacccaagagacagaggttgcagtgagccgagactgcgccactgcactccagcctggacaacagcgtgagactctgtctcaaaaaaataaattaaaaggccgggcatggtgtctcatgcctgtaatcccagcacttttgagaggccgaagcgggcagatcacgaggtcaagagattgagaccatcctggccaacgtggtgaaaccccgtctctactaaaaatacaaaaattagctgggcatggtggcacgcgcctgtagtcccagctactcgggaggctgaggcaggagaattgcttaaacccaggaggcagaggttactgtgagctgagatcgtgccactgcactctagcctggcgatagagcaagacgccgtctcaaaaaaaaaaaaaaaaggaaatctcagtggcttacaagtactaggcttccttatgcccaatacatgtcgactgcacattgtgagttggtgggggctttgctgtgcatcagcgttgtctttgcttcagcatggcttttgggaacatttctggccacagtggcagagggaaagagaggcttaagtgagcccggccttggtattaaatgtcctagttgggaagtgacacacatcatttctgtccagaagtcatagatggggctgtctgccagtcacacagcctcacctagccacacagctgggaagagcaatcctgctaggagctcagaagaggggaaagggctgcagagtttggtgccagagatgctcaggtctggagtgcccacttcccccctaacctggtccctgatcacctgctggcccctctaagaaaccttccctgaccaccctgggtcttgggtgttttgaggaggcaggaggaccagaagcacaggtgtcccatgtttctctctgggccaggaaggtagagggactagggactttggagaggaagaaacatgcctggggaaaggagttccattttaggcatgttgagattgaagtgcctctgggacatctaggtttaggaggatggtcaggattagaggtggagtaatagttgaatcaggtggaataatagtaatagcagatcacctttatcaagcacttgcatgagccaggcgctgtgctaagcactctgcatgcatcatctcattaatctttgaaataatcctatgagggaaacactatttttatgccattttaccgatgaggaaaatgatgctcagagaggttaagtaaattgcccaaggtcccacagctcctaagagacagagataagactgaacctgggcagtcagactgcagagcagagaagaggggagggagagggccgaaccctggggcaggcctacccgtgtggggaaggagaaagaggagagaccagcagagggagaaggggcaggagacaggaagccagcactaaccacatgccaggtgctgggctggtgcttggcatatgtggccttagttagcgcctgtggaacaaaaggagactaagttcagatggcaggaatagaaatgggagcagaaacagggaaggaagccagccaaaggagcagacattcacaagcaggaggtgtcaccagcagtgatggatgctgcaggaaggccaagaaagatgtggcccaaaggctgttagactcagggatgggagcttgtcaagagaaggctttctgctgtgcatggggccaggagccagactgcacaagattgaggataggtgggtggtaaggaagcggaggcaggagtgtgttactatttcctgtgaaggaagggatgggagagaacaggagctggagggctgagcaggcccagagccaggcagggctggtcctttaccaaggaggaaatgtcagaaatgggcctgtggctggataagggccatgggtgccttgcctattccgcttggaccctcttcctgccaactcgatagaaaccccctcattgcatggagtccagattacgtattatatctaggaagcctttcctgaccccaccttactaggagtgattcccaccctcctctgaacccctgcattatccagcatctgtttttccatgtgacatcaatccaggagtgtaatgatataataacagtgccacgttatgtgccacacactgtgctgaataccttaaatgtgttctttcatttaatactcatgacaacctgtgatgcgtaggtggtctcatggggttcctagccatgcctttagtagctatttacatagctgtgtgtctgtattttcctcactgtgagattgtagtttcctaagagaagggtctctgacttctctctgaatcccagtgtctaggactcattccttcagtattgggtacctactgtgtgccaggcacatagttgtttgtgttgggggaggtagaccatggaatggataaaggaggattcagattcagcataagttctatacagaggagcatctgtgctttgggaacacaggagagcacaactgtgcactgtcgtggtgacattttgcaatgggtcttgaagatcatttaggagtttgctaaggaaatgggctggaggagatagttccagcatacagggtgtattattaagggaacagtgagaagctcagataggacttgggactcatgcaggggaaggttatgatacaaggctggagggacatgttggcagcagtccgtaagttgcctttaccaagctgcagaggtcggggagaggaggagcactcgggaaggaacttacttccagccggcaccattgaatttagtgattcgcgtgacctctcctgtaggacgcaggctcactgttaaggatgtcagctgtagcatctgagcagtgccacagacaagttggcccaggccctgtgctttcccttgacagggatcctgccccttctcactgaatggtcacctctgctcaggtagtttgcccctttcctgccacctctgacctccagaggctatatgctatatgtatatgctaactgctctgtacacatcaagggagtgtgcttcctatctttttttttaaaaaataggtaaaagtattcatatagttcaaaaataaaaaatatataaaaaggtttaaattgagaattatgccccacccactacagtaactaattttataaatctcttgtgtatccttatagagtttctataggagaatataaacaaatactttttcttgcacaaaaggtggcatacagtacattctttttacctcctaatgtgtcttagagatcattttatatcaaatttatctatatctagacattatatctcgatataaattatagacttatttctgagtctgtatctgtatcagatatttctttctttctcttttttttttttttttttttttttttgagacagagttttgctctttttgcccaggctgaagtgcagtggcgtgatctcagctcactgcaacctccgcctcccggattcaagtgattctcctgcctcaggctcccgaatagctgggattataggcatgcaccaccacactcggcttatttttgtattttgagtagagacggggtttcaccatgttggccaggctggtctcgaactcctgacctcaggtgatccaccctcctcggcctcccaaaatgctggaattataggcatgagccaccatgcctggcctatatcattttacttaacagctgtatttagtcttccatgatgtgacacacactaacttattaaccagtctccacttgattgatattttggttgtttccaatcttctgtgactgcagacaatactatacttaataatcttgtgtgtgttactttgtatatgtgaaagagaaattctcctaaatgtaagcattggatcaaaagataaatgcctttctaattttgatagacatggccaaattgttcataagggttttaccaatttatactcccacatgtcattagactgcctccttcaccatagacttgccaaaagtgtgctgtatatttgttgtatgtttttgtcattggggtaggtgagaagtggtatctcagtggagttctgatttgtatttctctgtgattatgagtgaggctgagcattatccatatctttaggattctgtattgggttctgtttgggggtcttgggagactaggatcttcaccccatttcccagatttggaagctcaggccatggagctccacgtaaatggagctagacctgaagtgtgaccggctccatagcccacccttacttgctttgcagacaagcatgagacgaagctgaagggagtcatctatttccaggccattgaggaagtgtactacgaccacctgcgcagtgcagccaaggtcaggggtggagggcaccagaggggggccagagggacagccatggggaaggggtggcctggtggggctctgggagcaaaggcctccagcctgccctctacagaggctccaacccagtccttgttctctttgtcaactttctcttcctttctccctctccccttcccagaagaggtttttccgcttcactatggtgactgaggtacccctccccacttagctgtaaccagcacattaacacctcctgtaccccactcatccctgacccttgacctccccttcatccccctcccttcccccaggcccaagggaggagcagaaagcaggttgcaaagagcaagaagctcctgtgggcttgggtgcctctctctccttgttgcctccctctcctggaaatgacagcagaccccatgggggtctggtgatagagaagggatggccggaaggggtggaggggacccttaaagactagatttaatagggagaaattgataaacaggagatattggaggctggggcctgcttccctagtgcaagtcagccttcctgcccccagccctctggtgcccaccccagtcctgatctctgctcctctggggtcccagggcctggcatcctacttgttgctttttctgtctgccgctgttttgctgagaggaaactctggtcctcactggaaaagcctttgtgtttgatcctcttgatactcacttttgaacctggggcgccaaggaccagtgccccccttgtcagggtatagctctgtcagggtccagggagtttagagagcccaggactgctgtggtgtgagaagggaacatttcagcctggggctcacatggactggtagggtctaggctctggacctatttaggactaagctccagggctttctaggggctgggaggggaaagggcagatagggaggcaggtgagaatattcctgggcatgggtgagccccatcttagaccttcctctcttcctttggcagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtg

SEQ ID NO: 37632 - DNA, 117519 bp, Homo sapiens
caccctcacccctcctccacccctactcagctttctattcaacaagtgagagcaagggcggggaagaaagccgacaggggagaggattgcttccctttcttttcccattcccccttaagacgaaccaggaagtaaccgcaagaatcgggccaccttaacagtagagtaatggtttggcctcgcgccaagtcccacctctgttccagctcctgctcctcccctctctcttcccgcactgcttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagaggtaggcttgcagagaatgaattgacttgtgatttgcaaactttgtttctttcttttctctcaatggcttctaaaactccccgattttcctctttctagaatatttcatgcgactgggtttggaggattttttttaaaatatgtgtgtgtgcacagatttgtcaaatactgttttacctattatcagttctgagaaaccatatagtcgaacaagtgatttatctctcttttcctagttcttgtcattcctgggctatggggtagggtaatggagggttctctttttgacaccaaaattgagctcttggaaaaaatatttatctcccctccctcaacccattccgttcctgccctccccttccccccttggcttgggaatgagacgcaggatggaaaactgttgcaaaaatattttccgtgtctgttccctttctcgaaagcccaaaagagagatggaaaaaaaaaaaaaaaaggaaccaaagaaatcttcagcagaaagaggggctgcagcgggaactaggagaggggcactttggggccatggggtggaggtgggctgggagaagttggcaggagtggggaaggagagtgcacgaattaaatttctttagctttgcagagaaacctcagcagtttctctgtgctgcttgcaaaacatcctcagactttcacatgtataattagctgtggaaaaagctgggagttacctcgtaccgctgttgtttgagtgtgtgtgagcgtccagaaccaactgtatgagtgtctccgagggcaccgccccacacatctctggtcccaaaggggaggaaggagaagggtgaattgaaaagtttccgatgtcgaggctggacactgtggggctggtgagtgtttggcagatggggtgggccacaggcatctgtggaaggatccctgagcgtctcgggccactgccttggcttgctgaagagctaggaattaagactgggattgtccttcctgctctcccttctctctttcttttacatacttggctcgctcttggtagagggggctgctggcatccttccccgagtcgagtctggcctcttacactcctccacctccctgagggtacccgccgctcttctccaactgggtgtggagggtgcaggagtggccagccgcatcttgggaggggagtgggcactctgctgccagaggcacgtccctcctgggcattcctgccggacttaacaataacttgcagacgtgatgccggcgcctgctggccgggcagggggaatgtcagatgaagaaataggccggtactcaactgaggcccctgtggagaggggaaaggagtgggggagggaagggaaacaaaatcccattctgcagcgcccccctcctctgtgtgaggagtctggcagggagtctagagaccctggccctgctccttaagcccctccccaagctgccccttctccacgcgcttcccattggaggccctactacgccccctccactctgagccctctacctggaggaaggagaccaggctcattccaggctgggccaggcccaggaaagcagcctgggagtgacgaggggctgggccaggagtgtttaggaagaaggggagtggaagaggcctcctagcccatgtgctgagttaccctccttggctgagggtggtggcttggggagcagactctgggaggggcaggaaggatggtggcagcttggtaaggcgtgttctggaaggtgggccctaaaccctgaagcagacaaatctgtgggaatcaggctgggggagaggaaacacctgccttcagccccagggcttggaggagtggtaaaggctacagctgagacactgcgggagaaggaagtaaaacacttagaggagagctcatctcggggctggggatgcaacaggaacgatttgattttcactttgaggtgttgattgatctgactgcacccctcggctagacagctcttccctacctgtgttctgctcgagaagggaatgaggccttccccagtgggcagggcccccaagacagaattaatgcccgtgttctggagggaggggatccatttctatactcctcctcgggagtcccatcctccctgccaccatcttgctgaggtgcaacctcgaaaatcacgccgctttcgccgcggcctcccatcgtggaggctcagagtgcagctattcctgcagccggccttcctattttcagtaatctgattaggggtcgatgttggtgggctcggggacggcttctccgtgaggtcgttatttagcgcgcaccgggtcgcctgagcccggggtcgcggccaaaggggtaatcggctcccgcagtctcagcccttcccccggggctcggggcaggattgactgcgcaaccctgcggcccctgtgctctccgcggcctctgcgaccccgccccgccagcctctccgccgctgggctccaccctcccgggctctgctgtagtctgagaactccgtggagaatgcgaaccgagcggcgaacggaggcttcctgcctcccaggttgtgccgagcctcagacccttctcccttccatttaccaccaagtctctagattcaaggtcaagtcaaaggagcacagcccgtcttacccctgggactcccagcgcccagcacggagcctgggatgttagagcgctgggtcaaggcatgttgagagaagcacgggcagtttgggggccttggaatcagcctgacgccagcgagttcctaacccgccgtctggcctccagtttcccctctgcacaatggaaagcctgctctccacggtagaggtgacagggcgtggctaggcagatttgtcacactgctgtggtctttgtcagaagaaaatcaaaatgagagggcccagttaggggcagaaggagagcagttagaatttgccgaaggtgtgggggctggaagaggtaaggtgatgtgtaggggctggatgtcctgggccaggatatcgggaggctttactcttccccactcccactaaccggaggtcccgagaggaacggggtctgggctgctccctgccacctgtcagcaggtcaagccttccaccggaaactgccccttattcaagaatttagcttctctcaaaaactccgaaaccccttttctctctctctctctctctctcttttttttttttttttttcaatgctcctggccttggacccagcacccaaagacatggattagccctatccactaggacagagcattgcagacccactaagccttggagagagaaaaggatcttgttcattcttagtccccagaatgaccaagacaaaccccgttagccaaacccctaaaaaactgtttggcttaggttagattagctccaagtgtttgaccttgaaggggaacaccccacccagagtcttaactatccttctctggaaggattcttcaggcaatctgaattcttcccccgaagggcgcccctcagacaaggctccctacccagcccagttccctgcttctcagataagcattgattcctgtcatcccagtgggtatttggtgggtaggggtgagaaggaaagagggatgagaaaagcaaggcctctgccttgtcagactgggatgacaacctttctccactcatgtccccttttctgcaggtcataggattagagcaggccctggggctggagtccaaaatgcttgtgtggaatgttttgcccttggcttcctctgccagtatctctccttgtgtcctctttcctctttcccttgtgtgagccattcttgttccactgacttatttcctctgtacatgttaaaacagaaatgacagggactttctatttctgcctctaccttaagccagtcctctgtgttcagcctacatgaacttgagttgaggagggaaaccaggcaggatctagtgaggaccagagccaagggctctgggtcagggaagaggcttgagaggcagtctatgtgtgaaggatagtggagaggccaaaggaaaggaaaggattgagaacataggtgccaaggggcagagcccccatttctacctttcctcaccccagttcctctctgcctaagatcctcagcctcattactcacctctgctctagtttcccaagtttcatgcacaaatccctgggacaactcagggaagatgaactgggatgggattactaagacccccttcctcttgcctttctgccacttcacttggggtgtggcaaagggagtttggagcagtgcgtttattggtaggaaggtcagggactctcagctaggttcaaggaaagtcttagcttagaacacctcatggcaaggtctacctaggttgcgaaatcaatgccaggaatacaaacaagtagtataccctcaatactaacagcccatctaacatcccaggctccgtgctgggcgctgggagtcccaggggtaagacgggctgttagtattgagcccgggaagttagcaatatctaacaaagctacgtacacatttacccagcaatcctacgtctaggaatttatccagaaggtgctcattcacaaatatggaaagctacgtacaaggtgatttttgtttgtttgtttgtttgttttttgagacagagtctcgctctgtcgcccaggctggagtgcagcggcgcgatctcagctcactgtaagctctgccttccgggttcaagcaattctcctgtctcagcctcgtgagtagctgggattacaagtgctagccaccacaccggctaattttttgtattttaatagagatggggtttcaccgtgttgcccaggctggtctcaaactcctgagctcaggcaatctacctgcctgagctgggattataggtgtgagccaccaagcccagccacaaggtggtttttaaaggcatatttacaataggaaatcattggaaactatccaaatgcccattctttaaaaaatggttaaacaaacaatggtacagtccatacaatagaatcctaggtagccaaaaagaaaaaaaaaagaatgactaggagccctgtgaacttatatgacatgattgttaggatatattattaagtgaaaaaaccaagacatagtacagtatatagtatgccacctttgggataagaaagcaggagaagtaagaaatttttttttttttgagacagagtctcgctctgttgcccaggctggagtgcggtggtgggatctcggctcactgcaagctctgccgcccgggttcacgccattctcctgccttatcttcctgagtagctgggactacaggcgcctgccaccacgcccggctaattttttgtatttttagtagagacagggtttcaccatgttagccaggatggtttcgatctcccgacctcatgatccgcccacctcagcctcccaaagtgctgggattacaggcgtgagccaccacgcctggcctaatttaagtactttttaaccttcattccctgattctatattcatattttaagtaaaaaaaaaaaaaaaaaccacctacaaagaaatcttgacctttactttgtagacatgttattggttgtggtatttgtgtcataaattggaaactgtttcgtttattgtatgatagatgaaatgagtaactatggtgatatttctggaaatcagggtctcactatggaaaaagagagatataagtatggaatgggggaaggggaaaaagaatctttcggggtttttttgtatatcttgtgggtctgtccactgaaaggactgtggaaaggaacacacctagtacctggatttttatttctaagtacaacttcccacgggggaggttgtaaggaacagtgctccttgaaaaaatgactaatttcaagtctgagactgggaaagtataagtgaactgtgttgtgccagaaactagagcatgctcatgtcatgacatgttgtcacaggagctggcttaaagggtctcccgccaaccagaggtgaaacacattaagcattccaaaggataatggtaatagattgtaacacattgaatattaaaaattccttgagtctattttgacagttgacatggacagggaggagcagggagggaaaactctgaacagaaatgccaacgaggccagacacaaggcctcactctgtaatcctaccacactgggaggccagggcaggaggatcgctggagcccaggcgtttgaggctcccatgagctctgatcatgacactgcactctagaatgggtgataaagcaagactcagtctcaaaaaattaaaaagtaaatgccagttgggcgcagtggctcatacctgtaatcccagcactttgggaagcccaggcaggtggattacttgaggtcaggagtttgagaccagcctggccaacatggtgaaaccctgtctctactaaaaatataaaaattagccggaaatcgattgaactcaggaggcagaggttgcagtaagccaagattgtgccactgcacttccagtgggagacagagcgagactccatatcagataaataaataaataaataaataaataaataaagtaaatgccaactaataaaatctagtagtaatgacaagatttttctttaaatttaattttatgtgaggctgaggtgggtagatcacctgaggtcgggagttttagactagcctgaccaatatggagaaaccccgtctctactaaaaatacaaaattagccgggcgtggtagtgcatgcctataatcccagctactcgggaggctgaggcaggagaatcgcttgaacctgggaggcggaggttgcagtgagccaagatcacactattgcactccagcctgggcaagaagagtgaaactccgtctcaaaaaaaatttttttaaatttaattttaatagaaaaatactagtttcatatatgtatggggtgtaatgtgatgttttgatatatgcatacattacggaacgattaagtcaaactatcaacatatccatcacctcacacatttatcgttgtttttgtagtgtaaacatttaaaatctctcttagcaattctgaaacatgcattacattaactatagtcaccatgtagtgcagtaaatctcagaaacattccttctgtctactgaaactttgcatcttttagccaacattatctttatttacctacctatttttagagatagggtctcactctgtcagccatgttggagtgcagtggcccatagccttgaactcctaggctcaagcgatcctcttgcctcagcctcccaaagcaccaggataatgggtgagacacagtgccagactggaactttaaattgaccagtttgcagcctctactataatagctgatttagtctagcgtttaatggatactaaaaccactgggtgaaagattggtcttagcatatcttagtttgggctgctaaaacaacatcatagactgggtggcttaagcaacagaaatgcatctctttgtttgtttgtttgtttttgagaccgggtcttgctttatcatccagctggagtgcagtggcacaatcacaactcacagcagccttgatctcctgggctcaagctatcctcccacctcagcctcccaagtacctaggactacaggcgcatgctatcatgcctggctaattttcatattttttgtagagacggggtttcaccgtgttgtccagattgggctcgaaatcctgggctcaagcaatccacctgcttcagcttcccaaagtgcggggattacaggcatgaaccaccgcacccggccccatttatttatttatttattattttttgagatggagttttgctcttgttgcccaggctggagtgcaatgctgcaaactcagctcaccgcaacctccgcctcctgatttcaaacgattctcctgcctcagcctcctgagtagctgggattacaggcatgtaccactacacccggctaattttgtatttttagtagagacgaggtttctccatgttggtcaggctggtctcaaactcccaacctcaggtgatccaccctcctcagcctcccaaagtgctgggattgcaggtttgagctatcacactcagcccccatttatttttgaaacagggccttgttctgtcacccagactggggtgcagtggtgcagtcatagctcactgcagcctcaaactcccaggttcaagcaatcctccgacctcagcctcccaagtaactggagcaggtgcatgccaccatggctggctaatttttttgttgttattgttgttttgtttttttgtagagatggatgacataggaagactccacctctacaaaataaaaaattagctgggcatggaggctgtgcacctgtctgtagtcctagctactcagcaggctgaggcaggaggataacttgaggctgcagtgagccgtgatcatgaaactatactccagcctgttgacagagtgagaccctgtctcaaaaaaaaaaggtgaaactaagtaaagggtctgcagttgtttattgtgctatttttttcaacctttcaggtttgaaatttttccaaatacttagccagagagagaagtccatgccagaggcactcctagattcctggtttcttctcactttatctgcaaaactcctgaccaataggagtgtcttttctaagctcttgggtgctgagagtccccatggagcacacagagggatcttctaagaaagtaaggtcctttaggaagcctaccttcccaccctcactgctccccacccacagcctctcctgtccagacaggagcacctgggccctgatgagtgggccacaaagggaggtaggatgacaggcattctcccaccatgccatggggccagctgagggaacctggggactgagggcttccagagtcacccacctaacttttgaggagacaggtcccaggctgtaagagaagaaattcaccaaacagcccagagattgttgctgaccaaacctttagtgtcccttagaattctctaattaggtgattctgaaagaaaccagcaagcagtgcctgcctggagccttcatgcctgagctaagcaaggccttctaggcactcccttggcaagggcagcacacctggctgtcctgtcattgacccaaatcattgtgctacccacccccgcctccccatcctgatcgtcgctctggagagagattgagtttccaggatggcttctctctctctttttctccctctcttctcctggaaaccctggggctaggccctacatgactcagggctctttttacgtaggctcatgtaggtgacggctattaatcctttagtcaattccccttctgtgttggtgagggagcctgaaagagcgggagccaggaagttggaagggggcagacagggaggagtttgttctagtgggctgccaggcttgccagaagagcacgggactgggagtcagaaaactggtaatctggactcttgtctgctgtgtaaccttgattgaagcaggggatatctctgggccttcatcaactgcactgttacatgaaaccaagtttggacatacagacattcctgattcaagaccctcctcttctatagaagacaaaggagtaaaactctcaatgcccaaaccaaactcttttatcacagatagagtctagcacaatgtaacaatttgcagccaagtcccatccttctgcccaggatgaccaggggaaaagaggccaaaaagcatatggctttgaactgccaccattgatgtttgggagtagaacaggttctaagatttcccacctccacctgccgggaacttcaattaggaagtaccttccaaggccgtaattctgctatgtcctaggccagaaactaaggaatattagctagaggtagagaaattcaaactttcacaaagtttcctagggcacataatccccccaaaagttattatattgaaccatatgaaaatgccaatatacggctgggtgcggtggctcacgcctgtaatcccagcactttggaaggccgaggcaggcggatcacgaggtcaggagattgaaaccatcctggctaacacggtgaagccccgtctctactaaaaatagaaaaaattagccgggcgaggtggcaggcgcctgtagtcccagctactggggaggctgaggcaggagaatggcgtgaacccccgggggggggcggagcctgcagtgagccgagatcgcaccactgcactccagcctgggtgacagagcaagactctgtctcaaaaaaaaaaaaaaaaaaagccaatatacaaccacttttgacctacaaaggcaatttcatgtagctcacctaacaatattattcgacactggaataatgtcagtggcattacagtcagtgttgtgagctgcagagattaggttttcatctgagctgtgggttggattagaaattcaggcaaagttgccagctgctaggccagcttaccctccttgccaatccagactttcagccctagaggtagacatgttggcagagcccttgtttggactctggttgagattctagcattagccttcctggcaactggccagggaagctgcccaaggtagagaggaatgtatcatccatctatagtctgcttttcttgtgtcccaaatgccctgcttcctatcttgggagctgaagacggaggaaaatttaagaaaggaggaaatggaaatactggccctattcatcctctgtctagtgggatacaagagcgggaacacacacttgaaatctcatctggtgcagggacacatgacctagtgatggctggtaactgctaataggatggctgggggctgaaggggtcttagtgggaatggggagactagaatttggcagggctcaactggaaattattcatggaggaggtgattgccaaacaggattttaaagagaaaggacagatttgatggaggaggggaggggagatggggaggaaggggtgtgctgctaccacccgactgaggacactcagagcatcctggagaatcggatactctggcaggtgagggaggctgtctgatcccactcgctggaaggcctccagcctttgtctgagccagtaccggtactgtgggcaggatggcatctggcctcagcagcggcctgccacctgtctgctttcctggcacttatggaccattaggatgattttttgatgttttctccctgctgtccatattacagccttctttgtggggagcactcgtacgacatctgttaggatgcaaggacaggcacagcaagcagcaagcatccattccaggagctttctgaccttgtacaggggaggacggtcaccaggctttgggcttgtcaccaggctcattttactgagacagagcatttgagatggacagagaactggcacctcgagacttgcccaaagacactgggttagtttgaggcagaggtgggggtacagcctagttctccccactccaagactgggacctcgaccccatcactgcaacactgtgtgaccagatcaacaccaaacttccctggttcccaatgtctctacccacatggcagagagaactatccccgtccctccaaggttgatgtgaggtcatgtgctaggagcagtttggaagacagattctagaaaccataaaggtgctggtggcatgattgttactgttgctgttattattaacaattaaggtcattagcacacagaaaatgcaaagaagtatttggcactgcccgtatcaccgtgcagctcctaacagtcccctccatggctcctcctcgcacactgggccttgagctgagagaggcagagtaattgagaggggaagcagaagtcctgggaagaggtgtgcagagatctcctcctgccggggtattcttggccctacgctttcctcagggtgtgcctcctccaaaaggtcagaggaagtgcagaggggaaggaggggaagcactattaactccatccttccttagcagctgactaagtcaggttggctgctgagctctgatttgggatctaagagtcaagagggcggggccaccataatgtgacagcacaggctgatttgattgccagagccaatctgtcattcatttgcttgttcacttatccatttatttatccaacaaacatgaagcgagcacagaccatatgccaagcactatgttaagggtttgggaagaagtggtatccgggaggcaaaggaagggctcagcatcactgatgttaagctcagggatgattgtcccaagcctggggactcacagcaagccccgcttgttggtagtgctctagggagtttgcatctgtttccctggagagcacatttaacccttgacttcagggaggtaagatctagacccgacgcacaactgagctggtaggggccttagatatcattgcagggcagcccctggtgttagcagtgagaccatggcctgaatggtaaagggcttgcgcttgtcctttgctgaagaaagccttctcctggaccagggcatggtgccgaagctgggtgtgggtccagcctggtttattcagccgctcggttggcctcccagtgttacctgactttaccatcccctgcttatatccggagcctctgcctctgatggggtggagatgttctgttgctgggatgcccagaggaatccaaatggtactgagaaatagaacaatacctctccagagaagccctccagttcctcctccagtctttacctctcatttcagcctcttaatccctattttcagaggcaatgtggtataaaggataaaggagtggatttagcttcagttggtacatgctgtacacatctgcacctagcctgagttttgccctctttaaagtttgtataatatcgcctttcattacttaccccatagagtgttatgacagacaaataaggtattgtaggtaaaagcatcccataaacattaaagtgctagatatacgtaaagcttattattccggtgaccccctcttcctattccccactcttcatctcagttccttctcttgactgcccaaccccttgaccccactcccaagaacatcctcctgttctctgtgtgttcccactcctgctctcactgcatcctccctccttgcttagatcaagatctaaaacacttgttgcatccttttttgagacagggtttcactcccatcgcccaggctggagtacagtggcacaatcatggctcactgcaacctcaacttcctaggatcaggtgattctcccacctcagcctcccttgtaactgggactacaagtgcgtgccaccatgcccagctaattttttttttttgaatttttagtagaggtggggtttcgccatgttgcccaggctggtctcaaactcctggtctcaagcaatctgcccaccttggccccccagagtgctgggattagaggtgtgagccactgcaccctgctcttgtcacatcttaaataacaatgacattggtagaagtaataatcgagctaacatttattatttatgtgataggtattaaacttgaatcatctcatttaatattctcagtgaacagtgaggtcgatattagcattgtcttcattttccacatgataaagatgttcataaaccataaggctaagatgcacccttagtttagcccatttatagatttcctctttccatggctgagtgactgactggttgacaagaacatgggaagtttcaacagcatttattgaatgtcgactaaatgccagatgcttccaaattatgtcacaacaaccaccttctgagacaggtacaggctttttcttggagatcatctggttgtgagaatagaagcctactcagagaagcaaaagtaaaagggagctttattaggccattacagggaaatagcacagaacttaggtgtgggaagtgtagcccctctgtgagccacacctacatcctggagctgtagcactctcttcttcacagatgggctcctgctctttcatccacaagcacaggacccattgtgggtgaaccaggcagtaggttccatctgtcagtccatgtggccttcccacttagctctccgaagtaaattaactcggtctctcagtccaaacgccaacagatgctgattccagcttagatctgatgtcctctgcactccagtgatctgtggcttgtggcaggggagggagactaatcaggcctatctttttcatcaggtctaggggtgggagcagacatttctagagggaaaattcattggctttaggttgattcaacccaactacattcttcaccacaccagactctctctaggatatcttaaagataatgctctggttgaagcccctaaataagagggcatgcgagttgtcccagaatctgtggattcagctgggactggaaaaatagtactaaccatttttgaaccctgctttgtgccagccgattaatatacattatctgtaatccttactacactcttacaacatgctatggttcccattttacagataagaaagctaacactccgtgagttaaatagcttgcccagagatcatctggctcattagggttggggctgatatgtgacccaggcctgacaccaaagctcacggcccttctaatacacaaaaaaaggttatttactctcctggaagataagctccatgagagcaatggtcttcgccttgctcattgatatatcccaagtgcccagaacagtatttggcacatagtaagtactcaataaaaagttatttagtggattttgctttggtaacttttgtattcctaggcttcccaatgtcagagggaaaaatgactcagacagtgggccactgagaacagtggggtaaccctctgggcgtgcttctggtccctaacccccacagcctactgtgttttgtttttgttttgttttttgtttttagagacaggatctcactttttcgcccaggctggagtgtaatggtgtcatcatggctctctgtagcctccaactcctgggctcaagggatcctcccaactcaacctcctgagtagctgggactacaggtgtgcaccaccacacccagcaaattaaaaaaaaattttttttagaaatgggtcttgctatgttgctcaggctggtctcaaacttctgggctcaagcaatccacctgcctctgcctcccaaagtgctgggattacaggcgtgaaacactgcacctggcctcacagtctgctttgatgggggacattaggagcaatatagaaaagtctgaaagaaagtatgaccctggatttatctgtgttttctgtttgtatttctgacctaagccatttagccctgtaagaggagcagatgaaaagagatttccttaacactggaaaatccatttactgggactaggaaacaggatgctgaagtcttatattgatatagcaaagaatgctaatttccactgggttttcagccccgggggtcagagcttaccaaatcctgaatccattcctgtgcctttctgtataaaaatgccctgtgtcctaaatcacctagttggccttccaatcccagcaggtggtgttatataaaagtgcagatttgagggagtctgatggaactggattcaagtctggctggccagctgtgtgaccgtggacaaattatttaggctctcagactcaatttcctctggaaaatatgaacacacacaaatgaagagtgatacatgttctgagtgcctggctcactactatgagccagggtagtcatcgaattttaatttttcctatcttgtccctccatttctcccttccttttccatggagcctggcaccagcctgcccacctgctccctgctaacctttgggctcagtacatttataaaagggtcatagcccactgtctccccgtagcgaaaggcccagaggccccagcctcctgcaactctccatcaaagggcatgcaggggctccatcatttccatgagacaggttaccctcttggtgccagctctagggctttgcttgatatttgagcaagaagagtcctggtgaaataaggcagagtggagggtagagagctgcaaccacctcaccttgtttactcgtgccctgcattcctcccctgggagtagcggctgtagaagtcaatgctgggaaatctcttgttgatggagggagtcagactgggtgacaacactacttgtttttgtagaagctgtagcccaagggtgctatcactatttggtcacccagatcaactgtcagctgcactggaattgagctgcccctggataaacaagcaagagagtctcaggctggaatctcccctgcttttcccagcacacacccacgcagagactttagctggcaagaagtggcagcttagccaagataatgcgtgaaccagaacttgcctttcctggctggaaggggcttggcattaagtgcagttcttgctcctgcttcctatagatcacttaagtgctccaggctctcttggaacagggggaattctctggtcccctcccagtttctcagggatggcatccaatgatgggagatggtttcagatgcagtgacttgcagacaagggtgtgaatattagctgagagttcatgtgaacaggcttatggcagcatggtttctgagatgcagcgacttgttggttttggctgcagcgttttcactgagcccactcatcagcctgcaagctacttgaaaggagagtgatgctttagtcattcctatatactcggtgtttagcacagtctttggctcatagaatgaggatcagtaaagaacggatagatgggccgggtgtggtggctcatgtttgtaatctcagcactttgggaggccgaggagggtggatcacctaacattaggggttcgaggccagcttggccaacatgatgaaaacccatctctactaaaagtacaaaaatcagccagatgttgtggcaagtgcctatagtctcagctactcaggagactgaggcaggagaattgcttgaaccctggaggcagaggtggcagtaagccgagatcatgccatggcactccagcctgggcagcagagcaagactccatcttaaaaaaaaaaaaaaaaaaaaaagaatgcttggatggatggatggatataaacaaatagaaaattttctctaaacaaacagaccacagtgaactttaccttcttccttcccagggccaccctccctgctcaaaacctcatcatctcatgcctgaataattgcaaagccttcctaatgacaggcagggtggtctagagaagtgagttccagactggaagttgggaaacctggaacttgagccacttaagttgttctgtcacttttgggaaatcactgaacctttctgggcttcaatttgttcagatgtaaaatgaagagttagggctaaatgtacttctaggatgtttcaactctaacattctctgcttcctcctacccaaacaatgctgcagattaattatagttgggtaccaacatttaaaagtaagatctcactgctgtcttgctcagctgggcttcagtgacagagactggtgacatcttcctaggaagttggtgaccggagttgaaacaatggccagttccccaggagacttggcttaggaattggtctcctagaattattgagcccttatctaaggaagctccacctttcactctccctcttcaaactcatgctgggagcttgtgcggctccctgcagccccgctctgtatgactctatgtggccactatgccaaggtggagaggaggtctggactgcatttggaatcctggtaatggtggtgattctctttttacttctttgtggtgtccaacatcctctagtgtcactggcacaaaacaggtcaggctattggaaggccacactgcttaacaacaatgtcaggagatccaggctctcagctatattcagattagtgaagtgtacattctcctaacttgctcagcttatctcctgcacctagtgctataaacagttgtgtttcagagctccccaggctggccaaatccatagttccaatccccaaagtcccttgtctaaatggggtctaacttccgccccagtttaacccagggctgtttctgactcagcccctgtcatcctgcctgggccctaggcaacactgcctctctaatgccctagccagacagagcattcctgtttacccaactcacagactctccctactttctgagttatatgcttttcttctgctagttgctttatagcttggtccattattctgtgatctaatctacctagttttgtgaggggtttttttattttgttttgtttttcatttaaaaagcatctatattttctttcatcagctttgcatttatcacagtcatcactcctcattcaacacccttcccagcttatactcccttttctttcttttttttttttttttctggagatggaatcttactctgtcacccaggctggaatgcagtggcataatctcggctcactgcaactccgcctcctgggttcaagcgattctcctgcctcagcctcccaagtagctggaattacaagtgcctgccactgtgcccggctaatttttgtatttttagtagagacagggttccaccatcttggtcaggatggtcttgaactcctgacctcgtgatccatctgcctcagcctcccaaattgctgggattacaggcgtgagccaccgtgcccggccgtatattgccttttcataggaacgttgacatagttaaaccctaccttatcgtatgatcattcttgtttcagccacttttagagacaccacgtttcgaggagggcttttgttgttttctcggtgtactttaatccaaatggcaaatttttagccaggtggttattttttaagaatatttactttttttccagagtataaaagtaatatgtaaaaaggatctcacatatactgagcacttactatatttcaggcaccaagacacatgctaaaactgcatgacctcattccctcctcatgacaatcctaataaggaaggagtcattcctatcttccctttcaaaaaaagaaagtaaggctcaagagataaaatacttttatccaagttcccacagctaccaagtggtggttgtggaattcaaaccatggctctcaaacttcagagtccaagggtgcagtggcacgtgtctgtagtccagcactttgagaggttgaggcagaagaattgcttgagtccaggagtttgaatccatcttgggcgatataatgagaacccatctctaaaaaataaaaaatataaaaataaaaaaacagtcgaccaggcacagtggctcacgcctgtaatcccagcaccttgggaggccaaggtgggtggatcacctgaggtcagtgttcaagaccagcctggttaacatgatgaaactccatctctgctaaaaacacaaaaattagccaggcgtggtggcacatacctgtaatcccagctacttgggaggctgaggcaggagaatcacttgaacctgggaggcggaggttacagtgagccgagattgtgccactgcacttcagcctggtgacagagcgagactccatctcaaaaaaaataaataaaaataaaaaaagattctgagctatgtactgcctctacacaggatcatcctagaaagtgtggaatattcagaaaagcatgaagagaaaactaaaacgttcacaagtccagacataactgctaacattttggtgtagtctcttttagtcttttatatacgtgggtgagtatatacattttttaaacaaaattgggaacacgttgcataataagattttgatttaatttttttttcctacccaatactagatcatgagcattttcccacatcataaagaattggtcacaagtcagccccaaacatagtccagtggaatccaatgatagcaggcaaccagaggcaaagtatctgtggttttagaagggaaataaagaagctgatgggctgggcacaatggcccatacctgtaatcccagcactttgggaggctgaggcttgaggccagggttttaagaccagtctgggcaacttagtgagactccgtcacttaaaaaaataaaaaataaaaaaattagccaggtgtggtgatgcacacctgtagtcccagctactcaggagactgaggcgggaggatcccttgagtccagggctttgaggctgtagtgagctctgattgcaccactgcgctccagcctcggcaatagagcaagaacttctctctaaaaaaaacagaaaataacaacaacaacaaaaaaaacaaacggctggacacagtggctcatgtctataatcccaacactttgggaggcaaagcgggagaattgcttgatcccaagagttcgagaccagcctgggcaccatagtcagaccccatctctacaaaaagtatgaaaattagctgagcgtggtagtgcatgtctgtggtctcagttactcgggaggctgaggtgggaggcttgcttgagtccaggaggttgaggctgcagagaaccaagatcgtgccactgtactccaccctaggcaacagagggagactctgtcttaaaaaatttaaatatatgaagaaatgattaggaaaaaaaaaagtgctgatggccatagcctttgctttggaagctgaccacctggagccagcctaggtggtgcacagggtctgatcctgggatgagaaatcagagaggggagaaggcttggaactcttgggtcacctttgggaggtactttcctctatgtgtctggatctcacatgaaggtgtgagaagatgggcaggccaacttgtgtttgaagtgggagtcaaaatgtaaagtggcttttacacaggctcagctaaaggccaggcttctagaataagatgtggaacaccctaaataaagccccctgtaaatctgtgagtgagattactcattcatggtggagaggctggctcctgctggtgatttgggttctcatgctggcctgtgattggagagaaccataaagatttcctgccttcattctcttaaatgtatatgtgtgaaagagaagctaagtatattttatctgcagctatatttttaaagaaaagaagtgttttttttaaaaaaaaaatccaagaatagcacaagaaggggcagagagaaaggaagatctggaggctgtcaccagccaaaagataattagcaaccatggggctggggacaaagacaatgtctagtgtctatgatgggacactagatgggaaagtccctgtgcttgtggtgggccacttgacaccccttggcagttaggtggctttggaatgacagcccgaggtgccagcctcttggaggttgtaccaactgactgctacaaattcaagagtgataaagagtactggtggcctccatgacagatacaggcttgtccaaggcacctgttcggtgcaggatccagggccaggacatggagtcttgggttcacccatgagctggtaccaccttttgccatgactctggggaaggcttgggctactctgtgctcgtagtttgtcccctggcccataccaaggtttcacccctccaccttcctcctttctgggcatcttgaggacagaaatgagaaaaatggagagagatgctttgggtttccattatgaatatagagagtttttcatcattacattggttatctcagaacctcaggggtaaccaatgtaatgcaatgcatgggaaggaaatggggtattattgttgaacatgccacttaactgctgcagccttttcactctccttaaaatatcagataatatcctcttgaataccttacagggtaaggtaagtgacaagaatcacttgaaatactggatatgaaagtgctttgtatatcatggagtgcctacaaatatacagattcgtatttatggagatttttgcatgggaaagtccctccttactcccctgaggttggggagaccattcatttctccagctcctataaaatttgagtcctctttcttgagtagggtggcttctctccacgctgtagaatgggagagtgaattccagttaagtgcgaatgatgtgttcaaagtgggtgaaaaatcttggaatcttggggcattaaaaagaattccttaatttatttccattcttgaccaagctagtaggtaacagtgtgaccttgagcaagtcacttaacctctgagcctcacttttctcattcgtcattagtttgtatccacaaatgatagttatgataatctaaggagagagtatggaatctaaatggaagtgctttgaaaagttaaaagtgcttcactttagggtgggcgtagtggttcacgcctataatcccagttctttgggaggctgagaatagcttgagcccaggagttcgagaccagtctgagtaacatggggaaaccccatctctaccaaaaccaaaacaaacaaaacaaaacaaaacaaaaaaatagccaggcctggtgatgcatacctgtagtcccagctactcaagaggctgaggtgggaggatcactgagcccaggaaggttgaggctgcagtgagccttaatcatgccactgtactccagcctgggcaacagagaccctgtctaaaaaacaagcaaaaaaccaagtgctgtactttacagaccagaaaaattgaggtcacggaaactccacagcccccactcgtacccggccaggcatgtcacactcgccactctggggcccagggtccccatacgctaagtagggtgtgctccaggttacctccccttcttccagagctgctgaggactaatgagaacactcacttgtagacgctgtaatagcctgttttgaagcatctcagatttaccccagccttcccttccatggtgatgtaaacggagtggctttcacgcacacatcccagaaccagcccagtttttgcccttgtcctctgacataatgcatgcattgatcaatagacatttatcaagcatgcctgccccgtaaagcttggagcgaggccctggtcccctgggttttggcagctcaaggacgggcgctcccggggaagctgtgctgagaagtcggctgagccactgaagccacagggtttggtttcagggaggccaggtgaggggcagggtgagaactgggagggttccccaggtgtgttccccgggttgtggtgtggtgtgatgtggtgggggacaggacgagggtccctggggagggagagaggtgcttggctggctgggtcgagtgagtcatcggccccctctgagcaatcgctgctgcccaggtggagtcggcccgccttatttggggcttctgtgctgagccaggcctccagggctaaggcgtttgtttccccagctgcttcccgggccgcgctggtagccagctgagcccggcgcctgcggctgagttgcaccgcgcagaggccgggggagctgcaggtccgaactcggccggcccggggcgagggcgggcggggagcggggcgggctagggcgagcgaggctgccacacccccgggactcgctggtgcgaggctcagcatgccggctgcggaagtcccgcacagggcagcttccaggcctcctgtccctagagcagtaaatgcagatcagcacttctgcccctcactgtactcccactctcatccccttcctccctctaccaccaccaaaaggccagaatttttaagttgattgatatttttttattaggataataaagtcagatgcagtatattgtgtatgtttttttgtttcgtgttgcgtttttgtagagatggggtctcactgtgttgcccaggctgctctcttaattcctgggctctagtgatcctcctgcctcggcctcccaaagtgctgggattacaggcatgagccaccatgcctggccttgactgtgttgttaaatggctattttagaccatgaaattttcaacaaaagttcttatttaagagtcttgatatttttagatagttccatggctgtctttgatcatacaagttaaaaaatgttgctggtagaaataggaaccattttttttcttctctctctctgtctctgtctttcatttctagttctatctcttttgtttatttctcagatgcacaaaattggatgagtcaaaatctacagttcattttcttgactggtttatgcatgcctcgcttttactgcttatttatatatgctattaatgttttttattaacctaatgaacacacttgaacccaccacccaaaaatgagatcactatcatttatttgcatccacctatgaccctttcctatcccatccccccacctcatcacccagccaaaccactgtcttgggctgtaatgttgtattcaccattctcttgataaccatatgtatgcctaaagaaacatattatttgtacttgctttatatgctttatctaaaaaatatactagctgggcacagtagtacgcacctgcagtcccagctactcaggaggctgaggcaagaaaatcactgagtccaggagtttgaggctgcagtgagctttgattgcaccactgcactccagcctgggtgacagagtgagcctgtatctaaatatatgaacacacggctaggcacggtggctcatgcctgtaatcccagcactttggaatgccgaggcagggggatcacctgaggtcaggagttcgagaccagtttggccaacatggtgaaaccccgtctctactaaaaataaaaaaaaattagccaggcatggtggtgggacgcctgtagtcctagctactcaggaggctgaggagagtctcttgaatctgggaagtggaggtggcagtgagccaagattgtgccactgcactccagcctgagtgacagagcgagactctgtctcaaaaaaaaaaaagcaaaacaaaaccctttagagacaaacaaaaacagaggtttctaccaacagactactccactaaagcaacttcttcttttttttttttttttctgacacagagtctcactctgtcccctaagctggagtgcagtggcacaatctcagctcactgcagcctccgtttcccaggtgcaagcgattctcctgcctcagcctcccaagtagttgaaattcaggcacgcgcctccatgcccggctaatttttttgtatgtttagtagagacggggtttcgccatgttggccaggctagtcttgaactcctgacctcaaatgatcctcccacctcggcctcccaaagtgctgggattacaggcgtgagccactatgcgaggcctactaaagcaacttctaaaagaaataattcaaaagaagaaaaattataagcataccttattttattgtacttcagacactgcctttttattttattattaaataaattgaaggtttgcggcaaccctgtgttgagcaagtctgttgacgccatttttctatcagcatgtgctcatttcatgtctctgtgtcacatcttggtaattctcatgatgtttcaaagtttttcattattattatatgtgttatgatgatttgtgatcagtgattttttggtgttactaatagaattgttttggggtgctacaaatggtgcccatataaggcagcaaacaatcaacaaatgtgtatgttctgactgcctcactgacgagctgttcttcatctctctctttctcctggggattccctattccctaagacacaacaatattgaaagtaggccagttaataaccctacaatggcctctaagtgttcatgtgaaagaaagagtcacaggtctctcactagaaatcaaaagctagaaatgattaggcctactgaggaagtcgtgttgaaagctgagataggcccaaagctaggcctcttgtaccagttagccaagctgtgaataaaggaaaatgttcttgaaggaaattaaaagtgctactccagttaacacacaaatgataaaaaagcaaaacagctttatttgctgacaggaaggaagttcaagtggtctgattagaagatcaaaccagccacaacattcccttaagttgaatcctaatccaaggcaagatcctaaatctcttcaatgttgtgaaggttgacagaggggaggaagctgcagaagaaaagttagaagctagcagagcttggttcttgaggtttaacgagagaagctgtctccacaacgtaaaggtgaagcagcaagtgctgacatagaaaccacagcaagttagtcggaagatctagctaagataattggtgacagtggctatgctaaacaacagattttaatgtaggcaaaacagtcttctcttggaaaaagatgccatctacgactttcatagctagaaaggagaagtcaatgcctggcttcaaagtttcaaagaacaggctgactttctcattaggggccagggcagctggtgacttcaagttaaagtcaatgtttaccattctgaaaatcctagggtctttatgaattttccacccctcaaggttcaagtgattcttctgccttagcctcctgagtagctgggattacaggcacccgccaccacgccctgctaacttttatatttttagtagagacggggtttcaccatattggccaggttggtctcaaactcctgacctcaagtgacccgccctccttggcctcacaaagtgttgggattacaggcgtgagccaccacgccaggcttctagggcctttaataattatgctaaatctattctgcctgtgatctatcaaagaaacaacaaagcttggatgacagctcatctatttacagcatggtttgccaaatatatatatatatatatatatatatttttttttttttttgagatggagtttcgctcttgttgcccaggctggagtgcaattgtgcgatctcagctcactgctatgtctgcctcccgtgttcaagcaattctcctgtctcagcctcccgagtagctgggattacaggcgcatgcccccatgcctggctaatttttgtgtttttagtaaagacagggttgcatcatattggtcaggctggtctcgaactcctgacctcaggtgatctgcccacctcggcctcccaaagtgttgggattacaggtgtgagccaccgtgcccggccagtttaccaaatattttaagcccactgttgaaacctactcctttcaaaatactactgctcattgacaatgtacctggtcacccaggatctctgatggagacatacaaggagatgaatgttgttttcatgcttgctaacacaaaatctattctgcagctcatggaacaaggaacaaatttgactttcaagtcttatcatttaagaaatgtattttgtaaagctatagctgccatagacaatgattcctctgatggatctgggcaaagtgaattgaaaacctctggaaagaatccaccattctagaggccattaagaacattcaagggctgggaatggtggctcatgcttgtaatcatagcattttgggaggctgaggcatgaggatcacttgagcctaggagtttgagaccagcctggcaacacagggggaccctgtctacaaaaagtgaaaaagttagtcaggcatggtggtgtgctcttgtgctctcagctactcaggaggctgaagtgagaggatcgtttgggcctgagaggtcgagggtgcagtgagccatgattgtgccactgcactccagcctgggtgacagagtgagacctcgtctggaaaaaaaaaaaaaaaaaggaaagaaaaagatattcatgattcatggaggaagtcaaaatatcaacattaacaggagtttggaagaagttgattccaaccctcatggctgactttgaggggctcaggatttcagtggaggaaataactgtagatgtggtggaaatagcaagagaactagaattagaagtagaacctgaggatatgactgaattgctgccatctcatgataaaacttgaacaaatgaggagttgctttttaggaatgagcaaagaaagtggtttcttgagatgaaatctactcctgttgaagatgctgtaaatactgttgaagtgacaaaggatttagaatattacataaacatagttgataaagcagctgcagggtttgagaggactgacttcaattttgaaagaagttctactctgggtaaaatgctgtcaaatatcagtccttcatggggatgtaaaaaaaaagaggccaggcacggtggctcacgtctgtaatcccagcactttgggaggccaaggcaggcggatcacctgagatcaagagttggagaccagcctggccaacatggagaaaccctgtctctgctaaaaatacaaaaattaaccaggtgtggtggtgcgttcctgtaatgccagctacttggaaggctgaggcaggagaattgcttgaacctgggaggtggaggttgcagtgagctcagatcatgtcagtgcactccagcctgggcaacatagcaagactccatctcaaataataataataataataaataaaataagaaacaaaaggaagaaaaggaaaaaatgctgtcaaatagcatcatatgttatagagaagtctcactaaaaagtcaatcaatgcagcaaactttattgttgtcttatttgaagaaattgtcacagctaccccacccatcagcaagcagccatccacattgagaaaagacctctccaccagcaaaaagattaccacttcctgaaggctcagatgatcattagcgttgtgttttgttttgttttgtttctgagacggagtcttgctctgttgcccaggctggagtgcaacggtgcgatctcggctcactgcaaccttcgcctcctgggttcaagcgattctctcaactcagcctcccgagtagctgggattacatgtgccaccacgcccagctatttttttttttttttggtgattatagattaatataatatacagccatccttaaagccacaacatatcacagatcacaaaagtgctttcaccaagttacaaccctaacaccttacttttttatgtcatctaactgcaaataagtttctcctcagagaatcagtgcagtcttctttatccttttaaaacttagctggagctgcttaaactaattcttaataccattctgaaactagaaatatactgtttagaacacagaaatgctaagaaagtacaaagactttagtattttttttcattttcatgattcaagtagaaaacagtgccaagtaggtattattctacatggtaaatggaagaaaaaaatgtttagaatgtgaattcactagacctttgcggtattcagaagttaaggatttcacaggtgaaaagatttctctaagagttctgaactttgcgtcttctcacatacttttagtgtaaacactgtaaacttaacatctgtattaatgctgtctttttaggattaatgaataacgaggtagaagatacttcatttaaattctcagacacataattaagtgtgtattaacctttttgaaaggcattttcaacggaactggtggtttttcaggaaattgctgaatacccacgcataaatgcagatattgatgaagtaggatatttgtatatttgctttttttcaatcattcaattttatgaacatggggtctaagcagatttcaaaacaaagaccatttataaaactggaccattttaatgtttacaatgtaataaatctcttgattgcagacatatatggctgtttggtagaaacattacagtaatggcagttttttcagttggtgtgtagtccccaataattatatatgaaattgctgtcaaaccagtaagactgcatttatgcagccatcattttcaggactgttggtaacctgagcatattttctccaaataactttgcctccttgtgtcacaaggcccaattcgctcacatttacctcaatgacaatatctttggtaataacacccacagttgtatacggtggggatgagggattcttctttacaccaagtattggtgggcaaaaggtggctttcagttcaagatgtaatacatgggctttcttgaaatgcatattggcctgatcagtctttcttatttaggtggttttcttgtaaagccatctccgacaaagcagagtttagtaaccaccctcttccatgccttcttctttctctttcctgttcaaacaacttttaatacgtctgtttctccctgggcatgtactttagtcagagggacttcccgttttcccaccttctcttttcatttctgtttaatcatattggaaagtactttggctcgagattgtccctctctgtccagcagataagcaggtactgctccctgtggagtcttttcatccttcttttgtttggtgtttctcttttcatgcatcttgatagtctttttcatttgtattttctcagcatgacactgtttaaggtaaagcttagccttcagaccaatcatttgctttgccttctttgaacgttcatgagcctctcgttcataagcctctcagctttccttctttcttttcttctcatggtaatccaaacggtatccatagtgtttatggtgtaattcaatatattcgttctgtggcatggtgacaggcgcagaaccaccaggagtagcccctgaggtgcgaaaacactctcaattttaaggtctcagagactccacgcaggccgggacaggaaagggtcacccttttttaaaaatatttgtagtagagacagggtttcaccatgttggccaggctggccttgaactcctgaccgcaagtgatccgcccccctcaacctcccaaagtgctaggattacaggcgtgaaccacggccgatcattagcatttttaacacaaaatatattttaattaaggtagtcacattgtgttttttaaccataaaaacacttaatagactatagtattgtgtacacataacttttatatgcactgagaaaccaaaacaataataaataaccaggaacttgccttattgcagtggtctggaatcgtacctgcaatgtctccaaggtatgcctgtactaaaaggaaagtctaagattcaagaagggatgatggactgagcactgtggctcatgccttatagtcctagcactctggaaaaccaagatgaaaggatcttttgagctcaggagttcaagaacagcctgggcaaaatagagaaacctcatctctaataaaaattaaaaaaaaaaaaaaaagcctggcatgatgatgcaggcctgtagtcccagctacttgggagactgaggtgggaggatcacttgagcccaggagattcagtccgcagtgagctatgatggcgccactgcactccaccctggccaacagagggagaccctgtctcaaaaaaaaaagaaaaaaagaaaaagaaacgaagacgggatgatgagcaaataaaatggtaaacatggagtgaaatctaaatattgatgtcaaagacaagaaatatcagaaatataacaatgtctaattgataggaataaaatgaagatataatttaaatcctcagtaactatagtatataaattggaaggtaaggccaggcatggtggcccatgcctgtaatcccaacactttgggaggctgaggcgggtggatcacaaggtcaggagatcgagaccagcctggccaacatggtgaaaccccgtctctactaaaaatacaaaaattagctgggcgtggtggtgtgtgcctgtaatcccagctactgaggaggctgaggcaggagaattgcttgaacccaggaggtggaggttgcagtgagccgagatcgcgccactgcactccagcctgggtgacaaagtgagactgcgtctgaaaaaaaaaaaattagaaggtgaatatagtaattggagtttaagtgttctaaggtccttatattttctagggaaaaaattaaagatattgcttattagaagtctttatgttaagatttctaggctaatactaaaaaacttggtataatataacttccaaactagcagaggggaagaaaaatgaaaaggaaacacaaatgaaaatgatagaaaatgtgtcagttaaaaaaaaatttatggttgtgatatcgaagaaaataataaagattaccatttcttgagtagctcttgtattaatcactttgaatcattaatctttataatttcatgtaatatatgtcagaatgacaagcccaaagcaggtatttaaaaattatagtttctggccaggtgcagtggctcacacccataatcccagcactttgggaggcagaggtgggaggatcacttgagcccaggagtttgagaccagccgagaccacacagcaaaacgttgtctctacaaaaacatttgaaaattagccaggcatggtggcacacccctgtagtccacaaaggaggctgaggtgggaggatcacttgagcccagaggctgaggcttcagtgagttctgatcatgccactgcattccagcctgagtaacagagcaagaccctgtctcaaaaaataaaaataaaaattagctaggcatgtgggggaagcctgtagttctagctactggggaggctgaagcgggaagattgctccatccagcctggttggcagggtgagaccctgttgctaaaaaaaatatataaaaagctgggtgtggtggctcacgcctgtaattccagcactttgggaggccaaggcaggtggatcacaagatcaggagttcaagatcagcctggccaaaatggtgaaatcctgtctctactaaaaacacaaaaattagccgggcgtggtggcaggtgcctgtaatctcagctactcgggaggctgaggcaggagaatcgcttgaacctgggagctggaggttgcagtgagccaagattgtgccactgcactccagcctgggcggcagagcaagactccatctcaaaaaaaaaaaaaaaaaaagaaagaaagaaagaaagaaacttgtccaaggtcacagagcttggattccaatccaagtatttgaaattcaacccaagctacttttccctttaccatgtggtagattttttctctctaatgccaaaacatcatgtaacagccaagaccatgagttttttggacctgggtttatggtccagtttcaccacaagttaactgcagagctttaggcctcagttccttcagttgttgaaagaggataaaaatagctatcacaaaaggtagtaggttggaagatcgtgagaatgcacgccattggggtgagaatgtatcacttggggtggtggagataaaaaatgaggtcccagttcaatgtaacagccgatgaataggctcctagggagcagtaagaagagaacggaggtggggggtggggggaggcctgggcacagtggctcacgcctgtaattccagcactttgggagaccgaggtgggcagatcgtgaggtcaagagatcgagaccagcctggccaacatggtgaaaccccatctctgctgaaaatacaaaaattagctgggcatggtgtgagcacctgtaatcccagctacttgggaggctgaggcaggagaattgcttgaacctgggagacggaggttgcagtgagccaagatcgcaccactgcactccagcctagcaagggtgagactctgtctcaaaaaaataaataaataagaagaagagcacagggactgggcacggtggctcatgcctgtagtcccagcactttgggaggccgaggcaggcggatcacttgaggttaggagttcgagaccagcttggcaacatggtgaaaccctgtctctactaaaaatacaaaaattagccgggcatggtggggtggccctctagttccagctatttgggaggccgaggcaggagaattgcttgaacccaggaagcagaggttacagtgagctgagatcgcgccactgcactccagccagagcaacaagagagaaactttgtctaaaaaaaaaaaaaactttcccaaggtcaaatgggtagtgatctgggatttgggctgtctgtccacagagcttatgctcttaatctctgcaccatactttaagaggtgaatgatcactgagaaagagagctctcatgtctggaaagcacctcaaaggcaatattatgaaaaaagtgtggcttctgccaaagtcgggtttggattctggcttggcttcttactgtgtgagcctagacaaagtatttagccagttttctcctctgtaaaatgggagtgatacgacccatttcccaaggttgttgagaggatcaaatgagatactaatacagagtgatcaaaaagcctggagacttagttccccatcttgggtcaggaaagccttagctgtacctgctgtaaccaggtgcctgtgttctctgagctgatgatggggtgactttgggagaggagaggatgaacacagatgcctttctcctgctctttgaaaaggtgatttgtctaccctatgcccaccaccctcaatgcactcccaccattgtctcctaccacacacaagcatgctgcatggtattcagaaagcccagtctgtttctccacccctttgccttgtcactcagctttgccaggtcccttgagttctttgatgttgtgccaggctctgtgtgggctcccagccctgggcgtgtctgtggtgactgacctgtgccccactggcctccacctccattaccacaatggatctgaactctcggtgacagcagctgctggtccacatctggaatttagctctgctcttcccttctccacccttctcacctgtctataccaggatgactcttccatctgctcttcttccttctcctatttttatttatttattttactgtgataaaatatacagaacataaaatttgccatcttcacctttttttttttttgagatggagtctcactcagttgcccaggctggggtgcagtggcacgatctcactgcaagctctgcctccgggtttcacaccattctcctgcctcagcctcccgagtagctgggactgcaggtgcctgccaccacgcccgactaatttctttttgtatttttagtagagacagggtttcaccgtgttagccaggatggtctcgatctccggacctcatgatccacccgtctcagcctcccaaagtgttgggattacaggcatgagccaccgctcccagcttatcttaaccatttttaagtagaccgttcagtggtactaactacattcccagtgtaggtttcccatcaccatcatccatgtctagaacttctccttcatcccaaactgaaactctgtacccattaaacaataatgcccattccccactccatccagcctgtggtaacctccactctacttcctgtctctatgaatttgcctattctacatacttcatatgaatagaattatactgtatttgtttgtgtgtgtgtgactggcttatttcacttagcataatgttttcaaggttcatccgtgtggcagcatgtgtcagaacatccttccttgaataataattccattgtatggatgtgccacacttgtttgtccattcatctgcccatggaggccctccttttttaaatcacattttttgggtatatcataatttgcagtaatatgaagagaatagcctactctttccttgtagcaggaaactgaggagggtcactctcccagatagtggaaggcaggtggaattgagtgtgctgtttataaactctgtcctgaggttttactcttccagaggtctcttttctcgacaaatacttaatgcgcatgacatcacctgaacccagaagtgctagctagagagaagtgattatctggggccagaaccttgcatttgcttgccttcctagggaaagaccctattgttaaccctggagattccctcctttcaatgctgaaggcctttaaagggtctagagactgtagagcaacattttgtttcctgtttatattttttgggtttgtgtttgcttttgttttttgcatttcttccccttgtcagtctttgtccttcctggtcctgatgcacttcaatatttctggatgtgctgtactataatcataggccttcttaatatgggtgtatcctgtcttctttatttagaattctgcggactgggaattccctaagggaaagagccttcttcctttctttttctaatcttcctccacccttttttgttctcctcccttttgtacctccacaacacaccaggaggtgtaccgcctccatctagaccacaaactgtactctcagggtacccatggccaagaagaatgacacacacacacatcacacatacattcagcatgtctcactgttacctctgagaggaagtaggagaacctatattaatcctctgagctcatcaggacaggaatccccagctccaatgtcctgggttgggcctagaattatcccactattttctacaggctgctctctctctctctttttttttttttaagcaaggtcttgctctgtcaccatgctagagtgcagtggtgtgatcatagcttaccgcagcttcaaactcctgggctcaagcaatcttccctcctcagcctcctaagtagtggggactacaggcacatgctaccacacccagctaattttttattttttgtagagacggtgtctcactgtattgcccaggctggtctcaaactcctggcctcaagcgatcctcctgcctcggcctcctgagtctctgggattacaggcatgagccactgtgcccagcctcttctctccaatttcttttaggaccttgtagtatggagtatgccttagcttcttctaggctcttcctgtggttgcatggccttaactgagtgagtcacttcacctttaagaccatatgctctaaaatctgtcaaagaatgatattgtcagtcctgtctatcttaaaagattgttgcaaagatcaaatgtcagagtgctttgaaaactgtgaagcattatccacatgtgagttcttaacagagttcctttactctcatgaactctttctgtctttttacttagtcttgctgacaccacttaaaaaggaacctcagacagatagattccccagatatagctgcaaaaattagagattctggagaagtctgggaatggggagtaccaatgtcctcctggtacacagagccaagggtccagatccaggactggaaagtataggaacacggtggccagaggcacggggaggctctgacagaggggcaggagcagtttgcctccactgttcagtggcttcttaagatacttgatcttcatccaagggcaagggcctttgcacatgaaaaaagtaataatcctttcaactttggtatggggtagatgactttttgatccccatttttttagatgaggaaatgaaggctcagggagaatggatttggaggaggtttggctgagaggcactggtgctacttgggaaggacttcatgggagagcctgtgagctgtgaggggcaggagcctggcccgggtgcaggggccccacggggctggccactttgacatcttcagctctggctctggtgcatccccatgtcaaactggattcactactggttttcttccttagatatttttcaggatttggtgacccaagggaatgccaggttgacagttaactgcacctgctagtccttaaggtacttttattttattttattttatttttgagacagagtctcgctctgtcacccaggctggagtgcagtggcgcgatcttggctcactgcaagctccgcctcccgggttcacgccattctcctgcctcagcctcccgagtagctgggactacaggcgcctgccaccgcgcctggctaattttttgtgtttttagtagagatggactttcaccgtggtctcaatctcctgacctcgtgatctgcccacctcagcctcccaaagtgctgggattacaggcgtgagccaccgcacccggcccttaaggtacttttaaagattttagaaaggtgaatatagcccacaggagcaaggcccatctggcaaaacttagggtggatttcatctcccaaaccacctccttacctggtgcccatgttcagggcacatgctacctgactgtatgtagcagctctgaaaagagaaggttcccctctgctcagggtgagcccttagtgggaggcccacgctgtgatgagctctctcctgcagcagcttgatggccacaagctggcagcaggggaaaccctagaggttttgggtaggcacaggctagcaggcgtgggagatgtttctgcccttcctttgacacccaatacagatttctttgcctcaggtgtctctgcccctgtcctgctttcctgtcaagattgtgtagccttggccgggctcggtggctcacgcctgtaatcccaacactttgggaggccaagatgggcggatcacgaggtcaggagttcaagaccagcctggccaatatggtgaaaccctgtctctactaaaaatacaaaaattagccaggcacagtggtgcgtgcctgtagtcccaggtactcaggaggctgaggcaggagaatcacttgaacccgggaggcggaggttgcagtgagccgagattcacagcactgcactccagcctggtgacagagctagactccatctcaaaaaaaaaaaaaaaaattgtgtagcctttttatccagtgctcagcacaatattttgctaatacatgcttaaatgtaaaatgaggggatttgtttagacttttccatctacgtggctatgattatgggattcttgtttgatgtagttggtgggaaaagcagaggacatgctccctgaaaagaccaggaacttactggctagtattgttactggtgataaaattgtgacaggtctgacctgcctcctagcttgtggtcagcctacctgctttgagaaggtggtggagcatacgtggtaattaacctacagtggtgccacagttgctgcttctgggtagagcagagcggtgagcaactctgtctcctttccaagctggcaccagctcaggaggaagcatccaaggggattctcataagccacagagaactgcccatgagtatgaaagggaattcctgggccaggtggccacactcagctgacagctcctgctgggaggaatggtagcattttggtttcttacaatgttctccatctggctcctttgaaatgagagttgaaagggtcctgaccaggggacctgcaggaggtggacagcaaggcaggcctcaattctggaaacagcacctccacacatcacttctggggataattatctcatctgccctctttcaggcaaaactcagagtctttggagggccttcgctttcccaaagtagcttaattttggcccccgttcttcgtgcctcctaggttttgttgggtggacatttaacatagtagaaagctgactcctcttcctattaacctcctaggtttatctcaccatctgaatagggccttataatcctacaaatgaggcctctctccctatgctcaccaggaaaaattgaactctcaagactgtccattttctttgccctgttatggaaacttctcttccttttgccatatccccctcttatcttggctcttgaaactattcccttaggaagaaaaaggcagttcccttcctgcccttcttttgaaccaaacttctgtttgtggtcttggaaaccatgacaacctggcctaagaagccactttgaccatcttggaagttaatatttcagtgctgtgtactcacaattgtgagctctctagcacctttttgcttttgttttgtttcgttttaagatagggtctcactttgtcatccaggctggagtacagtggtgccatctccactcactgcaacctctgcgtcccaggttcaggagatcctcccacctcagcctccagagtagctgggactataggtgcgcaccaccatgcctggctaatttttgtatattttgtagagatggggtttcaccatgttgctccagctggtctcgaactcctggattcaagcaatctgcccacctcagcctcccacaatgcagggattacaggtgtgaatcattgtgccctgcctctagcacttttttccaaagggggacagaagcccgtgatctactgagaggagaaagtttcaaacaaagcaaccctagataatccttctacaagtacattagcaaaggagcaatgttccctgtaggttctagggagtggatatgggcagcattcgctggcagtctggagtaaggttctggagtgtggcctatacttatttttcctgtgctcttttcttctttcctcttctcacaattgctcagttactcagtagactagtgttggaggtagctatcttttcgcttacaccaacttttttttctttcttctcctcgatatgtttgtccttcttgctcgggtgctaccttttaaagcccaaagttgggaatccagggagctgcgatgattaactgcaggagcccagtggaagaattccacagccttagacggcaaagtttccatagcctcactgccgtgggacttcccccgcatgaaggcgagctctctttcttggtctggccattggaggagggagggaagacagcagcctggcgtgtcctcagcttctctgaggacttggctgcttacagagagagggcccagtgacaggaaccctaaagggaggaaagtgaccccctccccaccacactgaaaaagatccctctctggtgatgaagatcttgctaatttggaacagctggccagggtgtgttagactggaggaactgggggaaagcttgctctggcaatcttctgcagaaacaaatagcatgagatgcctatgaaagtttcactctgcttggataggatgtgtgatgctactcctcctctgcgaatccttgtgtagtggtggggaaagagagaagaaagcagcctgtcaccaggggttggattttagcatccatatgtctattccccaccatgctctgtaggctcagagtggaacggaggtggaacagtggagccatcttgcagcttgtagttgggtaggactagcttattgtgttcagttcttgagtggtcagcttctttgggaaccctgaaaggagccagggtcagattgtagtgcctttttaatctgtctagtcttctgcctccatcaagccactcccctatttatgctagattgggagcttggctgagcatactacatcctgactttggtgttttgttttgtttttttcattttttagatggctatagttactataactgacttttgtatttaatccatgggaatattctcctatccctccccttcccccacctagagtcctcagtgttaactgtttatctctacctccaatgtagttagttcccacataaatatttgacttagacaagcaagctccagatggactggggagaatgcagattggctcatggaatctggtcccacatgcctttgacccatcatccgtgaccccagtgacacagatgggtcctgggttggtgctggctgtggcagccccacaagtgcctgacttgcttttcagcacattcctgctccttccactgtgtgagccactgtggactaggacaggactgattggtttcagaaattatccaggcaaggatcaatccaattaggctgtccctggagatgtgggaaaagagaatgagagagattgagagattgaaatagacagatagattggggagaaggaggtaggggaagggatacacataagtatgggataataaagtcagaagtttgggaatgaggtatagagaaaaatggggaggtggaaatagtttggtgctaggtattcttcttatgatcttggtagcttagggctttagaaataaaataatctagaaaatatcttattttttcacttcctacaaacctccgaccaccatcccaccattcttccaggttttgccttggaggttgaagtggtgtttaaagtggtatgtataggagtttagaatcaactgggttgtgttcacctttgcctctccctagagagtagatggattccttcagtgatggctcattccccttctatctgcaccaaaacctctgtgactgtgtcctgcagatcaagggagatgtgccatcaaccattcattcagtctgccaattttaaggtgcaaagaatgtgggcagatggagcaagtgctgaaggagtggtgcctgggtcttactgattgtctctggagactggatccctttccaggactttttttggttgttgtttgttcgtttgtctgttttttgagatggagtctggctcttgttgcccaggctggagtgcgatggcgtgatctcggcttaccacaacctctgcctctcaggttcaagcgattctcctacctcagcctcccgtgtacctgggattacaggcacgtgccaccaccccctgctaatttttgtatatttagtagagacggagtttctccatattggtcaggctggtctcgaactcccgacctcaggtgatctgcccacctcagcctcccaaagcgctgggattacaggcgtgagccaccgttcctggcccctttctgggactttcatacttttccttcccttggaaacagaagcacactggatggaacagagagaggtggctcattcattaattgcacaggttaggccaggctctggagctgaggttgggatagagaggtgatgacacaacctttctgctcacttggaagaaaaatacacaatactctccactttctctcccctgagagacttccatcaacaatgaccagctggggctgagtcacctctttgcctgccctttgtctctttcaacaatgagccctgtgtccatcactgtggatgcgagccctttggaatagatgttctttctagtccatgagttttggaagctcactctaccttgggacactgaaatatgtctgcatctctctttgtctttttatgtattcccaagtaatggccactcggcttgagttcatactcttttttattttatcttttttttttttaattgagtctcactgtgtcacccaggcttggagtgcagtggcacgatctcagctcactgcaacctccatcttcccggttcaagtgattctcctgactcagcctcccaagtagctgggattacaggtgtgtgccaccacaggtggctaatttttgtatttttggtagagacggggtttcgccatgttggccagactggtctctaactcctgacctcaggtgacccacctgccttggcctcccacagtgttgggattacaggcgtgagccactgcgcccggccgagttcatactcttaacctaggaagagaagcacagcttatctggaaccttaattcatagttagtacttttccatcagcctacacccaacagtccaggactatacctttttcatctgtggactctttcctcacctctcccttctcccttcccaccctataggaactaggatgctgatgatagttggtttgacaggtttagaagtgatgcctgctctgctcttctgacctcaaggttctgccaagactgatttttatcccaagttctgatttctccaacaagagcttatgagctaaccagggctgtcagttaggactttaacctctcctggggcaccagaagggtgcttccctgatgggagcatcagtgtcttcccccttctcctgccctctctcctccccgtggggagtgttctcatctatatcctttctgagccatggtggcatctgggagacattcagttatcatatgagatgggaggaaatggaacagtctatgcaatttgctgtttttaacactgccctaactttatttttatctggttaatgtgtctgttggcagtaagaggtttttaatctcctaataagtgtataccaatccaaaagaagctggaataaggtggggagaaggggttgataaattcctgcagcatctttatattccaactagctgtttctgaaaggtgactctttctcttactcacatgttgtttagtgattgacgacctatagcatatttattagtcagttcacgctttcagctcagttgtgtgtatgtgagtgtgtgcatgcctgtgattaattaccacattgacttgtgactcccactttcttgaccttcattttttttctttattttgtttagataaaaaaaataagtctcactatgttgccaaggctgatctcaaactcctgagttcaagcaatcctccctcctcagcctcccaaagagcacgattataggcgtgagccaccgcacctgcctctcctgcccatcttgaaccacctatggcccttatttctcttcttctttgctattttatttttggttgagggagtcaaggcagagggccatagtacttccatcgaatagatgcagactgacctctgatcactccctaacccctcggccaaaaacctttcccacgtctctggtgcccgagacatatgtgtctagggaggaatcagctgcactgttactcatccatcagcatctgaaccttgcatgctgactctgtgatgctgactaagggtcctcaccaccttgactaaaatcttgggtcttgctatgcagaagtagcccttcaccccaaagctaaggagaaaggattggatgaaagttctctgtagaagtggaggaaacacgtgtctcctcagaggtacctctagaggttgttctctgcaaccctccagctagagtgagcaggctccttgcctgggtggcactgctacccacagaggggatgggggcttcgaagctctcctcccacgacacctggtgaatcctccatgtcttcctcccttgatagtggcagctggtgggggctggggggagggaggagtgctgctgttagagcaagaagacaaagtggctttgtctcttatccgtaatataagtgcagggaggtgagaagaccctggggtttggcgtttctccttgaggagctgagccagaggcagggctttggttcctaagtgattagaggcctgcatggccagaggccgcaccttcccttttggaaaggagctcacccacactccttgcttccatcttccccttcctggctcaagtcataggctctattttctggctatcctgtttttgttcctgagtaagttgcggtggctcttttttttttttttttttttttttttttttttaaagctgatttagggggttgggaaaagaaaactttaaaagtaaaataataaaaaacagaccactctgtcattacaggcacataaatagctttaccgtcgctgggctgcacactcgctttgccatagcaacctaaagcgactgtttataacagcttgtcaactggcctggaaaccagcagctgctgctggccgccctggcctcggagcagtgggcaggcgctccctgagaggtgttatggaggcggtgagcctggtgcttcttctggaaccgtgggggatggcaggggaacggcagcctgggttccagaggcaaccaggggcagtaatgttttgggagccaaagtgagcagcgaatgtcttttgtttttgttttcccctcatctgtgtatgggccccagcatcgctcatctcctgtggagatagaagacagggctgggaggggatttgctccactggaacctgaaaggggcctgggtgtccctctgaacctcacgaggtggcttgttttaacttttcgaatagaccttggcttctgttgtagcctgttgagtgacatcctctcaagtctgttttctcaaagactaaaaaaatgtgggctttttcagggctctgtctgggaaagggggctgcccagagataaatggaagcagagatcagcaacctggaaggactagcagagggagagggaagagtgaaggagacacatggcaagatcttcctgtgccttcccatgtcagcctggagctgaaggggttcatgggaatgctttggaacctcgcaacattttcaaagtgtggtccccagaccagatgcatcagctcaccctgttaaggaacttgttaggagtgcaccttcccaggccccacctccgttcttgtgcaccagaaactcaggagttggcagggaggggcccaataggtttgccccagttctccagaggatcctagtgctcactctgggtttgagaaccacagctctaaaacattactcaagtgcaaggaagcatgatcagttcgctttccaaaggcctaggctgactgaatggatcctgtctgtgcaatatgtgaacaaggaagaataaaacaggcgcagaggggtggcaggttattagcgatcattcctggccaccttttttaataagcactgtcttttcagcatggagccctcgctgatttgcctgtgacttccaggaaataagcccagagaaggctggaataggtaaagcggggatgggaggttctctgtactctgtacaggtgagactgtcagagtggagaaagggaatgggagcagccaggcctgatgaccagtatgggacatgctgactagtatctgggccacacaggaatgttgttttaagtcctctcctgctgagcgtctggggacagagcagctgcccctggtgctcccttttggtggatgagatgtggcctcctcagtctgtggccaggcaacttcttcccccttgtcctgaggactccaccagatcctgaggcctgggaacaaccaggtcccgacccggtagcccagggagatgacccctctccataagcatgacatgattctgctgaaattcgtttctaaaaataacctaggatccgatccagctgctaaaaagcccctttgttcccttgaaaccaaaatatggaaagccacagcagccccaagaaagacagtctgtgtagtccaagagagtgcatatacgaaatacttgaatgctgctgccggagggctgcgtcctgtctgtggcctagaagcttcctgccgcagctctgaggagtgagtagcagttatcgttgctaacccttatcctgagtgaacggggtcaggagaggctgccagtaccccttttgttaaacagaccttccagatggcattgtcacttccacctgaaggtggctcttgtcctccttaaacaactgaaggaaatggtgagcgctgctgtttcatcctctacatttttttgagctctagcttgctgtgaacacccctacctccaccccatacatcctctgagtcactggaggacacagaggtgacccaggccagtgtgactcacacaatttgaaagaggttggctttcccaaggctctgggcctaagggactgccctttctcatcttgataattttttttgagatggagttttactctgttacccaggctggaatgcagtggcacgatctcagctcactgcaacctctgcctccaaggttcaagtgattctcctgtctcagccttctgtgcagctgggatcacaggcgtgcaacaccacacctggctttttttttttttttttttttttttttttttttttctgagatggggtctcactgtgtctcccaggctggagtgcaatggcacagtcttggctcactgcaacctccatctcccgggttcaagcaactcttctgcctcagcctcctgagtagctgggactacaggcacgtgccaccacacctggctaattttttgtatttttagtagagacggggtttcaccatgttagccaggatggaatttttatatttttagtagagacggggtttcgccatgttggccaggctggtctcaaactcctgacctcaggtgatctgcccaccttggcctcccaaagtgctgggattacaggcatgagccactgcgcctggcctcatcttaataatactgatgccatttcaagatggagccagtggccaggggtcagggggacagccgtgccctcccaggcacattcctgcttcctcccaccacactgtttccctacccatgccctggagctttctgtcttcatcttggtggttcttaaaacctgtgacatgggttggatcttagcagaccaggtgatcaggatcaggctgtcaaccttgggtcaattcttggtatcgctgtttggagaaagcttttgtcatctatgggtcctaccttctccctgccttctgaaggcatctgaccagaactggtaagttttgccaccattatcactgcacagcatatcctagacaacacagccactccaagactgagaggtattttatttttattttttggatctcagatcaccacagataatgttccagtgaacatccttgcacatgccccctccaggccctggatgaggatttctttggaagatgtagccaggactagatgactgggtccacagcatgcatagatgtagtttgaccaaaaagcaccaagtgattctggggaggagggatgaattctggattcctgagacccaggggctacgagtgacacgttttctccgattagatgctttgactctagtactaccttttttggtggaattgaagaaggtgctgtcagagtagcagacttggagagggggaagtaagtgagggaggcccgtggataccacctcctaaccaggaagtggcgttctatcttcagaaagagagaactgagcctgcgagtgacatcctctcaagtctgttttctcaaaaactaaaaggatgtgggctttccttgggtctctgggaaagggggctgtcctgagatgactggaagcagagactagcaacctggaaggactataggggggagagggaagagcaaaggagacatgaaccagaacccagaacttcaggaagggagtaccccacccccaggaggctaagttctaggggctagctgaaaattagcatcagattccctgaccaggccatggtatactatcccatggtgaggccagaggcctggcttggtgtgcccgccctcacctggcttcctggcttgggtgtggctgtcggatgatgatgacaagtggtcccacccgccacctgaactttagccaacacctgctgcctctgaccttgttcccatgcctccaaagggcctcagtaggctgaaggagggcatgtgctctagtctgcttctgcaaaccagttggcatttaaggagcaattagggcagggcagacatggggaggggaggaagaacccgggattgtgatgaggatggctgccagacctgagggattggaagtggccagggtgaactagaatctgggtcatggaaataaggagcctgtgataaggaggcgggcagaacagcctctgcctgagattcacacctccggagagaagggctagccagggatgttttaggctaggcagcctaccatggtcaggttcttgccagctttcttgatagggcactgtcctttggaagcgtaagagtgccagagagaaggagtagagcttaaaccccccaaggtggtgcacaggaaacagccctgctggaaacaagagagagaatgcagagcaggttctccctctgtgcttctcccagatcaccagggggagcaaggccaagagcatgagacgactgagtggaggaagccctcatccccaccactgggctctccaggcaggaattggatatgcttggactcacagcaatctagagcccagtgctttctggcttggggtgggggtggggtgaggggaggggaggacaagggggaagggagggtgtctgctcccaaaaagctttgagtctatccctatgccttcccagaaagtttacaagaggtagatatttccctgacctatttcagtgcctttaggagtcaggaacaagggacagatgggtttatgtgagccttctcatcaaggtttaggaagtaagctcatagtttgtttacattttttttatatcattgttcttgcacttgaggcaagttggctttgaattcagattagggcacaaatctggctctctgaatctatatttccctgctataagaaggagaggtccttcttatagggttgttggtgagaattcaatgaaacagtgtatgtaagaatgataatagctacagtgtgtggaccagccactatgccaggcactacataatacataggggtatgtacataatttctaattttcatatgaagtacctagtatgactcctagcacatggtaggtgctcaacaaatatttttttcccaaccttcccacctctcccaatcccacatccctgttcctgagtatagggagaagtagagcctcgcttggaatgagggagactgactctaggtcagaaaaaagactacgggttttctgagggactcctaaagcaggttttgtttgtttgtttctgaagcagagtctcgctgtcacccaggcgggagtgcagtggcacgatcttggctcactgtagcctctgcctcccaggttcaagtgattctcctgtctcagcctcccaagtagttgggattacaggcattcaccaccatgcccagctaattttttctgtttttagtagagacagggtttcaccttgttggccaggctagtctcaaactcctgacctcaggtgatccgcccacctcggcctcccaaagtgctgggattacaagcatgagccaccgcacccggccctgaagcaggttttatattgtagctgggtgcattctaaagtgggaccaggctgcttcccctctccagaggtcttcccttcctcactcatcaagtcctgcctggcagtgatgctggcacccctgccagagtatctccaagtgctaccggcttgctcctgagcagaggctctcagcccatcggggaaggacagagtagggcagggcagggaagtgtctgctccactgagcagcccctgcctgtagcccagaagccagagttgaccagagcctcttattattccaggcaggtctgtctgcagtgctgcagcagcctgaagccctagccccgggcccctcctgtttcctttctcccatttttatgcatcacatcacattcaataggagcatttagtagcggggagactcagggggtgagttcctttcatattttcaaatataccctactctataacctatacaaggtatcactctttttcctcatagtttggggatgtatttcttctttagcagcctgggaaagctaaaagtaaaagattccttggacaaaattggaggaaagtgtgtctgactagtgtttacactttggtgacttaggttcttgtctctggcagctcctcatttctagaggcttttttttttttttttttttgaagtcagggtcccacttggtttgcccaggctgaaactaagtgatatgaacacagctcactgcacactgcagcttccacctcccaggctcaaatgaccctcccacctcagcctcccaacttgctaggaccacaggtgtgcgccatcatgcccagctaatttttgtattttttgtagagacagggtttcaccgtgttacctaggctggtatcgaactcctgagttcaagcgattctcccgcctcagccttccaaagtgctgggattacaggcaggagccacggcacctggcagatgcctgccttttaaagggcctcttagaagcttgccagaaaatgaggaggtttaggctcaagagaaggagcaaagtgtaacaaaaagagcaccaggcagtcaagaccactgacttgctaagaccaaaccacttttttatctccctgtacctttgtatcttcatctgtaaggtgggggtcacagctgtcctaactagaattgatatgaccaatgctttcacacgtcatctacaaattatagaacagatgttataggaatttaggaggaaaaaagtaaaatgtcttaatgatcatgtaaagcattatgatttcttgccctaggaggaagagatgagagagttagctcttctatcctatcatctcttaggcttgcaaaatattagaaaagaggagggagcacataccttaccgagaatgccccaagccgaatgactaacccttacctgaaaagaggtagtacctttcaggtgtctgagcagttcatttgatgctgaggtggtgtgagcaccttcagattattctttggcagttgcctaatcagattaggggccaggcaagctcagcagttgcagagaactcatactccggagagttcaaaactcagacagaagtggggacgtcatgatatgtttcctagtattatagcgatcccaccttaaacctcaggccccaactctgcactgcccttttgactttgtgccagcagcttagcgcttgacctactctgtgtttctctagataagcctgaggcaaacaaatcttttcattcttttccacatgtgttcttcagccccatgtgttctaatcttatgcgaccttttccatcagttgcctatggaagtggaagaatctctccgctttggtactgtgaaaagaggttcaaagtaaggaaggaattctgccaggcgcagtagttcacgcctctaatcctagcactttgggaggccgaggggggtggatcacaaggtcaagagatcgagaccatcctggccaacatggtgaaatcccatctctactaaaatacaaaaattagctgggcatggtggcatgcgactgtagtctcagctacttgggagactgaggcaggagaatcacttgaacccaggaggcagaggttgcaatgagctgagattgcgccactgcactccagcctggcaacagagcgaggctccatctcaaaaacaaacaaacaaaaaaaacacaaaatattagctgggcatggtggcaggtgcctatgatcccagttactcaggaagctgaggcgggagaatcacttgaacctgggaggcggaggttgcagtgagccaagatcgcacgactgcattccggcctgggtgacagagtgagactctttctcaaaaaaaaaaaaaaaaaaaaggaaggaattctgactcagactgtcttttctaattctcaagagacccaagaccctatatgctggtggttattgctaatggttataacctagctaatggttattgttaatgaagctgccttagaattttccattcttttggtggggtgggggttccctggcaaggaaagatggaagggcacatggagcttattgttcttcttctacttaaagggcttaataacaaaagttcattaagatcaaattaggcggctgggcgcggtggctcatgcctgaatcccagcactttgggaggccgaggcgtgcggatcacgaggtcaggagaccaagaccatcctggctaacacggtgaaaccccgtctccactaaaaatacaaaaaattagccgggtgtggtggtgggcgcctgtggtcccagccactcgggaggctgaggcaggagaatggcgtgaacccgggaggtggagcttgccgtgagctgagatcgcgccactgcactccagcctgggcgacagagtgagactccgtctcaaaaaaaaaagaaaaaaaagatcaaattaggctttctcccatcacttaagtgtcctattccagacactggatacctttcatctaagatttccaagcactatttctataattccattcctttatcactttcttagggtggtgcgaaaagacagggcccattctctacccaactaaaggtggaaggaactgagtcctgagaaggctaagtaacatccctgtcttcatgaagcaaacattgtagtgggtgaagacagaaaaggtaaaatcctctgattcctagttcaacactctatcagcattgttcccaacatcctcttgaaaggttaaggagttctacttaagggtcaagttgggtttcttgctactttagcccttcccacttcttccaggcttggaggagaagctgaactggggtgaaaactctgtggtcctgcctgtgcctataccagtctgaatgaagggagtttgacacattgcctcaggttctttgtggatcttcttgtttcccagataagaagggagtacgatattttaaaaacaaatagagccctgctttcttaactctttgtaagtcagagtagtgctaaaaatctatgtggcgaggaggacgcaaagggcaaattgggagagggaggagtataaatcaacctgcatccctgtggaagcttctgggaagaggattgtcaggaatcggcaaagactttggctacatgtgactttggaggagatcattgataaaagaatcaagtcccttatctgatggttcttgtgcttctttgttcaccttctagaagtaagtgtggcatctatttattacagagaggttggccagagctccttgccaccccctggtaactgaagtcgtcagtggggactacgtaaccggggctggggtcccatgttctggtgctgtgctaagagtcccttcacatttaaaaggctgatgtgtggcagtgacacctgtcagtggcatgacacacagcggccccactctgaaactgagaaggggcctcaggataagttctcttcccaccttcagccctccgttttgtcacctacaccacaccccctagttagcatgcgtgagaggtaatgcatctttctgaggggagaaatgctggcctctctctggtgcctttattgagctgatgtgagactctggtgctcactcacaggctagcttgtctcccttgctaaccttgctgtggccctatcctctatctgaattgagaggtatcttaccgctcccactccagagaaactttaatgctcaggcttcaaactccctatctttcctcctcagaggtccttctgtcccctttactagaaaaaaaaaaaagttcaccctgcgtcaccaactgccaaagcattttactctcctcttctccccaaaagcctcttggaggagggtggagcttagcctcagaacaaaacttggtgccggccaggttgacacctgcacgggctgcagaatttccgtacacctggaggctgagtactctaacgggctttggaggattttgacatcttctatcaagttgtcatttccatacacctggaggctgagtactctaaggggctttggaagattttgacatcttctatcaagttgtcttccttgtgtgtaaatgtgtgtgttgggagtgggaagagtgtgggttgtgggagaggaaggcagactgacaggccacccttcagatcacttagatctgaactcctttttctgacctcttctcatcttttatagataaggtcagactaaaggatcctgtcacaggtccctcaaatagacagggaaaacattagagccatcagaggtcgtaaccatttatttccaagtttctgaagctgtgggttttatgttgcttggttgggagaggtgagacgtgaagactcgggtattgaaattactcctctacattggagtttacaggctgcaggggcctcccaggaaggaacgggcctctcttgagtcagctctctaagctcaggcctagctatcagttcagctcagatctcaactgtcacttaaacccttgtgcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtaaaggccatatcaggggtggggagttggaggaaggtggctagtgtttcaaaatattgttttcccagcttctagagaaggcacatttctggaggcccagctggtatatttttgtctggtgggaaaggtatggcatctgaagcactgaaaggagggcaggccatgaagaactgtatctttcccagagatgatgtttagaaagtgtgctattctctaaagattattcttttctcctttttcttttctttctttcttcttcttttgtttcttttttttttttttttttttttggtgagacagggtcctgctcttttacccaggctggagtgcagtggcgtgatcatggctcactgcagcctcaacctcctgggctgaagccatcttcctacctcagtctgctgggtagctaggaccacaggtgtgtgccatcacacccagctagctttttagatttttttgtagagttgaggtctcagtatcttgcctagactcatctcaaactcctggacttaagtgattcttccaccttggcctcccaaagtgttgggattacaggcacagtgagccactgctcctgacccctcttttctcctttttctgtatcagtgtccagaaaggaggatatttatttttaaaatgtttatgttataaatgttgttgtcagtaaataatcaagtctgttcttctatatgtctgattataaaataatttaattcttccctacactgatcttacagtttaatgaatggaggaaggaagggtacaaaaaagtgaataagtccagctgcccaattgagcacttctctattgtatactgttagaaatgggatgataggccaagcaggtgggtggctcacatctctaatcccagcattttggcaggctgaggtgagaggatcacttgagcccaggagttccagaccagcctgggtgacataataacaccccatctctatttttttttttttttttttggagacagagtcttgctgtgtcacccaggctggagtgcagtggaatgatcttagctaactgcaacctccgcctcccaggttcaagcaattctcatgcctcagcctcctaggcagttgggactacaggtgtgtgcaccaccacgcccagctaattttttgtattttagtagagatgggatttcaccctgtgggtcaggctggtctcgaactcctgacctcaggtgatctgcctgccttggcctcccaaagtgttgggatgaggaggcttacaggcataagccaccacgcccagcctctattttaaataaaaagaaaaaaaaaaggaaatgggatgctaaatcacaaggtatataactgtacccatcatatctttggatcactcactgttttgtgtcagggaattataagtgattttttttcaactctgctggatacacttttaatgtagttctccttaatcttttttgtttgttttgttttttgtttttttggtttttttgttttgagaaggagtctcactcttgttgcccaggcaggctggagtgcaatggtgcaatcttggctcactgcaacctccacctcctggattcaagcaattatcctgcttcagcctcctgagtagctggggttacaggcatgtggctaattttgtatttttagtagagatggagtttcaccattttgaccacactggtctcaaactcctgacctcaggtgatccgctcacctcaacctcccaaagtgctgggattacaggtatgagccactgcgcccggccttaatctcttcttaaaagctaaaaaaacttaaaagataatgaaaaattcagcttcaggctttggcccagcccagttgcccagtgtgccatggtattatgaaattttgcctcatcaaaatgtagaaagaacaaaaggaaacttgctttttcactttagtctggttttagcatctctgtagcagattcttacttggccctatacatctggcagttcatggttgagtagcatgagatggagcaaagatcttgtccattaggggctttcagtctcatgtggtctcctatttctgaatcttcctcagaggccacagcatatttctcaccaattctaagaagttgttaccctttgccagtgctgtattataagttagtgacttggagcctagactctttaggatgaaaaaagagaaagagagttttacatagatatctatacctagtttatgtcttattttctttacaacctaagggagcttccctacctgttttctttacttctagaatttggtttcctatctcataggctttgagttcaaatgatagctccaccatttactaactaagtagccctctacagtttactcagcctccctgagtctgtttcttctttgaaaataatgttaataacacctagcccatagagttactgagattaaataatacatatacagtgctcatacttataattaggtgttcaatagattagttttctcagattaaaacagagtccatgcatctgtagatacttgccagaacatgggtgcctatggagtgcaatgttttgtcctatctggagaggttactgtgtgtgtaactgcaactactgtccatttcatttgctcacttcttaatcacaaaaaaaaaaaaaaccctgggtaaggtggcaatatctaattgctttcatgtggctcagtctttgccttctaatggtagtccttaatcatacccctttgggctctgtctacttcttgccagctagatttctttattcagtcacttttacagccgtactgactgctgagggtctgttcttaattatatcttcactgagattatgcagtactttacaaacacccatcagaatttaaacaggatctttctttttcccttcctatgctgttcttgatccctctggtcagctgtctgtctcacaaacaggaactcgggagtccaaagaagctggaacctagagaactcctgacagcaggattcaggctttcctccaattttccagatcccttcccagagctgccactgtttactttctgattcccagagagcttcctttcccaaaggccaacatatattctactttctgtcaacattggatatcaaatgttatagacatagctaatgctcttggatcctttcccagtcctggtttcagccccttccaatggcaagtgcttccctcgttacagcccctggccatgcctgtagcctaggactcctaacactggcacaattttctactgccatgtactgcttccttagatcacaaatatgtgtcctggtgtttttctttcttttctttcttttttttttttttttttttttttttagaaggagttttgcttttgttgcccaagctggagtgtaatggcgcgatattggctcactacaacctccgcctcctgggttcaagcaattctcctgcttcagactcccaagtagctaggattacaggtgcacgccaccactcccagctagttttttgtatttttagtagagacggggtttcatcatgttggccaggctggtctcgaactcctgacctcaggtgatccatccacctcggcctaccaaagtgctgggattacaggcgtgagccatggcatctggccttttttttttttttttttttctttatgagagatggggtcttgctctgttgcccagactggtctcaaactcctggactcaagcagttcttctgcctcaccagtttgtagtaatgtaagagttaccatagggcttgttctggaactggggagacggtgttggaaaacaacctttccattagtaatttttagtccccagtaccaacagtgacgtcctagtgtgtaagaagaataaagagataagaaaaggagaaaaaaataagaaagaaaaagaaagaaaagaaagaaaagaaaggaagaaagaaagaaaaaaaagaaaagaaaagaagatatagaacagctaagacataggagtatctacccaggcaagggtaatgctcacctgtttagttagggtaggcagacaaaagatccccaatatgctcatcctataaaaagccagcctgttcatggaaggccacacagcctgacagcctaggagaattttgtcattgtgggaggtcccagtggaccaataataagaataaagaaatgtacctggtgcttgaattctgctagctggaaaccaaggtgaaagtgaagatcagagatattgtttcctaaaatataacccttttcctttattttctatggactgatagcatctttagtatagattgacagaatttttttttaaaccatagcttttaagggggcttatggaacttgaagtttattacatttctgatactaacatggttttattatcatagatttacacaattctaaaggcaggtgggacttaattatctcttttggctggccgcagtagctcatgcatgtagtcccagcactatctgtgctttagctaagatactctgtgagactgctctagcataagaagcatttagagcattaatggagtataagtcagaaggcatgaaatattccatcccattctacctggtggtaagaacttaggtcatttaaaccctttagcctggagagagggagagagaaagagattattattattattattattattattattattattattattattttgggatggattctcactctgtcacccaggctggagtgcagtggcatgatctcggctcactgcaacctccgcctcccaggctcaactgatcctcctgcctcagccttccaagtagctgggaccacagatgcgcgccaccatgccgggttaatttttgtattttttggtggagatggggttttgccacctctacctcagcctcccgaagtgctgggattacaggcatgagccgccactgacccaatgtttttttgttgttgttttcaattttatttttgaaacagggtcttgctctgtcaccgaggctggagtgcagtggtgaaatcatggctcactgcaacctccacttaccaggctcaagcagtcctcccaccttagcctcctggttaactgggactacaggtgtgcaccaccacgcccagctaatttttgtatttttttttgtagagacagggtctctccatgttgcccagggtggtcctgaactcctggcctcaagcgatctgcccaccttggccccccaaagtgctaggattacaggcatgagccctcatgcgcagcctcagcccaatgttttgatactggcttgtgttccttgagtatacattagctagttagagtaagaggagttgccccagtggccaagagttggttagacttaagaaggcttggagatgtttagctacatggccttcagcaacaaccagaaataaggctgagagcatgagccaaaaagagaagaaaatttagggcaacaagaaagggtgggggagacataaaagagaatacatgtttacatcaaagtaactaaagatttcagtctttatgtctgtatataaacaaaagcaaagatgcaggggtgagactggagctcctgggcaagctgtgttgccttgggtttatcaggagggacaatctgagcattttgcacaatggaatccttcttgtttgcttgcttcgttccccattccagttttttccccctccttttattgtctcttctttccctgtcccattcccacctcaaccaatctttccaatccccaaagaacagagcagtttggttggtataggctagaagatagccttttaccttctgtgtggtttcctgtggagtctcatggcctcgtgagtggaagaagctttttgtgaatctgggatgaaaattacctgtggcttaaggggaagaaggaagaggtattttccttagtctcaatacccttttgtgtgaaggaaaaagggatggtcctggcggcctaggtagaggttatacgtgttcttttttccctgtagaattttgcacattggtccttagctacgctatcctttttaggaggaagaatggtgttttctgaggaagagttaggccagcccttggaggcaaggtctgggcccagaacagaatgggaaacaaggggagccttgaataaacagcaaattattaactgtaggccttctttcaaaaggctgaaggctattttggttgaatttggatctaaaagattgttggtggaactttctgttttatgttccttctgtacccttctacttcttttctcctctgcagagttgaaggcgtgacagtgagatattgagggcctccaattctttttcaacaacattcaactaatacttaaaaactgctaggtgctagggacacaagggtgaacatgacaggtgcagtgcctccttccatagagcttacaggctaaaagaagatgcatatgaatgaaggcaatttcagaaatcttgccatagggcttcgatgaggaagagcagcgtctatgggaacacagtgtagggacctaagctgaaggcattgcaggggaggggaagggggcttagagctggagacagcacacctgtatcatttagggattacccagtgaagctctagcatggccacgctctatgatcattgctaccacctgctgaatattcctggcataagatgccagcatttttgccttccttaattactgggtagttactaggtttagggagctgagattccttggggagtaagtggcaggcgggaaaaaaaatgtgttttaagacggccaacccaaattacaattttgttttattagcttgaggatttagatgaacgtctatcaccttaagatctctggggcttaactgtgttcccgtcactgtgccttttgagggcagtggcatgttttaccaggaattgtccattttgctacaagctgagatgtactgggattgggctcttcctcggtgtagcagattgaaatttctagtagtattgtcaatctggaaaaaattgagtacatatcccaagtaaatgttcacctacaagactattgccttactattaatacatctaacacttttatttacataataagataggcaaacatatattttcctcactctaacagatggatgcatgccccccgcttagagaccgctgctctaaagcacggtggcgttagggggatgtggaggactaggtgagtgaagatgggatggaacagatgtgagaggaagatgggcaactgggttctttgagatttttcttccctatctttagagcttatagtctgttctggaatatcaatttttaggagctcctccacttgaggttagaagcataacctctattttcctctttctttgtgccctctgccctgtagccatcatctcttgccccaactctactaaggatggcaaataagtgaccctaataacagtgatctgggcatggcctcagagattaacattctgtggtccactctgcctaccaaattttgggcagatggattagcactaactaattcacgatgtgagaaggactcaagccaaaagtgtcctccctctgcccctccccatcccccaccacagggaactccactttgcatcctaggaattccctgtctggtttgagtttcatgcctagggctgaattaggcttcttgtaggctgtgggttctctcttcctagcccagcccaggctctgccagttcttttctacttagccctccttgcctagagctgggcttctgggttcactgtcataatgctgtccagctggggtcagagggatcttcacgaggagagtagctaaggcttccccaacctggaagcaggaggcttccccttcctgctttctctcctggagccctttatgctccattcctttgacaactcagcagcaactgttgcaagttttttgggggtctgatttggtttttaaccttctcattcttggcttacattggaccattagctgttgggaagaaaaatagcattccctccttgggtgaagcagatactgcatctaccgaaagtggggctttcattcttattatttagctccaaggtgggaatatgacaccagatggaagcacattcatgaagtacagaaggtggcagagtggcagagcagaaagctaactagagagctctagggagacttttttccctgggccacagttgctgttttcaaaaaaaggccaagagcagggggcgggataaagggaagcatgccctgaggaagcggcccaccttgggaagggttttgctgaccagaatgagaaaagaagcattgttctccaagttcatcatcctctggctgtgaccttgaatcaactgctttatctctaggagctggaagtctagcagatagggagcaaatctccaagccatgcgtgtattaaactggaggtgctgaagcagggaaactgctgtatactcggaagagtagcattcggttattagccagagatggctagatcttgcatggccctattttgattttaagttactcctccccctcagtccccaaatccagggttgttggggttttttaaaattaattttaactttttttttttgagatggagtctggctctgttgcccaggctggagtgcagtggcgcaatctcagctcactgcaagctccgcctcccgtgttcacaccattctcctgcctcagcctcccgagtagctgggactacaggcgcccgccaccacacccagctaatttttgtatttttagtagagacggggtttcactgtgttagccaggatggtctcgatctcctgacctcatgatccgcccgcctcggcctcccaaagtgctgggattgcaggcgtgagccaccacacccggccttttttttctttttttgagacagggtcttgctctgttgcccaggctggaatgtagtggcaaaatcacggcttactgtagcctcaacctcctgggctgaggccatcctcctgcctcaacctcctgagtagctgggaccacaggcacacgccatcatgtccagctaattttttttattatttgtagagacagaatctttccgtattgccccggctggtctcgaactcctgagctcaagctatcctcccaccttggcctcccaaaattctgggattacaggcatgagccaccaaacaaaacccaaatccttttaaggaaggacttaaaaggtattctgctgtctgtccttctcaagttccaaaagaggacagccttcaaatcaacccagagaaaattctccctggtactatatgagtgggagaagattctgctgcctcctttggcaaggtgtcataactcagacagctgggaagtccctcctgatgtctaccctagccccaccctttctggggctgagctggttctgataagtagtgcctctgccgatgtcgttggcccttccctgctggagctaagccactgagggttgggctgcatttctcctcccaggccctaggtcctgcacactcatggcagacacaaatattccactgctgtttattctatgttcccacccagcctgggcaggggccgtgcacctccccagcatggggtgggggtgatgacttcacagctaaacattctctttgcctctcccagctcatgtgttcagtctggttcatagggccagaagtactcccactctgggtggggctttctctctcatgttcttgaggacaagatttcccctcagtttcctgaggaatttctaggggaaacccttttcctgtgtttccagcattctctccctgccaagttttccttcccctctccaggaggttgtgtgagcatctgagaaaccactgcagagatcagggccttttagagccttttcccaggctggacaagtatttgtgtgaaattacagctgctgagatcagggcctgaaagactctctagggcagaaagaattggaatggaaagcccaaaactggggattggccgagctcccagtcccacatggctttcccatgcctcaccacatgtcagagaggattcccaaggctactacagctaagagccttgacctgccccgccttgctgcagggcatactgggaactgagacagccacttgacttcttaaggttgctattgtacaagctcagggtgacttaaggtggaacacatagatgagtagaaaatggcaaaaaaaagaagcaagcaagtgactttgagagcatttaggtaagaacaagccctgactttttatgttttccatagtgtatgtcacttcatttgcttgggtccaaaaaaggccataagaaaggttttattgagtacaaaattcataggtttggactctgatgaacctgatggcgatgttaccatccctgaggccaggaagaaaaaagacaggactaatccaccccaattgtagacagtgggaacagcgctggcttgcttagaggtacagaggaaagcagcatgcaaccctgccccgtggtgaaggaagtagggtggccaaccatcccggtttgcccgggactgagcggggttcccaggaggcagaaacttcagtgctaaaacctggcaagtcctaggcaaaccaggacaagttagtcacactagattgaagcctcagctgagtgcagctgcctccatgtcccagcgtcctctgtatctaggttggcatccagtggccctctgtggggtggcatagactctgccacttaataagctcaagtagtcatacccctgccaggccttagtttgcttctatgtcaaattgggttaatagtagctaccaggtaggggtttgtgatgcttgaatgagaaggcatgaatgtgcctggtgaggcatctggcacatagtaatcacttaaatgttagcaatcttagttatcactcattcattcagttcattctacaaatttgtgtgtgtacaatgtgctgggcaatgctgtaggcctgaggaacaaagataaaaatcctgcccttgtggaggaggtggacaaacaataaatgaatgtgtcctattatatgctaggtgagaagacctgtggagggaaatgattgagcaggatgagggggatcaagagtgccaggtaaatacagtggtcagggtaggcctcactaaaaagaagatgtttgtacaaagacctgagggaggtgaggaagtgagccctctccaacaaagaggaatctgggcagagggaacagcttgtgcagaggccctgatgtagatgcctgtctagtgcgtttagagaacagcaggcaggctggttgggccagatctcagtgaacatggagaaactagtaggagataaggactggggggctgggggagtcataagggtcctggaagcccatcattaagtccttggtgcctagttttactctaagtaaaagccagagggttttgagcagatgaatcgcatgtactgccttggatcttaaaaaagatcattctggctaatacattgagaagagactaagaacaggagagggagggtggaggcaaggagaccagttagaagatgattgctataatccagatgagagaggatggtttagaccaggatgataacagtgaaaatggaaagtgattggactttagatatattttgaagctgataggatttctcaactacatgatataggagatgggggctgggcatcaaagatgattacagggtattagcatgagagcagagagggacaggtagccctgttctctgcccctcatatgtccctctttttgggagggagggtttcattaggctattggggtgcaccttatgatctttaatatctgatgtcttggtttgccctcataatcatctactaaaccttggtaagaaggaaagggcatctactccctttacattgtgaatcctgcttttttgagaagcgtcccaggtagcttaacaaattaccagcactcctgccagcaagcctggctctccagcacagcagacccaacttggcacagccttgccatctctggtccctggggagaaaggaccagcaaggccctgcccctttggcaagtctgcctctgcctgtctggggctaaagattccctgcccagaacactcctttcccaggctctggctttccctcctactgggaacctgacttctcaggctggtggggcagggagtctctggggagcaacccaatttgcttctagaggtttggccaaacctcacagctctgcggggctcagctgtgcccctaagctggaggccagggtgatgtgcttgggcactgggagtcaggagaccctggataagccatcaggcaccacttccctaaccagcccctgtgtctctctcctaagcactagcaagtgaatgtggtctcaaaagagggccctcacacccctaactgcataggtgtggatgctagttcatcccctgcccccccactttcatctcccaccccccacatctaccttcccagacagatgagtatcttatgtatgtctcctgatgctttttgttttataggatagggaaatggaggccatcccaaactctgcaaataatgctcccttgggtacctattttcccattttcaaaatctttatctgttcagatgtcttcctcaggtcctaacccaaatctctccttttgacatttaaggtaacactcctgggttcttttttgagacagagtctctctctcgcccaggctggagtgcagttgcatgatctcagctcactgcaacctctgcctcccagattgcaattctcttgcctcagcctccctagtagctgggattacaggcatgcgccaccacacccagctaatttttttgtatttttagtagagatgaggtttcaccgtgttggccaggctggtttcaaactcctgacctcaagtgatacacccaccttggcctcccaaagtgctgggattacaggcatgagccaccacgcccggcccactcttgggttctattcagtgaagattttcagtgaagagtagacatttgcctgtataccacgtctgcattccttcctcagcaacagaatagcccttcacattgactaaagtgtaaagaaggcctctggcatccaagtcctttgcctccgttttgtccctgcagcctccatcatccacttcttgttctctctgtgaagctcagttgaagttcccttcctctgattctgaccctcctcagctgctaaccttttttcaagacaaaagtcaccctaccctgcctctgggaaacccttcaaaccggcaaccaacagcttccagtgccaaaaccaggactaatttgcctcagcgtgtaaacaacttgaacaccaactggcattaatcaccatggtaggattgcccctcttcccttcaagggtagccccacctggggacccatgaaaggacccaaatataaggaaagcactgagaataattctgcctatctcttgtccctctgggaaagtgcgtagagagtaggtgtggtatgtatgtggtgcatgttctgtgtgtgtgtgtgtcatatatctgtgtggtatgtattgtgtatgtggtttgtgtttggtgtgtatgtgtctgtatattgtgtataaggtgtgtgatgtgagtggtgtatgtggtttgtggtgtgtatgtgtctgtatagtgtgtgtggcatgtggtgtgtgtacacacaggtatgtaagcaaacgtatgttggtagggaggatgctgctaatcaagtactgcgtggcatctgaaaactttgtggccccacctttcttgttctctttttattcaatctgagtagtagtacttcccttagtacctacttagtccttagtagaatggtagtatctctcagtggtgtgtgtttgtgcctctgtgagtgtgtgtacatgcatacacctaggcacacaggtgtgtatatgtgtgtgacagaagaggggcacatgtgcttaaagggaatgcccacaagttatagtcttaaagactctgccctgatgctcccctaaagctcctggatcttagaattaggacacatgtgtgggctctgcctccatcttgcatgaccttgagcaaggagcttgttcttcctggcctttgtgtgtgagccaatggatggcagctcactctgcttttaaatcactgcagcatttacctgttaatatgacataaaagttctatgtgaatcccaagaaccactttaatatttaatgttctcagagctggagcctggggcatactcaatcagtagcagataagattttatgtctggttaagaatttatccagcttatacttgttactaagataagtgagtggtcccatggctgactagtttcattttgcccatttttagactgaaagttccaccctctctaagtcctgggcagattaggatggttgtctctaactggatctcatacttgagcaaatcaggaaggaaagggtcttttttatttattttattttagagacaaggtctcattttgttgcccaggctggagtgcaatgacgtgatcactgctgctcactgcagcctcaaactcctgaggtcaaaacaatcttcccacttcggcttcctgagtagctgtgactacaggtgcaccacatcatgcctggctaatttttgtcttttttgtggagacaaggtttcaccatgttgcccaggctggtctcgaactcctaaacataagcaattcacccaccttggcctcccaaagtgctaggattacagacgtgagataccatgcctggcctctttattttatttatttttgagacagcgtctctctctgttgcccaggctagagtgtaatgacatgatcatggctcactgccacttcaaaactgccttttatcattttccttttttcctacattcattcatccactcctatctccttttcaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaacgtgagtgtcctaaacagctcagcgtgactcttatctgggttctttccaccaccaccaccaagcgcttagtattggtggctgacaggttatagcttaaaacatttcccccattatccagagtgggctttccaaaggaaaccaagcagtagctactaagctattcttccaactcatccttattccaagggttcctccccaccccaccctcaccctctgtcttctattaaatcctttttcggaatgtcaggaatcctctacccttttaagacattttatttatttattaattattattattattattattttaatggaatcttgctctgtcacccaggctgggtgcagcagcttaatctgggctcactgcaacctcctgggttcaagcaattctcgtgcctcggcctcctgagtagctgggattacaggcgtgtgccatcacgcctggctaatttttgtatttttagtagagacagggccttaccatgttggccagactggtatcaaactcctgacctcaggtgatccacccgccttggcctcctaaagtgctgggattacaggcgtgacccacttgcctggcctatttaataatttttacaacatagagacaaggtctcactatgttgcccaggttggtctcaaacccctggggtcaagcgatctgcctgccttggcctcccagagtgctgggattgcaggtgtgaaccaacacccccagccaggaattctctacccttatccaaccaacaaaaccctacatctcaaagtgccccctgccaccaattgtctggcatgatgggaaacagtagtgaaagcctgaccatgttgggaaccataagtgtgaccttacatgtgacttccctaaatttgatagtttgtactatttagtcatttgcctcttttggattaacataaatagttacactagtgataagacaatactcaatcctgctatcctctgatatcctcttccagccaacagttgtatttgctattattcacttttcctgactttctatcttggggtgattgtggaagcactactcctatttcttaatgtcaacaaaagcccttcagtgactatttctctcccttcctgggatagtgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgagagctccgtgtttcttttgcttaccccaccaccacccccatttaagggataggtcctttggcatgagggggctgggaattgctgaaaacccaaaaagataagatccaaaattgtattcacttctaggttagagtttaaagaggttgtgggaagccatttcagaaaggagtagctgaaactctgtcgcaagattgtcagacttgtaccctgtgtgtcttagggttaaaagtgtataacattcaggccatggaaaggtgttggggatgaataagagtttgaatttataatgcctggaaagcaaccttctcccagattgtacagagctgaagacttgtaaagagtctccatgtactctcggccattgctgtctagatagggcccatgggaacagccatgagatagggttgaaggagttggaggaccctaccctcagccagtctcttactatctccttcactgtccctccttcccctttgtgctctaggtgatctgctgcctgcagatggaatcctgatccaagggaatgatctgaagattgatgagagctctctgacaggggaatctgaccatgtcaagaagtccctggacaaagaccccatgttgctctcaggtataggccctggctgcccaagttcccatttacctccctgcaaacacctaggccacaggatccagaccctgttctctcctctgactctgtcccatctccttccctggggttcagctggggcaacagcattttggtgggtggaatacaaggatatcaggcagcctaaatgaagttttccatgaaacaagtgttataagggccttgaaggggctttgctggttgcaggggtggcgggggcaggagggagggcttaccctaaagcggttagacacattttcctccttactcccaatttgtctggtctgttttaaatgcgcccagctcttgaccttttcctactgtgctaagcacatcattatccatggggtagggaggagtattttttcttctaagtttgtgtttcataccaaatcatgtctaggtattaaaaaacccattccttcccatcttctcctttcccgtgtagggacccatgtcatggaaggttctggccggatggtggtgacagctgttggtgtcaactctcagactggaatcatccttactctcttgggggtcaatgaggatgacgaaggggagaaaaagaagaaaggtaaggggcatctggaatgagattctctttcctctcatccccatggacaaacaaggaagcgagggagcagatctggatagaaagcatggttggaagaatctgctgccatgaagaaagcagatatccaaactccttgctgagataaagatgtaaatccttggctccagggagctctgatgaaaaccagatcctggctctaggctcccaaatcaggttgaatttgagccttgatttttatgtctaatggtagcttgtaaagggatgagttataaagcctgccctaaataaactggctaggtgctggtagccccaaatgccttccgtgtactccccctccttccccaactttcttcctcaaagatggggggttaaacgaaccatcaagactaagagaaaattggccagaagagtaaaatagatttctgccgaaactgtaggctctcaatggaagagacacacagctagaagagtaggaacagttagttcagtctttgccactcagttattcctgaaggaaagaataagagggagaaagaggagaagatactaaaaccaagtctacacgtttccctaagcattccttcttcccttaggggagagaaggtttctaccacttggctggagaatcatcttgagctgtttagtggaggacagtttatgaaaaggaaacaaaacacattctctcaggaactaaataattcatttctgcagctgcctgcagatgaataagggggaagcttgcctggtgctgttgaagtaacacggagacacctttcaaagtctttgccatcaggcagaaacggttcaaacctctcacttcctaatccccaccccatttttccaagcaatgtgactcaggccaggagcaagagaaagcacctcaggtatgagtatgcactcacctacatgagcgttttggtggatatcccgaggattcatgacagcctctagcaagaatgaatgaaaacagagatgtgagcttcctttacatttatgtcccttccctgcaacccaaacactttgctgttgtccttctgggctctgagcaggaccaacaaattggatctcttaatagttactttgggtttcgaccccacttttttctttcttgttcaaacaggtaaaaaacaaggagtccctgaaaatcgcaacaaaggtaacctctccaactactcatttaccatctctacctgcccacactcaaaccagacctttccaggccatcttccttctcccttttcctctccataaatctgttatctgctgctgtggctcagatgcctcatcctgaggaaggtgcagagatttttggggtggtctcaaggtcctgatcccaatctaagatgggacaacagcaccctctgctgttggctcacagaatgtcatgtcaaggtttgtcttggggagtgtgtaggattgatctgctcttcctagggagctgaactctgcttcattgacctcagcctgatttaaacaccaacagtcatcagtttctgggttggaagacttcagggtcctcatggtggagggaggtggggtgggtagtccctgcaccgtcctcttgctagcttcctcataagtgtcctcttctggtctggatcccttctctgctggtcttctcaggggtgcttggagagagccctttctctgtatctctctccccacctcccttctttgttcttgccacagtctgttttcttcctcctgatctgatgtgtgtgtctcttttggtgactgtgttcacattctgtctccgtcttcttgtttgtgagtctgacagcagggactactcaggaagggtatcctaagcaaggggctgagccctatagcagtgaaagtggagtggtgctgggagccagcaagaactactgtcttgtgacgctcctagagatttgtttttactttgtaacccacatcacagcagtctttagaaataaagtcatcacattggaaaaccagagctaaacagaaataattctttaattttaggtctttaactcttcttttaaaagcaaaatggatttatatgtctctctttatccctgctttctcttattccaggaggtccctcacaccagcttcttccctcttccccaaaagacttaaccccaggtcccactctgtatctctctacctttgtcaggcagggaagaaagggaattttcttttcctatcctcaactgctagaaggggctggaaaataccctgggtctgggggtatgtgtttcttccctgacaatcgagagagagagagagagagagagagagagagagataaaccatttaacagagcaatcttgtgctccagaaacatctgccaaccctctccttcagcccctttctgcagtaaagattcactattttaagcactgagttccaggaaggatggttgttttaatagtgcttagtgacatgattaatccccttgctggaataaacctagcttgggactctgaggtagtaccaggaagctgccactgaagaagaaatccataccctaaaagcaccccagtttcatctaaactcattagaatattattccaaaggccctaatagagtgttgaaggcaagttccatgtctagcatgggttggaagtggtcggaactgatgtcagggtccaaggtatattccgggaaagagacaggaaggttttctggtttccacctgcctgccactcagtgctaccaccttgcctgctcacctgtcctatttgtgtgtacactccagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtgagtagggtagagcctcgttgtggtttatcaatgttgtcttggatcctcatcacttttatccccttctttctgcaccgaccgagactggcagaaagaagctgaaacttcagggtggctagttggggctaggcggctgtttccctatctccgccactgtttggtcgctccctaggctttttcagagagaaatgttttcctgtgtgtaagggttaatggccctgagatctcttaatccaaatgaatgagaaacaaagagcatatattacagcaggggagatttacattagcaagaaggaagactttaataactgcttacctgtctcttgctttgggttgtaaattccttaaagatagagaaggctgcagcttgctacaggcaattctctagcataggagtaggatctggctaagcacagagcaataaataccaagtaaggactggaggaagaaggaaggctgtggttacagaggctctctccagaagagaggtaactaaataatgcactctgcatatgaggaagtggcttctccatcacttgcctctacattttcctgtctcaccaccttctttcaatggagggggagaaaggggagtgggaagaagaaatagaagattgctactttagtggacatatctctcaaggaacagtctttttttttttttttttttttttttttttttgagatggcgtcttcctctgttgcccaggatggagtgcagtggcaccatctcagctcactgcagactctacctcctgggttcaagcgactttcctgcctcagccacccaagtagcagggactacaggtgcacaccaccaagcccatctaattcttgtatttttagtagagatggggtttcaccatgttggccaggctggtctcgaactcctggtctcaagtgatccgcccacctcggcctctcaaagtgctaggatacaggcataagccaccgcaccctgccagagagtagttttttaccactgtttattctctgattccacctttctgtttaccacaatcataatcagcacatctctgcactttatacagctgtatacaacttacctcgggttcttgttaaagtgtagattcagttcagggggtctggtgtggagcccgagattctgcattcctaataagcccccacaggatgccagcaccgctgattcagtttgcacacattggatggcagggatctatgctgcccaccatagcagccactcaccacatgtggctgctgcaatttaaattaattaaaagtaaataaagttaaaaatccagttgctggggtaaattttagttggtcacgagccacatgtgctagtagtggctgtcatattggacagcataaatagagaacttcttaagcgtcacagaaagatctattggactgagttggcctaacctcttcatgtccattctggtacccagctaattttaactactgtgaaatctcttgcatataaactatacatggatgagatgaattgcaggtgcagaatcaaacacacaggtttgaaacattaaatctaccccacctaacccttgtactattctcctaatccttgccttgttgttgttgttgtttgtttgtttttgagacaaagtctcactctgtcacccaagctggagtgcagtgatgcaatcttggctcactgcaacctccacctccggggttcaagtgagtctcccgagtagctgggattacagatgtgcatcaccatgcctggctaatttttagtaaagacagatttttgccattttgggcaggctagtctcaaactcctatcctcaagtgatctgcccctggactcaaggaatcccatggcctcaagtgatctgccggcctcagcctcccaaagtgctgggattataggcgtgagccactgtacctgtcccctgccttgttcttcttacagagtacaagctacctgatggctggccactagtctcctctgttgctttattttatatattaggccagtccaggaatagggtgaggcaagtcagatgctttccaccacctggagagtgagttccttaaattttgcactctcagtggcttgcttctccacctgagtcctggccctaatcaagcaaagaacggaagaatttgctttcattgatatcatcatctctagccttgcttggaggcccccgaatcatcaggcccttgggaaaagcaaaaaccaaaaccagataatgatttaaagcagagcttttcccaaatattgtgccacagttagggacagttgtccccagatattgattccatcagccctcaaagcatccaggcagcacccatggcaatcagaacccctaagccagtcggttttgaccttgagcagattctttcacgtactgtaatgtgtagggtaaccaaccatcccagtttgcttgggattttctcaattttagcaaagccccacatccctggaaactgttcagtagtctcaggatggtttggttactctaccaatgggccataccaaagacttcccagtactttcatttcctcatctttaaaaaggcggtaataataatgacctatttcacagggttgtgaagtgcttgcctggcccacagcaggtgcccacataagtatttactattattggcatcttctatgtgtgccgtgacaagagaaatcttgggaagcactgttctaagagttagtcatgcaggtgatacactagcaccatagaggcattgttgtaaacaaggtgtgaattgtccaacattcagaggttagtagaggagaagtcaaaattgataaactactatgaaatggacaagtacagtcatgacattatgaatcgcagggagagggtgggcgtggaataggatcatagaaagctgtttcaggaaacagatcaaccccctgatttatgaatgaggaatttgatctaggaaacaggcccagagagggtcaatgacttgtccaaagccacaagtcaagttagtgcagtgctgagaatagaacctgtgtctttgaaatacgaaaccactgtctgttccctatgctataatgtacaagcaacagagaatgggggggattttagtaagtcttcctggcgatggtggttttaataattggcaacaaaggctacaactgatgccaatctatctctggctagggccctaggactgccctccagcctgggttcatatgacttgtttctctggacaggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaaggtgagactagaacaatcctatctcttcctttaggatagagatgggagagaagggtaccatgtaacctttagtgaaaagataagccattctatcatctataaactttggctggtgcctcacaagagcagaagtccctggtattatggaaggaccatctctgtcagatgcatcaatgttgaaatgacccagcagaatcttaagagaatgacaaaaatggtatcttggatttttttttttttttaagacagagtctcattctgtcacccaggctggaatgcaatgatgcaacctccgcctcccgggttcaagtgattctcgtgcctcagcctcccaagtagctgggattacaggtgtgcaccaccatgcccagttactttttgtatcttttacagagacagggtttcaccatgttggccaggctggtcttgaacttctgacctcaggtgatctgcccgtctcagcctcccgaagtactgaaattacaggcatgaatcactgcacccagtcagtatcttggatttttgtgtgggactggaagatgaaatgtggagagatgttggctaggaaatggcctttgacctagatttaggagagtccagttagtccccctctcaagtcttttctcttctcctttgtagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctggtaagcatttcctttgcgtagacacttagagtgggtggttggaagggaacatccattttctctgaaatgaacccccttattgtttacactgcctaaattgccatcccacatcccatttctcacgctggagtgaacatgtttgggtgagactacagaaaaatccctgggagtcaatggagggttggaggtaagggcctgtaagaatctatggccaggaaataccctcccaattagcatgtaaaagcaatgtctctaaggagggaaagtagaaagtaacccaaagtagaattgggcttatcagaagtaaattactcactttctagaaacaagcatagtgtattagaataagacccacacaaggcgagacaccagcactaccactagagcaaactacaaaatccctaagccctggatggcacaaggatcacggttaccactgacccctctctgcctacccttgaaaaacaacaggctaggcatagtggctcacttctgtaatcccagcactttgggaagccaaaatggtaagatcgcttgagcccaggagttcgagaccagcctgagcaatattgtgagacctcatctctacaaaaataaacaaaattagccaggcatggttgcgcacctgtagtcccagctactccagaagctgaggtgggaggatcacttgagcctaagaggtcaagtctgcagtgagctgagatcacaccactgcagtcaagcctgggcaacagagcaaggtgctatgtcaaaaagaaaaagaaaaaagatgccaggtgctgtggctcatgcctgtaatcccaacattttgggaggttgaggtgggcagatcacctgaggtcaggagttcaagaccagcctggccaacatggtgaaacccggtctctactaaaaatacaaaaattagctaggcatggtggcaggtacctgtagtccctgctactcaggaggctgaggcagaagaatcacttgaacctgggaggtggaggttgcagtgagccaaggtcgtgccactgcactccaggctgggcaacagagcgagactccatctccaaaaaagaaaaaaaaaaatgttatttcccctatgagctccaggtatataatgtgaaggctttgtaaatgagttctttctccctaagttctctgccttgtcaaggcatcttactcaatagtgctgtgtatatttcttctcccagcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgagcacccccgaccactctgcttcccttcaagatcctctcctcaggaaggcatgggtgcacaccccacactgaacccatgtgaatgagggagccctccagccaggtggtgacataataactaatatccaagcgtctactcaggccacgcatgttttttaagtgcttaaggtggcttgttgtatttaatcctcacaactcagtaaggtgggtactatgattatccctgttttacagatgagaaaacagagatataaggaagttaagtatctcactcaaggtgatacagctaatagtggcacagccaggattcagacctggacgatcctaagtttccatttcctaatctgaaaacagagatagccatactcagctcctaaaagtactaccccctcactgtaactaaatgattcaatgtatgtaaaatgccttatacataacaagtactagaaacgtttgttctgtgttctcttttccttctctttccttcccattcccatttctgattacagggaatttacataactttaaaagtgactattcggccaggcgcagtggctcacgcctgtaatcccagcactttgggaggccgaggcaggcagaacacgaggtcaggagttcgaaaccagcccgaccaacatggtgaaaccctgtctctactaaaaaaaaatacaaaaattagccaggcatggtggtgcgtgcctgtaatcccagctactcaggaggctgaggcaggagaatcgcttgaacccagaaggcagaggttgcagtgagctgagatcgcaccactgcactccagcctgggtgacagagtgagactccattacaaaaaaaaaaaagtgactattaataaattacccatagttcatcaaaagttggcactatacctaagtagggctgaattaaccagtgctccaacatggctttagccaccttcttttaatcagcacattcttgtataggaaacctcccccaaaccaccagcaccacacagtgagcactattctaaatactcggattgaaaaagtctctctgccttcaagaagttcaaaagagcaggtgattcacaaatgacttgcattgcattcacatatgggtaagaacagatgacatgggagaatcccactctctatatatctagaccttaactccatccacagcccacctaccttggaaagagggactcagctgggtgatgaatgaaggaaatgtttggccacacttggagcaatgtctttaggaataatacagagttgccaaaatacctgtcaatgattgtagaaacgtattgagtgggaagggagacaccgcgttcttactgtgcgcctccccaggtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgagagggtgggaagccacccaggagtctcaggaagtggggtactagttccctttctagttgtgaccccaggcaggtaacctaactgcctctcacttagagggatagaagtttctgtgcttcctgcttcacaggactgctgtggagtgccagtatgatcgaatgtggcattcctaggactaatgctgtctgagtgttgagaagcaaagggcttattgggctcattatttggtacttaagtgttgtcaggaggtcaatttagccaggacaccaactttgtctttagctccctcctttcaatcaacacattctttttgagtacctgctgtgtgctgataactattctagacactaggggattgaaaagtctctgcttctaagaagtttagacagatggactattaattctcaaggcccagaggcatgagagggtgtcatgcatgtgggaaattacaaagagctgatatggttggaacatgggccaggtgggtggagagtggcaaaagcttctgctagaaaagaaagcactggccaaatcgcaaaatgccattcatgccctgccgagaagtctcaattgtaagtgaaagagcaagtttttacacctcactcccaaagcaaatttccccttcaactcatggtacaatagggcaaattcaaatgtgactgccgtgggtaggacagaagtgaggtggcacccaacagtatcaaaatgaccagacctagcccatgctgcatggcaccacttctagggtgcctttctcctgtctgccacaaagggacagacaaacagggacagcttaccagggtcatcaccctcatctgcgcctttcccctttcttcactctccataggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtgggtcctggctagggggaaccaggacctcacctgacaaggaaaaggcgggttctagcataaggcatctgggtcatgtgcgggaaggtgggtggtttctaaagtgaaagctattcgtagtgaaacatctccttgtaccaaactgctgatatggtaacattgggagttgccggctgggcgcggtagcttactcctgtaattccagcactttgggaggccacggcgggtggatcacaaggtcaagagatagagaccatcctggccaacatggtgaaaccccgtctctaccaaaaatacaaaaattagctgggcatggtggcgtgcacctgtagtcccagctactggggaggctgaggcaggagaatcacttgaacctgggaggcggagggtgcagtgagccaagatcatgccactgcactccagcctgggcaacagagcaagactccgtctcaaaaaagaaaaaaaaaagagggggggagttgcttgtgaatgaagcttgctagcttcattcacaagctatcttttgagacagtgtcactaacttttcttgtctttctgctttttcagttttttatactgacttccccctagcccacccctcctgtgtccctgccctttggctaacagtggctaaaggagaatgtggtctggcggtggcacagatccaagctttcctgagctacatagaaatcaaacctaagacctcagaagcaccactttacccacccgagccaacagccaaccctggcccacctcccattaaaggtctgggaaatgggggattggctgccaggtagggacttgggaggaaaaagaaaaaaagcagggcctgaatggtcatcatccatgaatctacccttggagactggttggctgtttcatctctgcttaatccagaataacactttcatgtgggactgtggtgtacccaatctcccagtgactccaagtgtatggagaagttaagattttcctggatagcttttctgcatttgactgatccaggtgtggtctggtgttggcaggtagagcaagaaaagctggacaagatctggcctaagcttcgggtcctggcgcgatcttctcccactgacaagcacaccctggtgaaaggtgaggttggcttccaaataggtgcctgcaacagctgaaggcaggccagggcgaggacagataagaaccaccagccaaagccactctcctgtccaaatagggaggtcctaggagagctcccaggctagtggggagaacatacagttagcaaacatctgagcccttggtgagtatgacacacaataaagttgttgggtttttattttttttattttttgtttttatttttggagaccgagtcttgctctgtcacccaggcaggagtggagtggtgcaatctcagctcactgcaacctccgcctcgtgagttcaagtgattctcctgcctcagcctcccgagtagctgggactacaggcgcatgccaccatgcctgattaatttttgtattcttagtagagacaaggtttcaccatgttgaccaggctggtctcgaactcctgaccccaggtgatccgcccacctcggcctcccaaagtgttgggattagagccgtgagccaccgcacctggcaattgcatgggttcttaaaaacatgatcatgtcttatttaccaatagtactgtgaactaggcagggcaggtattcccattttacaaatgaggaagtttgaggctgagaagacaagtaacttacccaaattacccagctggtacgtggaaatggtgcagtttgacccctaggtctctgccttgaaatccatcctatgtgttcttcatagctgtcttagggtaccggatgaggacaaacttagttcagtgctactcatgaaacaacttactgcccttaggtggttcctgtagaacttctaggaaagggaaaagggaaggaaagaagaaagtagaaggagtggcgggtggtaggaactgaagggtgggggagaccagaaaagctcactgtggtgtgtctgtttctcccaggcataattgacagcactgttggggaacaccggcaggtcgtggctgtcactggtgatggcacaaatgacgggcctgctctgaagaaagcggatgttggttttgccatggtaagctcagcacagtgtctctctgattgcaagctgccttctccatcaggaagccaggtccggcttctggttgcctgctgcttgctacacctgcatagcccatggggtgcttttttgtccaactccatctctcctatctaccgggccaatcatgatatatgtaactggggacccatcaagtatgaagaatagataagagggagggaagtcatgaagaatcatatgcaggaaagccagaccaacataaacttgcctataaacatgtgaggttgtcaactaggcaaactctagaagatttgtgttccctatggtaggcgctctgtgtggctggcaccattgggtattccgcttttcacttctgaggccaagagcatcagaatcacttggaaagttcatgtgaaatcacatgttccaaggctccacagttagacgtcttaattcagtaggtctgggatgaataccagaatttttttttaacaggcacaccagttaattctgatgttcagaaaggtttagaagccccccagattctatcctcacactcaagtagtttatgattataagcctcccatacagattgaactgttggtgatttttagcagtggaaggacatttaagaagtcatctatctttagagaactcttttttttaagggttttattctaggaaatttcaagaatatgcaaaaatagggagaattgacaggtacctgtcactcagcttcaactatgatcaacacatggccaatcttgtttcagtgattcccccccatttacatccccagtcttcagctgaattgtttttgaagcaaatgcaaggcatcatgtaatttcatccttaaaaatttcatggccgggtgcagtggctcacacctgtaatcccagctactcgggaggctgaggtaggagaatcacttgaacccgggaggcagaggttgcagcgagccaagatcacgccactgcactccagcctgggtgacaaagctagactctgtctcaaaaaacaaaagagattccccctcattgactatttgattactctgaggcgggcagatcgcctgaggtcaggagttcgagaccagtctagccagcatggtgaaaccccagctctactaaaaatacaaaaattagctgggcatgatggtaggcgcctgtaatcctagctactccggaggctgaggcaggagaatcacttgaacctgggaggcagaggttacgatgagccgagttagcaccactgcaccccagcctgggtgacagagcaagattccgtctcaaaaaaaattttcttttcattatatggggggatggtgtggggcaaaaaaaaaaatttcattatatgcctctaaataataattatatatcaataatctatatatctaaaagaatcttaataccattatctcagaacaaaatcgatgcttccttactatcatgaaatttctagtttgttcacattttcctaactgactcaaatgtttttatagtttatttgcccaaatcaggattcagataagatccataacttgcagttatttgatacatctgttaagtctcttaacctatctcttggagtgcgcctccttccagctgtaccagtagctgtactagctgtatagtaggtttctatacaaacccatagaatgcagattcacccactcaggccccaccccagatttactgaattggaaagccgggaactggggcccagaaatcttaattaattatgttaaatctgttaaatgtgttttgacaggctctctcagtgattctatgtaccctaaactttaagaatcactgatcttataggatctctatgttgggagtccccaaaaacacccctatattcatggggttgctaggaggactcatgggacttggcatatagttgtactcatgactaagattcataacagtgatgtagtaagaatacagttggatcataaaagaaaaagacaatggcagaatctggataaatctatttgcagtctttcttatgctctccctcccatgaggagtcaaacagagtccattctttccccactaatgaaaacacagaaatatatgtgtgatgttctgcctagggaagcccatcatggacttagtacccaaggtttttcttgaggctggtcacataggcaccttctgcctagcacataccaaaattccagactcccaaaaggaaagcaaatgttcaatgtaaaccacattgttcggacacagtctagacacaatgagccacctttatcagttagttgttgagggcaagcattctgagagcccatttcccagaagccagccaagggcccaccctgcaagcattccttcctaaggacagtcgtctcaggcctgctgtgttaactctcttttgcacaatccccctccatcttttttcctagcaacttagttttgaaggaagtgggttgtttgtctgcagagactatccctcagtatagattttgttgattatttcactgtgatttcctttaacgtattattttcttccttatatttcctataagcaagtagttggttctagaagttatcagattctagaccctttctttcattgagggctgcaaaatgacaatattgtaattctttatttattaacttaaatacttacataaaaagagattcccggccgggcgtagtggctcgtgcttgtaatcccagcactttgggaggctgaggcaggcagatcacgaggtcaggagttcaagaccagcctggccaaaacagtgaaacccgtctctactaaaaacacaaaaattagctgggcatgatggcgggcgcctgtaatcccagctacttgggaggctgaggcaggagaatcacttgaacccgggaggcagaggttgcagtgagccaagatcacgcctctgcattccagcctgggtgacaaagctagactccatctcaaaaaacaaaagagattccccctcattgactatttgattactctgaggttccaatcctacctgaaaggtaggtttttggtttgttttttaattactggttttttttaaaatgatgagttgactttttaggaacctccaaaggtgaccaatgagtggatttttttttaagtatcattacgaattcatagatttaagtatatttgatgtgtttcaatccactgctcttagtatggttttgatgctcaaagtgatccaccattaggcagaagaggcctcttcaacattgctgagtcctttagatacaaccccagttgtttttaatagctttcttggtttattcttggttttttcgttcttttttatcctggataggagatagtccatttctccaaggattcctgcttcattttaatgtgaaatggtatttattttatttatttatttatttatttatttatttatgagacggggccttgctctgtcacccaggctggagtgcagtggggcagtctcggctcactgcaacctccacttcccaggttcaaacaattctcctgcctcagcctcctgagttagctgggattacaggcagctgccaccaagcctggctaattttttgtatttttagtagagatggggtttcaccatgttggccaggctggtctcaaactcctgaccgcaagtgatccacctacctcaacctcccaaagtgctgtgattacaggggtgagccaccgcgcccggcctgaaacggcctcccaacactttgggaggccaagggggaaggagcactagagaacacaattggaactcaaaggtgttccttgctactgagtagatctttgtttctaagccttttcagtggacaaagctaagaagtatgctcttaagtctcacttgcttttgtgtttgttttgtgtttgctcacaaagagaaaatacttcgtgaattcatatttctgtttttcatttacttttagaattacatattttttattccacttttagaagaaataataattttttaaagaattatagatgtctaacttcctgatttataactttctaattttattttattttattttattttattttattttatttagttatttattttgagacacagtctcactctgtcgcccaggctggagtgcagtggcatgatcttggctcactgcaacctctgcctcccaggtacaagcagttctcctgcttcagcgtcctgagtagctgggattacaggcgtgtgccaccacaccctgctaatttttgtattttttagtagagatggagtttcgccattttggccagagtggtctcaaactcctaccctcaagtgatctgcccaccttggcctcccaaaatgctgggattacaggcatgagccaccacacccagcttctaattgtatttaacttccctgattttatgtttgtatcccttaagctgaaaattttgattcctaattgcattaacatgattattttttgttttattctaaaatatttcaagtagttacaaaatatcaataatattaataatacagttactctgccaaaaacaattaaatatttttctcatagttccttttatccataggtatatgctaccaggaatgtgccatcaaattattgtttttaagtcatttgtaacatttgtctgtgtgtgtgcagttgtgctaccaagtggctaccagatcatttatatcatgttactttccgttttggagattgctttttaggccagtgtggtggctcacacccgtaatcaatcgcaacactttgggaggccaagggagaaggagcactagaagccaggatttcgagaccagcctggacaatatagtgagactcccatctctaaaaaaaataaaaaattagccaagtgtgctggcacacacctgtcgtcccagctactcaggaggctgaggtgggaggattgcttgagcccaagaattcaaggctgcagtgagccaagatcacacctctgcactccagcctagatgacagagcaagaccctgtctcgaaaaaaaaaaaaaaaaaaaagcaagagagataaaatacatggttctaaagtcaaatgtacaaaacaaggtatattcatacaaatccggcttccaccctcattgcctttgccttgctgcttccctcttaattcaataggtaatttttttctgtcgtttttggtgtattcttctgtttgctcctttaaagtataatcaaatgcagtctgggcacggtggcacatgactataatcccagcactttgggaggccaaggcaggtggatcacctgaggtcaggagttcaagaccagcctggccaacatgatgaaacccctatctctactaaaaatacaaaattagcccgtcatggtggtgcgtccctgtaatcccagccactcaggaggctgaggcaggagaggagactcgcttgaacccaggagtcagaggtagcagtgagctgagatcacaccactgctgtccagcctgggcaacagagggagactctgtctcaaaaactataaataaataaataaataaataaataaataaatgtaatatattcatggcctgcccccttagataagtgataccataccatcaactcatttttctacctttctttcttcacttaccaacataacttagagattatttcataatagtaattataaagctgggcgatatagagagacccccatgtctacaaaaaatttaaaaattaaccaagcagggtgagcaaatgcctgtagtcccgttactcaggaggccaaggtgggaggatcattggagccccagatgtggagcttgcatttagctgagatcctgccactgcactccagcctggacaaagcaagaccttgtctcaaatttttttttaatttaacttaaaaggaaaattttgaacaaagatgaaattttggaactgtgctgccatactactactcctagaacaaatgcagagtttctcaaaggtgtcggaataacatgggcttaagtgagatactggcagtggcaacagaaatgtgagaatttggaggtagaatagacaggatttgctctctaccttttaattagtttccaaggttgagggagtaggaggggagggtgaaagggatatcaaagatgattgtaattcccagtctgagctcaacagtaaggttggtggcatcaggccgcagccctcctttctctagagtgacagtgacacatttgctctttgttttcttttgtgtgactagtgtgccctgtagtatttacactgacttcggaagcttcctggaggtcaggaaatggagcctgggctttatccactccctcactgttttccctcccatcttacctcagggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggtgaagggggtgtgggtgggctgagacgggagggatgagtcaggggctaaggaacatggagtgaagactacggtgtgtttactgaagagtaaagacagcgtttccccatgacattgggacaggagttagctcttctaagtctgctgtcttcatctgcttatgtagatggtaacttacaggccttagcttagcacttatgtgtcagccactgtaataagcatttatatgcactatctgtattcttcaaaaatgaccttgtgaagtaggtattattatccccattttatgggtgaggaacttgaggctcaaggaagttaagtagctttctcacagtcactcagctaggaagtggccagattccaagtctaggtgggtcgtgggagctgggccatcgacagggcaaaggtgggctggtttcagagaaaagctaaaaggactggttcttctccccgccaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagccactttgggggtgggtagcagctggggtcctggttggaggtgggggcagagaaagaaggtagcgtgagagcaagtgcacaggtcaggaataagcgcagcttcacctcccagtgcttgctgtgctcccgctacacggtgcattatgctactatatgtactcatacagtactcttgagtacagtgtgtactgtgtgtactcaagaatttcacaagggaggctttattatttctttctttctttttttttttttttttttctttttggagacagagtctcgctctgtcacccaggctggagtgcagtggcgctaactcgggtcactgcaacgtctgcctcccaggttcaagtgattttcctgcgtcagcctcccaaatagctgggattacaggcatgcgccaccacacccggctactttttgtatttttagtagagatggggtttcatcatgttggccaggctgggctcgatctcctgaccttgtgatctgcccacctcagccccccagagtgctgggattacaggcatgagccaccacgcctggcttatttctttttttacagattcaaaaaattaacctcaggtcccataatgagtacatagttgcagtaaaattcaaacctatgattgcctgactccagcgcacatagtcttactaccatgctgcactacatgagagcaagtatcaatgcagcaaactgagagagaaggtaaaataagtcaagaccagaactaacatttaaaatgtttaataactagtacaacaaaaaattagccaggcatggtggtgcacgcctgtagtcccagctatttgggaggctgagatggaaggatcacttgagcaggaaggtccaggctgcagtgagccatgatcatgccactgcgctccagcctgggtgacagagtgagaccctgtgtcaaaaaaataaataactagtgcagctcagatattgattaattagaatggacaccagccataagcaagcagtatatctgtaccaacacattcttactcttagttcagaccacacttaacctccagtgcttctcctctccccactaggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccaggtgagattctatctgcagttggggcaggagatctggaatgataaagggcagaagctgggagccagggttccctacatacctaggaaaaggaatgaaggaattacggggactggagctgtaagttgaacactttgggattcccaatctgctttcttttgcatattgctctagaattggagcccattgtgtcaagagctccagtgcagggcagcatgttgactggaaataaaataatacttctaaaatcctttcatgatctttctaaatacacagaaatttcacagaatgaccaaaagaagtattctcttctagtccctttctatggctcctgtcagcctatatgaaatgtgcatgcacatctagtatagactctccctgtccctgccctttgttctgaagggcttatgataaaaagtgttgtgcaactcaaagaaagagaagtaatgggatttgtacatgtatattacatagtcagcccagcttggactcctccaatatgagactatgagctgatcatgtcccatccctcagcagggcacctccctttatttgtccccatcctcaattcctttttttttttttttttaattttaaaaatacagatggggtctcactctgttgctcaggctggtctcaaactcctggcctcaagcaatcctcccgcctcccaaagtgttattacgcctgccattttttctttttgtttttttttttttcgtttgagacagatatctctctctctctctctctctctctctctctctctctctccctctgcctctctctctctctctcttttcccccctcccccagggggagtgcagcctcagtctcccaggttcaggcaatcctcccacctcatcctcagttcctaactccatcactgtaccttctccttgtcactaactggctttagtcacaagaagccaccagctcccctaactcctccagattgtctgttaatcatagtcacagtaactatgtctgtctccccatcagagtgctcttaaaggctgtttttgtctgtctcccctttgagatttcttcttttcccttcccctgcaagcaaatcgggacttgtacccaaggatcctgaggagtgggatgatgtggctttgggggccttggctggagggccagctgcctgttagtcatttccttgatggtgggctgcccctttctctgttctagattttcatcgtggaatttgggggtaaacccttcagttgtacaagcctcagcctgtctcagtggctgtggtgtctcttcattgggattggagaacttctgtggggccaggtgagtaccggcacaccctcctggtgcattctcacagcctgcagaactcccctcctctacatgagatggaacaagcaacggtggagaccccccagctcctcatcttcatcttctcctcttccctccccacccccactcaagttttcaagttcttgccatctcataggatctcaaggtggaatgatcacttcagaggtttcagaattcttctctaactaagcctggaggtagaaaaatcccttagcttggctgggcgcagtggctcacacctgtaatcccagcactttgggaggccgaggcaggcagatcacgaggtcaggaaatcaagaccgtcctggctaacatggtgaaaccccgtctctactaaaaatacaaaaaattagctgggcatggtggcaggtgcctgtagtcccagctactcgggaggctgaggcaggagaatggcgtgaacctgggaggtggagcttgcagtgagccgagattgcgccactgcactccagcctgggcgacagagcaagactcagtgtcaaaaagaaaaaaaaaagaaaaatcccttagcttctctgagacagaaaccaaacttttcaatggaattttgctacaaaaaaaaaatatataataagggtcttagaagtagaagagtttacaagacacatgtctttattctcatgaggcagcaacctggctatgggctgtcgagctgacataattcagggtttccagcctcttctctttcttgccatggctttatctgggtggaattcttaactcttacctgagataaattcagatttacaagatctctagagtagcagtatggcctgtggttcagagcatggactctgggaatgactgcctgggtttgaatccagctctctgtttttttttttttttttttttttttctgagacagagtcttgctctgtcacccaggctggagtgcagttgtgtgatctcggctcactgcaaactctgcctcctgggttcaagcaatttctcctgcctcagcctcccaagtagctgggattacaggcaaccaccaccgcacctggctaatttttgtatttttactagagacggagtttcaccttgttggctaggctggtctggaactcctgacctcgtgatctgcctgccttggcctcccaaagtgctgggattacaggtgtgagccaccgcacctggcccagctcttgttgcccaggctggagtgcaatggtgcaatcttggctcactgcaacctccaccctccaggttcaagcaattctcctgcctcagcctcccaagtagctgggattacaggcacccaccaccgcgcccagctaattttttgtatttttagtagagacagggtttcaccatgttggctaggctggtctcaaactcctgatctcaggtgatccacccgccatggcctccgaaagtgctaggattacaggcctgagccaccgtgcccagcctcagctctcctttttataagctgaatcatcttgggcaagttacataaccaatctgtgtctcagtgtcttcagcttaggaaaacaaggtcattgttaattagtgaatcagttactatacagtaatgaataatgtcttattccttataaataatcaaattttaaactattacgattataatagtatcattaagtctaatagtttcacttcttccttaataccactttacaaacctccctcatcctcagctctggcctgggctatacctctctttacagaccccaggtctctgcagataatcccttagtgtccagccacccaggtaatggacactttgccctaactggcctcaaagagccatttctggagctgcaggccttctcccctaaacctgctagttatttatttcatacctagatgcctccctgaataatttctttttcttttcttttcttttcttttttttttttttttttttttaagagatgggggtctcaggccaggcgcagtggctcacacctataatcccaacactttgggaggctgagtcgagcagatcacctgaggtcaggagttcgagaccagcctggccaacatggtgaaaccctgtctctactaaaaatacaaaaaaaaaaaaaaaaaattggccgggcatggtgacacatgcctgtaatcccagctacttgggaggctgaagcagaattgcttgaacccgggaggcggagtgcaatgagctgagatcacggcactgcactccagcctggatgacaagagtgagactctatgtcgaaaaacaaaaaataaagagattggggtctcactatgttgccaggctgatctcaaagtcctgggctcaagcaatcctcctgcctcggcctcccgaagtgctgggattacaggcatgaaccgctgcacccagccctccctaattaatgtctgacccaattccctccaccctgttctgtttggtgaagatttctttttttttttttttaccaatgggttcctaaagcagttttatgctttggtaaagcttggttgttaaacctgttgtttgaaactctgttctggctcttgcctcacatgtggccatgtggccttgctgccagacagcagccttccttctgtatcacaacagctttttccacattcagaggcagagctctggcattcttcccatttcaaaacccttgactccatatcagattgcccatacagtccctcttccccacatgagccctggctactccttatcttgtccggaaagaactgactgacaggtgctgagctcaccgggaaatttatttcaaatttcaaaccctatgtactgctccttgtcttctgataatactcatgtgacccctcttctatggactgtcccatccacttcctcacctcaagcccaagaaaacttttggtatcctttcacaagagtttgtaacacagaaactactttgcatgtggcaactaagaaaggggtcattcatttccaatacccttctcaaccccttgcctatacataggcaatatcaccatcttctccccaaactcttttcccccaggtcctggtctctgtttcttcctactgcgtaccatgctgtatagttctgttaaccttaaaagacagattgcaaaatggaacagaagaaatgagacagaaagaggaaaatgaagtatatgaccaggcagatggctggtcaattactagaatagaagctctcttttgtgtgtgtccataaatacagaaaaccttcctaaaagcctgaccgctggtgggcacttggagaatgcttgcctggatggattggtgcttctgcccactgctcttccagtgggaagggtggtagggcaaagagtaacctgcccaagggcctggctcatgtaagttgactgacagctcttctcacgctgattctgacgtcttcctcttcgctgcgcttgttttcagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcaggtactctgatagtggtctgtccttcccttgggagaagcagcttcccatcttggaaggtgttgggagggtagcagttcttgtcggccagcatctcttcccttccaaaggctcactactgatgggcagccctagatcctcagcttcaggacagacacgcaaaaggatctgtgtggggtcctctgagaggagaggagtcaaatgacctagaccatgggacactattagcatagtcctttagctctgggttgaccctaaagcccagcctgccaccctctatcaaatgggcaagcttcagcataaggtctcttgcaagcactagacctgaccccagggtgggaaatgctcagtttttccctacccttcagaaggaaggagttagacaatatcaatatgccaacatacccagcattcacttaatatagcttcctcacactgccattataggaatagatgctatctggaagggtctttgtaaaagaaactcaccttgttatatctcccccattcaaagtgtaaggccatggtggggaatctgatggtttcatgtgtaaaaatgacaatagtctcttgatgtctgagcatcttttgcaggattcagacttgcttcctgacaaggaggaagcaataatttcttcaagcctcttcccttcttgcaatttctgaaatgggatagaagccacccctgctgctcttatgtcccctgtctatagccccacaataacttttattttttccactttccatgcatcaattgtaactactttctcctgggtgaatgcgctgatctaagcattgataattctgtcttcccctgctctcaccccccatagctttattgttttaatcctgagattttccatttcaaaaacactgtaaattccaagatctcaagggtggtctccagaaaacaggcgtatttctctctgctgattggctagagatcttcaaaataagtttcactgtctaaaactggccttgcaaatgttttagaaagttccccagtcggccaggcatggtggctcacgcctgtaatcccagcactttgggaggccaaggtgggtggatcacctgaggtcgggagttcaagaccagcctgaccaacatggagaaaccgcgtctctactaaaaatccaaaattagccgggcgtagtggcacatgcctgtaatcccagctactcgggaggctgaggcagaagaattacttgaacccgggaggcagaggttgtagtgagctgagattgcgccattgcactccagcctggccaacgagagctaaactctgtctcacaaaaaaaaaaagactgggcgcggtggttctcacctgtaatccagcactttgggaggccaaggcaggtggatcccctgccttaggtgaaaccccgtctctactaaaaatacaagccaggcatggtggcacatgcctgtagtcccagctacttgggaggctgaggcaggaaaatcgcttgaacccaggaggcggaggttgcagtgagctgagaccacaccattgcactccagcctgggtgacagattgagagttgtctcaaaaaaaaaagagaaagaaaagaagttccccagtcaatcccacctcgttagtgtataggagagatagatggagtgaatattctaaactatatacctggtaggaacttatcccctataggcaagacaacaaatagaaaagtggaaaagaggccgggtgcggtggctcacgcctgtaatcccagcactttgggaggccgaggctggcagatcataaagtcaggagttcgagaccagcctggccaacatagtgaaaccttggctctgccaaaaatacaaaaattagctggacgtggtggtgggcgcctgtaatcccagctactctggaggctgaggcaggagaatcgcttgaacccggaaggctgaggttgcagtgagctgagatcgcgccattacacaccagcctgggcaacaaggcaagactctgtctcaaaaaaaaaaaaaaaaaagaagaagaaaagtggattgcagactcactatgcacctgactgtacttccaggcaggtgctttttctgtctgccagagaaacattccagggtgctgtggctgcctcacctatccagggcgatgcagctccctggggacacaggtgcttcctggggagccctgagcacttctccgtgttgctggcctcacatccaattgggcaggcattggagtccgggcactgcctggagctcaccagaaggtgctttacagtggtccttggtttgtctctcagagggcttggtcccctctgctgtgaggctggactgcagctgtggtggcaagtgaccagatgtcactgagcagcctgaccatggtctaggtggtgcttggatgcatccacttggcttcctttggtcattgagtttcaagaagagaaactccaggagacggcttggccaggatcaggcaaaaacaatcatgccgaaaaagtggcagaaaagcttgaaggtctctcagtgaaggaggagaccaaggaggatgctgaggagaaacaataaatcgtcttattttatttccttttcctctctttcctttcctttttttaaaaaaaaatttaccctgcccctcttttttggtttgtttttattcttttgtttttacaagggatgttatatgaagagctgaattaaaaaaaaaaaaaagaagaaaaagaaaagtggaaaagggctaggtagggaaacgctagggttccttttccctctctcaagttcctcctctcagaaagaaaatttccagcgggacctacacaaagtgcctcgtggcatccaggcatccagaatccccacgctcactccctaccccaccccacactccaggctgctgactccaagtacccatagaacctggcgcctttggctcccatctctaaagcccccagtgctttcctttgggtctgctctttccaaaataacctgtctttgctttgtttttcttcaggatcaaccacttctactatgtgatttcttttctcctagccaagattccctcagtccagtacctccttgctcctttccagtcttctgtcctgggaggctgagatttatgggtcttccttgccctccactaccaatttctatttccttgactatgcccctctctacaaggtctttttggtttcactgcctacatagctttaggtatactacctttccgcattgttggagcatgaggcagttgggccaaaatggcattaaagcctaaagtgaggcatgttcaagatgccacagtgaccaaattcacgccatccaggatgcacctgactctggaagctgatgaggctaatgatgctaacgtgtatcctggatccctgaggtccgctcccaacatcagcccttcagcctcagctgggttctaacaaaaccccctgccacctccacgttgatctttgttgtcattctcatcgcagtgctttggtatgggaggtgttagaaaacttagagactagaattgtggaggttgggaccttgtaactccaataagcactgaagaaggtgtctctacagtcccttcttccatggagctggaacccccgcacccaccccaagtgtaaaccctctcctcctgcaggttcaagctcctcagtcccagggaactaaaactgaataatgtgaggaagcagtgatgtttctgctcaaactgtgatctggatccagaaactagccctaaacagctcatggcttctcaggaagctttataaaaggactgtctcactcacattctgcctactttcccatcttccctcctgggaaaatgaagtccagttaatggaatcagcacctttccttcattcctggtagattaacccttggcattaagcagatagatatttctaagattattctaccagattcatgaaggctaaagggaattccttttgattttgtccttgttacttaggggtcagggataaggatggtagagttgattgaggccctagatcaggaccattgtcagaaaatgaatggcatggccgggcgcggtggctcacaccttaatcccagcactttgggaggctgaggaaggcaaatcacaaggtcaggagttcgagaccagcctggccagcatggtgaaactctgtctctactaaaaataaaaaaattagctgggcatggtggcaggtacgtgtagtccctgctactcaggaggctgaggcaggagaatggcttgaacccagcagatggaggttgcagtgagccaagatcgtgccattgcactccagcctgggtgacagagcgagactctgtctcaaaaaaaaaaaaaaaaaaaaaggaaggagggaggaaggaaggaaggaagctgggcacagtggctcacgcctgtaatcccagcactttgggaggccaagaccggcggatcacgaggtcaggagattgagaccatcctggctaacacagtgaaaccctgtcactacttaaaatataaaaaattagccagcctggtggcgggtgcctgtagtcccagctactcaggaggctgaggcaggagaatggcgtgaacccgggaggcggagcttgcagtgagccgagatcgcaccttgcactccagcctgggtgtcaaaaaaaaaaaaaaaaaaaggaaggaaggaagaaaatgaatggcattaattgcctctgtctctgaggaacagggcactgaaaaccagaggctacttgtgtaagcctcgacctgtagctgtttcaaccaccaccaaccaaaacctcttcctccccctccctcagtctaattgccgagttactgtcagcatttctgccagacatttcagatctctaatgcattaatgcacttagtagcattctcgatagtgggcttggccactgggttcttgagctccattctcagggagcctacctacttcagcccagggaagggatagctcagacaagatacccagaggaggatgagcccagcaactcatggcccaggggtctttccatcatggccatttgtatattggctactaaatggcccctgttttttatttaaacacatgagttattttcctggaaaatccgcaaaaatacgtagtcggtttaattgatttagaggttcctgagccttcaaattcagtaatacataatttgccttcagaatcttcaattgtttgccttatttttaagagtacaggtaaaaaggggcctgtaggtggaggttgcagtgaaccgagagtgtgccactgcactccagcctgggcgacagattgagattccatctcaaaaaaaaaaaaaaagtacaggtaaaaacaacgaacaatcgctgtctagctgttaggagtgatggagtagggaaaagtccctttacattttaaatactcttggccccctctaaacctcaaatgcccactgtggattcaaagggaagaaaaaactagattctggctgggcgttgggactccatggcaaattgttccctaagtgaagtatgatatgcaattaacgtttttctccttctcctcaccattgctttttgtgggagggaagctctctcttgctctctcctgtccccttttcccatctacttccattcctgcttccccaaccttccatgaccctcccttcctctttcttcacctctctcggactgactgtggagcaaagctgtctcactctctgattctttgcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataattctgttttctgattgttcctctgcattgctcatttcttccttttcttgagttttgttttgttttgctttgccttttttgtttgtctgtttgttgctttgctgggatatgttgttgttcctctcttctcctcctgctcctttgagtctgaactctacctcctaagcttagatgtgaggttaggccagaggaaaacccaagagctttctttacatgggggcaaagtttgggatcttttgaggaaaggtaggaagggagctaatgtgcccatgggtgtgttttgactagtggacctgtcataattgagccagtattaaacttggtcaataataatagtccatttggccaccactgtattgctgactggcaattttagcataaaagttgtagctggctgggcacgatggctcacgcctgtaatcccaacactttgggaggccaaagcagatcacgaggtcaggagatcaagaccatcctggctaacatggtgaaaccccgtctctactaaaaatacaaaaaattagctgggcgtggtggcgggcacctgtagtcctatagctactcgggaggctaagacaggagaatcacttgaactcaggaggcggaggttacagtgagccaagtggagagccactgcactccaccctgggcgatagagcaagactctgtctcaaaaaaaaaaaaaagttgtagctataggtgaagaaaagaaagtagttcagttcaaatgtatatggttgaacatccccgttattttacttttctgggactccggtttaaaaatcagttaatcttggctgggtgctgtggctcacacctgtaatcccaactttaggaggccgaggtgggcggatcacctgaggtcaggagttcaagacctgcctggccaacatggcgaaaccctgtctctacaaaaatacaaaaattagccgggcaatatggtgcgtgcctgtaatcccagctactcgggaggctgaggcgggagaatcacttgaacccgggagtcagaggttgcagtgagccgagatagcaccattgcactccaacctgggctacagagtgagactccatctcaaaaaaaaaaaaaaaaaggccaggcacagtggttcacgcctataatcccagcactctgggaggccaaggcaggtggatcataaggtcaggagttcaagaccagcctggccaatatggtgaaaccctgtctctactaaaaaatacaaaaattagccaggcatggtggcacgtgcctatagtcccagctactcaggatgctgaggcaggagaatcgctggaacccaggaggcggaggttgcggtgagccaagatgctctactgcactccagcctgggtgacagagacagactccatctcaaaaaaaaaaaaaaaaaaaaaaacgaagaaaaaaaatcaattagttcacatgaaggtacgagaaatatacaaaagagtcaaaataacattttttcttcatttactaaacttttaggagtttctgaagaggagtgccttttattttgcttctccttttctctagtttgattgtttcaccaatagccagcacttattttgcacataaagtttcaggaagccctttctcagccggacttgcaattggagtattatcaactcacaacctaagatctggtgttcccattggtagattcttggattcttgctaatgcttatgtcttcctattcctggtcattttcccttccccaaatgggactcagagaggagagagaaggtagccagctctttgctgataatgtgggaaggagtttatctgtattaaatataatgtgggtttcaaatagctgagtgttcagtctgttccttcctcccccattcccaacctcaccaccccccaccccgacctctgcaaaggggctcaagaaagaacagttgccttgtctgtggttcacatgatcacggactgtgtgggttgaccagacttagatttgttttgtctctttagccaaagtgttctgatgtgaggaatgggggtggaacttgatagagatacatacaatttctttaggtcaaaaaaacaggcaagaaagaactcactaagtcttgccctgcaagtatccaggaacctctcccaccagttctttcatattcctctcttaattccttttttccttctagttctgccatccccttctaactagcttctgttctgttttaatcatccctttctgataggaagggttagtgtcagatatcctgatggtttgatggtggaaggagactaagtagaagactaagcagaagactgggatcttgtagagcagctggtagagggtgtgctccaaatcctcaaagactagatcagaggagagacaggccacacctgctctttctccagctgtgcctttttagttggagctcctagaagttatagccatacattttaaaaccctctttcccattccagatctccaaatgaattcaactgtttgtccaaccttcattagatagatctctaagatttccctgcatagggaggccctaatccttttcttctggtttctgaaaagagcagaaaactgcctggcgcggtggctcacgcctgtaatcccagcactttgggaggccgaggcaggtggattacttgaggtcaggagttcgagaccagcctggccaacatggtgaaacctcatttctactaaaaatacaaaaaaaaatagctgagtgcggtggcgcacgtctgtaatcccagctactctagaggctgaggcaggagaatcgcttgaactcgggaggcggaggttgcagtgagctgagatcacgccattgcactccagcttgggcaacaagagtgaaactccatcccccccaaaaaaaaaaaagcagaaaactacagaatgagaaaatggagtcttcacctgcccactcattgagctgcagagagtagccctcagcactcatacccagtctcctgagtcatgaaaagagttgcccttcaaccagccacttccacctgtaggccagggccccaaaagagacatttccccaaggttttgagaaatgatgaccaggaagggaagggttgactggctgtgtggagagtgctcaaagctttccctgcaccttcttcactagccctgtcttgtccccatacactgctcatgcaccaggcatcatgctccaggaaggggagatgccagccctgggtggattggtggtgatatagtgcatgattgttcatcagcatgtgttctctgaggccagtgctggagttggggcatcctggcacagccccatgccctctcctccctcacccttctctccacccaccaagccagctggtgctccctagctctctgacccctcttcacgtgagcttccttacaggtggctggtttccctttagattccagaagtcctgcagtctagctggatgactgtttcttgctccccaaaagacatttcccatattttttccatctacccatccccaattcacttttatcttcctcattgtttacctgtaacagtattattggtcaccccaacaggtgagaggaaaagccaacaaacagggctccagaccctcactccaaccccagttgttacaaatttattttctatagtggacttcacatgtaattttttccaacaaagtattcaattgaatggaagcaggaaattgaaaatcactgatattgaagatgatgtactggcggataaaggcacctgccctcctgtaatattcagtagaaattttgagatcttgaaaacatatgaaaaatgtgggctatgttatcactcctgacagtgatggctttgatggagtgggatgactttggacccatctcttggccagtgtatctgtgccagggtcaaaggagaaggcactgggtttggactcactcaatccaaattgccttgctctgagattttatgtagatcagtgaaaacttgagacttcctgaagaccagatggagcctccattccatctgatctcacctagatctggagcaaaggcaacatgataggtaaaatttgcacatcagatggtcaaataggaatcagataataaaaatgtggtcctcgctgtctgttcagcatggtgagtgtgtgcctgtgctccctgattcttcttggctgaggtgttgagctgatactgttgagtggcaaggagtcctttgccttctgagctttgagcaccctcagtcttgggtgggtctgcaggctgtagtagagtgggacgagataaagaaagccttagccagcagagacacattctcctccagagaaaacggaccaacagtattgatagtgagccttctttgagtggtatttatgaaggttctgtatggtggtaggaagcactggaacaggtgatccaaccagtttatttggctgactctctgtatcctctgctgtctccaaattcttgtgtcttctcctggaatatatttttggttaaacagcagaggaatgaaagaggtaccctacccccaccttcatcactcctacccctccaacctcaacagtttcccccacattactcccatttcttttctgagtgaagattttttggacaagactaggatcagccaccttccaacaactagaaccgtcctacaaccatttacctttcccctggcccctctctccaacttctcggagctccaaccctctccccctaccccaattctaccatccctgattctaagccacgcctcagagagacctgcagttcagaaaagcagagctgccaaaattgctggtgcctgtggacaagcaaaagctgttcacaggcatcaattattgtcagttttttcttgatgactctgaactgaccgaatcccttcctttttgcgcagtaagacagagactatgacactgggcaatgcatctccttttgcccagtaaaaccgcacgtggtttcctttccttcatcctcttcatccaccccatcagaaaggccacttgtttgtagcactgcctcctggattaggtttctctccctggtccctttcattcccttctccacataagactatgctcctcttcacaatttggaaacagctagagaaagcagcatgattgggcacagttgctgtgtatcagagacatgaacgtgcatttgaattatgagagccaggtcttttctcaataggcaggaggaaggcatcttttgacacctgtattttatctgctgcttctagggaaggggctgaaggagtgaagttctgtgttatttgcggggaggggacacagtggtggttgtgggatataaaaatatgcatgtttcctggctgaaagggcaaattattattagagagttttaagttcctgcatgctgctgacacaaatgaagattggtttgtctgcctggctgcacagttttcatggtcactcgtcacccaacctgtattatgtgcagattggtgtatgctggctctttgaggtctttaaacagataactaaacctcaatgcataatttttccattccacattcacaaaatgtttggcctcagcacagaaatccacatatctcaatcatctttttaagtttggctatgaatttgcatctagttcccatgtccttgccctccatctaaaagaactaatgaaacttcttgttttctgtttcattttaaaagtagattgtttgggaatgctaacgttgctttgggttttctactttttttaatgcagctttcaaaacgtcctagttgccgtcactcaccccagcccaccccactgcttgaaagttgagccatgtgatgtttctagtgccccatgatctcttctgatgtgtgtttggttttgatgctgagcagtcatgttttatagtctgggttttgtttctctcctaaatccaccatctccttgttctgccggccaattctcacctctctattttctcatcctccttttccttcccctggtatagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgt

SEQ ID NO: 37633 - DNA, 117519 bp, Homo sapiens; identical to SEQ ID NO: 37632

SEQ ID NO: 37634 - DNA, 290518 bp, Homo sapiens
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccaggtgagatggaggcttttcttttcctttcttggggttttttgtttttcttcctcttgcagggggaaacaatgggaaccgaatcaccacagcgctttttttgaaaaatgttatttcttttctcattttgacaagcaactacatggcggaggagtaaaatttgaaggagcgttgttatcgaaagtgtaatcgcccatgccgagatgtggctgtgtacatatttgtgtgtgtgtgtgtgaatataggggtattcatttatatccacacaaacacacaggcatgccgaaaatactgccaactgatccaaaagcggccctcggcactttttactgctttaaaaaagtatcagagaaagcagaattgtcaagttttgaacagcattccatgccttcttgttgaggggactctgtaacattacgaaataaaatgtcccaagaacactttatttgcaaatttagttgactccttacctaattcagcgagtttgattttctttcttgactctcccgtccaaaattaatttttatcttttctcctttcttccccccctacccaaaatacaaaacaacaaaaaagcagggtatttctttgtcagtacttgtcagctatccagaaaatattttgcattcacttaattttgtttttttaaaaagttgatgaaaaggtgattttgtttttaggcatatttgttagttttaagagactcagatttttagtttaactttattgtctcctaatttcagccggtttactaaccttccgtgacacagacagctatgtagggtcctttaaaaaggggtggggggacaaaaatcaagcatgctcttttcccccatgcttctttcaggaccacttagaaatgaaagcatttatgaattttatatatttcagtactataggacatgaaggtcttcattaaggaaacataataaactgtgtagcctctcaagttaatccactgccaggtatatggttctctacttcaggattttacagtaaattctcttttaaagtaaaacatagactaagtgacaacccgctaacagcttgcccaaggccgaactcaaaaggaagaattttaaaaatctaatgaccacatatgtctgtacaattacccagctttgttatatctccgaagtagcgtttttctctttgaaaaccctgtaaacaaatatacgcaactcctatacttcagatgacttggttatatggagaagacatcattatgtgtatttctgtctacgtgaaataagaatctgagttgagaaaatgagaggaagcagttaaaaacatagatgttatgaattatactcaattttagctgcaagcacatgcaacatgtaaactcaaaagtactaaggtttacgggtgtttgaaaacttggaaatgttgaaagactcaaagtatcctaagttttgtttaaataggggaaattttaaaaattaattggtgctctctttgaattttattatctgaagaaaagctaataggtatggtaagaggaagatttcccactggcaattctcttttgaattggaacatttttctctattatattgttctagaagaatactctcagacataccaataaactggcttaaaaataagtttgtgaagtggaaggggctagtaagaatagatactacttttttgatgttcagtctctcttcttttgtgaaactgtggacaaacagggcttggcgacttccccctttcaatggcctagatgcagagagagatcagatacaattttgggatggggaaattttcagttcttcctctgtagctggctccatttgtgtgctgtggaaatacaatatttttataaagctgtgtgagaatttttgtttgcatttgggcctatatataataatagaattaattaaaactattttaaaagacccaggaaaggtctttaatactttaaagtattttccatctttttttttttctaccccacatgagaacttactaaaatcaacgctaagctttctttttggataaacaatgtaactccacttagtagatagtatgtccttttttcctttttctagtcacacctttataatgtgtatttattatttacaaaagtaaaccattaatattttagatataatgtatgtgttcattttgatagtcctgaattttgactttattactcccctgctgtacagtacatagggcatgtttctgatctctgttcttcatgaggatgtgtctattttttaactttcaaagggattaaaaaagaattgcatgtgttttgagtgccagaactttccatttatctttacacattaattttagttagtagacagaattcacttaactaatagctgatatgatcagtattttgtttccaaaacagtatcattctgctaagtggttccataataaaatagaaggaaaggtattgttttgttcctcaagtgcattcagaatacacacacacacacacacacacacacacacacacacacacaccaggtaaatcactaatctaaaagacaaaattgcatttatttttcccccaatgggtgcaaggtcctaattgtaaataattgaatttcaacacctgcaaataagcagtgtgtgcacagaagcataatgtgaacacagagaaatgaatttattccccatatgggtatgtttgccccctggcaatgcatttccatactctttaacttggggactgaaatgttataaattgacagttctactcagaagacctttcaagcatcttgtgtttatgagaatacaggggcatctgcggaatgaattcgaacacatggatgaattaaatttgaaaacacacagaccgagaggcagacagttcctaggctgtggtcgttgcatggattttacaaaactgttaacctacacctttggctttgctgtgttcattgtcctgggaagaattgtgggtttaagaattactctttgattaaactacttaaaaaaaaaaaaaaaccctttccctaaatgggcataatttaggttagttctgttctgtagttaaatccctaccctctccctgctaattaacattatttctttttctatggcgggactctgtatattaagtcatgaaaacaactgaagcatgccacagagttagggttgggtatataattttgtctaaatgttcaaatgttttcaccctgtgcattatcggcagtttgatcttgagagtccacctaagctatcatgttgtttctttcttgcagaaaacatgctttaaactgccacagaatgaagcctgccttgtttaatgtgttgtgtgaaatcaaagaaaaaacaggtaggaatgagattccaacattttagcattttctttggccaattaaatcacttaaccagcagtcacaaatctattatttaaatattaaaatttcagaatacaagtactatgaaggttgacctcatattcgaataggaagtcctagccctgctttccttaaaaaaaagaatcaagtttctttgacagttattatcaagcactactggttaattttccagaactctatttccagcctttttgagattggggctaaaatatagattctgaaaggaaatttatagactgatgtatctttggggcaaaaatatgaaagtaaaagttcatttttttaaggaatatattttggcccatttttaaaaccctaatttttttggagttgggtgtgggggtgctaaactgttgaaagtttcctttcctttttttcttgtaattacacaaagcagcagactagaggttctcaacagagagtgttgtcaaatacctttgtggaatgcgctatacaacattaggttatcggtatttgagtggcctgtgattttattgcagggagaatcgttgggtttaggagagtataacgccatgagataattcactctgttgtttttctactttctagacctcgtttcgtggactaacacacttataacacatcccaggagggcatttaaattttaaagcaacaattaaaaaatagcagtcatcaatcagaggtgttcttaaacaacagatgctctgggaaggacatttagcgacatccccttgtttattttaatccttaattttccaaagtgggtaaagctctcccttgtaagaagaaagatttgagaaggcaatctgaaaccagggaataaagatgagggacaaggggtggttatataaagcgggagcttctgctgggctctgacttacccgctcgctttagagcagtgcaaagtacctgacatcctatttatttatttattttttacaacaaggagtgtaacagtcaataattcatatctaaaccatataagcaagggcatgacatgaatgaaagtgacaataaatatgattgcatgcttggttgatatacattgatagttacacataaaaaatgggcggggggagagggcacacagggtggctttctttttgagagctctctgtgtttttcttttaaaaaaatagtttcaagatgtgactgttgaatgaatatgtaattacttgggtcttgaaatgcgtgtaaaattagtacgcagctcctttgttgaatgttatttgtgttgtgcataacattctagacaaagcacctgagaagtgatgttcagacctctaagtcttccaggttgccttgccaaagcttaaccttattgcaaacctgttaattgcattattttagctgtgagacaacttttaaaagatttatggactgtgcattcaaatatcaaaagagttttttccagtttgtcacactttttagtttcttttttctattagcccagagtaggaaacttaagtgtgtgtgtatatatatatttatatatatttttttatcttctctcttttttcttctttgatctctgatgcttatttactttgagtgtttggtttgttgagatttgtttctaaccaagtatgagttcctgctgatcttgtttcatgaaatgtagaatcaaaatataaaagcatatgtgataatatggactaaagagagtctatttttgaagatactttatcagatttttattgaaaggaagcctgtcagggcacttaaatgtacattgtggccaaagtgcttaattctagtttcctaattaaaacctactgaggcagtagattaaagtgggtgggtgtgaatagagatccggttcaggtgagggttaaagagttcgctccttgttcatgttggctcaagtataatgataggaagtaaagtagtcagtcgtattggtcaaagtaacattctaaaagttttgtattttaaattttgtgtcaatacatttaatgtttagagacttaaaaaaatctaaattaaggttttttgtgttgtctctagaataacatatttaaaaaaacaatttacaaataatgtaattgaaagtgataagagtcattgccccctgtgttaagggacacacacacacacacacacacacacacacaagtcttggattaagagggcacccctgggtgaaagtaggggaaaaaaaaggcttacctccctcttagtcttcaacttgtgtgttggaaggattgaagggaaggcaaaaacctctcctggaatgttgagtgttgtgttaaaggtaggagtcaactgtggtctgctgaaaagaaccctttgattctaaagcacgattacttggctactcaagaccctggaaccttcaatctttttgccagcatatctttcatgcagttgatgggtcggaggaacaaagtgtctgtaaagttgcaggagcttttttttttttttccccctcttcttcttgatacagagctggtgaaaacatcgcttgagtgatcagttcacatacattcctttattgtttggggactttttctattgttactttcaagcctttttgcattaaatgagtatttttgagtttccatctcaagcattataatgcttataataataatagaggttacttgatttagggtgggctttgtttgtttgtattctaacacgaagttcatacatttggctcacctaggcagaactcttgagaggaacttggtaattgcattgatttgttatttttgcttttttgcatttgttaatgattttatagttggaagacttagaaatagatacaaaaactggctaagatgtattaccaaccttttggaactttaaaaatacatacacacatgcacgtaacaccccaaagtagaaggtgccatctgaattacaattgattgatgggtgtttaagtcagaaattactgtggggatatttaaaaaacaaaacaaaacaaaagaacccatgcatcttcttgcttcagaatgtgggtagtttttattctgatacattttcgcttttaaaaaaataaatgctaagaagaagtgccagcaaaatgctcgggtggcaattctcaaagagcagctaaaaaaccctgtcaagacctatagcaatgtatatttcacatgtggcttttatctgctcgctcattctaggaatacagagacaattagagttttggatcatttaatataacactttcttttggatttttaagatccattccttgtcttctggcatattagtaataggctaagttttgcatatgtgtatatatggtggtaatggggttggtgggatagaagaaaaggagaaaaagtcaagcatattacatttctttaaaaaaaccttgaatatatttttaaacatttcctgatgttttttattcctgtgtcaaaatcacgcaagtttaaaaattaggaaaacacgaaaaatattgaatgccatttactaaggagaatatttatagatagcaatgaatagctgcaattgttgtgaatagtttttaattttagaacataatagctatatatggcacttttcagccaattttcctctgtgcattgtctgcatcaaagttaacgcaaatcaaatctttggaggaggttaaaaaaatttattttttgctccttaacacccttttgttctctctctttccttttctctctgtgttcaattaacacccccatcacagaactgtagtgtgtgtgtgtttttttaattctactactttatttcacttttgacaccctcccttattattctcgcctgccacttctttttaatatagcaattacattatgggacttctcctctcctctcccctttaaagcattagagaataatttgtgtgtctatgtatatgtgtgtgtgtatgtttgcatatgtaggtggaggggcggtgggttatggaaggaagctagagattgcgggaagagaattctgatggtattaggccttgagcaaaataggagtaaaataactttaaaccatttagaagcagcctctgatcagattccttttggggttgaagtggtaggagtcatttttgtagaaggtcatcgatagccagcaaatgcaaaaacttttcttgctgatgagaaaattcaagaatttggttcattttttttttttctccctcctggtaaagatgcagaggaaagaaaaggggatcaaatgaaaggaacttacaaatcagttttacctgatgctatctttcaggtacagtgtgttaaggcagaagtaatgtggttagaccctatattatttatttattataatgtggatataagccgtagacctacaacaatataactctgacagacataatataagaagaacttgtaatgagaaatgacttttctttttagtcacttttgtgtattccatttttagtctactactagaattagaacaattctggcttttgagaagtgcaaagagcaatttggtcaaagctgccagaatgagaatttgggaaattttggtgtcatttttttctaacaataggagtgtctgtgaggattggacatgagagcgatttaggttatactgaaggatctggaaggggatttataagcggggaaacatagaaccttgtgaactaagagctgtggggcattgagctgggccgggtgtgggtgggttctgtacagtaggctgcactgttggctgagaagggggcattacctgcctgtgtgtttagttcactgctggtgccagacctattcacatggttttgcccctgcattctgttgacatccatgaactttttgttgtggttgttggcaaaattataaaaatacccccaaacgagcaaataaaccaaaacctagatgttgcacataatttaaattggaagacattttcatttgtaaagcatgaccctgacttcttttgtgtcataggcatatcttaggaaagcttattcttcaatttggtttcaaatctcttttagatggatgatactatgtttgaacttggtgaagcgaatctaaatattctttttattgcttttcctttaaaaaaaaagtttaccaaagcaccacatgatagagacagtgtcctaggtccagctccaaacagctcttattcattctcttatgaccctaagaagcacccattcattttcattgccatattaacctgatttggaggaatataataattttggttccattgccctttacctgcaatggtgtggtaagatttaaggaatgcaataattgataaataagtagagaattcatgagttgtttgtgaagtgctttgagttcctgtgggttatgtaaataattaaggcactgtattttctataataaattatctcaggattcatatcttatttcacaggatatcactgcatttcactctttcaggctaaaaaaaatgtacgtctactggtctttaagtaatggggtaatcgatcgtcgctcatgaggaaagttctctggttgtatctttgccccatctgcatctcaaagatggcacttctcggaacttagcagagtgatccccagaggggaaaaaaggtgcaggaatagattgtcataagattataacacctatcccccatgatggcagaataaggtcaatagtgtcttacccgaaggtcttcttacctctaacagctctctttcaatctctcaattattggtggaaattgagattgcaatgggtggaaaattcatcctttttggtttaggttgtagtttcaactgcatcttctactgaaacttttgtcattaagtaggtattggggtgggtatacctcacactctgtgctagttctggaccttctactaagtagttataagaccatagaaaagttgcttaaataattttatgataaactataatagtagtggttaaggacctggtctttaaagccagactctctgagtttgtatcctagatcttttacttcttaactgtctggccttattcaagttaaaaaacctctctgtgcctcattttccttatttataaaatgcagatcataatggtacttatcttagagggtcgctgtgaggttaaataaggtgatagatgtaaattacagtgcctggcatagagtaaacagtcaatagctgctagctgttattatttctggacttgttttcttatatgaaatagagaggcttataccagatggtccctaaagacaaagccaattccaagactctgattttatgctgaaaagagacaaaaattgctgaatttaagatttgctttctttttttccttgcattttttttttttttttttttttttttgtcaagagtctcactctatctcccaggttggagtgcagtggcgtgatctcggcccactgaaacctctatccctgggttcaagcgattctcctgcctcagcctcctgagtagctgggattccaggcattcaccagctaaattttgtgttttactagagacgaggtttcgccctgttggccaggctggtctcaaactcctgatctcaagtgatccgcctgcctcggcctcccagtgctggtttacagccgtaagccaccatgcctggccctgtttcccttgctattctcttaaagtgagaattagctatatctggccaaaagtctgggacagattggaagaagagggggaaaagagaatgggtaagaacagaggaaaagtttttaagctactttaaaaacttttaaactacaaactggacaacaaccgcttgaaaagctagaattgcatattaaggatggtgttttcttagcgtcagcaactggaggcattgtgtaatcatagttaaaaacatttcattttctctctgaagatacataagcctatccattcaacttgcaaagttccaaagcaggaaaagtagcacaagtgagtttagggcaacctgaccttttctttttctttctttttttaaattatactttaagttctggaacacgtgtgtggaacgtgcaggtttgttacataggtatacacatgccatggtggtttgctctacccatcaacccgtcatctacattaggtgtttctcttaatgctctccgtccccttgtcccccaccccctgacaggccccagtgtgtgatgttcccctccctgtgtccatgtgctctcattgtccaactcccatttatgagtgagaacatgcggtgtttgattttctgttcctgtgttaatttgccgagagtgatggtttccagcttcatccatgtccctgcaaagaacatgaactcatcctttttatggctccatagtattccatggtgtatatgtgccacattttctttatgcagtctatcattgatgggcattttggttggttccaagtctttgctattgtgaatagtgctgcaataaacatatgtgtgcatgtgtctttatagtagaatgatttataatcctttgtgtatatacgcagtgatgggattgctgggtcaaatggtatttctggttctagattcttgaggaattgccacactgtcttccacaatggttgaataatttgcactgtcaccaacagtgtaaaagaattcctatttctccatatcctctccagcatctgttgtttcctgactttttaaggatcgccattctaactggtgagagatgctatctcattgtggttttgatttgcatttctctaatgaccagtgatgatgagctttttttcatatatgtttgttggccacataaatgtcttcttttgagaagtgtctgttcatatccttcacccactgtttgatagaagacaacctgaccttttcttgcccttctagtacattccttatttaggaaaaatgttatctttgtcataaggacagccttgattcatagtagatttattcttcattatttttatagctttcttgaaatatatttctaacaccatgaaattcacccatttaaatgatatacagttaggtggcttttagtgtattgacaaagttgtgaacccattatcacaatctaattttagaacatttttatcagcctccttgccccctaaaaaaacccagtactttttaccaatcagtccatatttcccccttcacctagtccctggtaaccactaacctacttgctgtctttgtggtttttgcctattctggacatttcacataaattgaatcataaaatatttgatgttttttgactcatttcttctgtttagcacgttttcgagggtcatccatactgtagcatctatcagtacttcatttttctttatggccaaatactattccgctgtatggatataccacattttgcttattcattattcagttgctacagtaacttaaggaatggacttcagttactgttcacttaggttatttccatttttgactattatgaataatactgctatgaacatttgcttacaggtttttatgtatgaatatatgttttcatttctctggataaggagtggagttgctggctcgtgataactctatgtttagattttgagaaaatgccaaacggttttacagagtggctgcagtaggcacattttttaaaaacagctttattgaggtctatttgatatacaaaaatctgtacattgtatatatatatatatatatatatatatatatatatatatatatgcttttttttttttttttaagatggtgtgtcccaggcaggagtgcagtagtgcgatcttggctcaccacaatctctgcttcccaggttcaagcgattctcctgcctcagcctcctgagtagctgggattacaggcatgggctaccacacccagctgatttttgtattgttagtagagatgggatttcaccatgttgaccaggctggtctcgaactcctgacctcaagtgatccaccggccttggtctcccaaagtgctggagttacaggtgtgaggcaccgcgcccagcctgagctaccacgcccagcctggtgtattcttaagtcatagtgtaaatggcactaagttttgtcttcagcactctcagcttttcattcttttcaatctctttctccattcaatgatgtctcctctctatgtttaggactctactgtgtttattgtcatgtttggtcaatacactaagaaaaaaagtttttgataaatttatttgacttgaagtatgcatgatcaggatttatgtgaaatctctgttagaactatttgcattttaaagaggaaaaaaagtaagacaaaggaatgattctccaatgttggaatttcagatgtcaggttcctggagaggaaggcacttttgaaaaagattggagaattttctgaatagtaatctagtgtgacagagggagcatggactttgagtgaaaccatcctagcttgtgttaacattagtgagctattggatttaacagagcttcagtgttctcatttctgtggtgaagataataatatgtatgatgtaggatggtgggctaaaaaagacactgatgtaaagcacatagttcaatgagtatgctcaactagtggccactactgttatttttctgaaaccacatgacagagtgttgaccacctttctcatcagtttggccttgtcggttcaggttgagttttctactacctctgtccgggagttttagaggttcactaacatgcttcctgaccctgcttttatgttaaatggttgtcagtgtgagagaaataaaagtctcgggcaaaacgcagcaaaaggcatctccacactttcacacccccctcccctacttctagagttctgtggagagaatctcacagaacagtgcttttcagtgaacacctgtaattttaaatttaatgatttacattttctagtagcctcatttttaaaaagtaagaagaagcaggtgaaataaattttaatacttcttatttaacccaaatatatctaaaaatctttcaacatgtaatcaatataaaaattattgagatattttgcattctttttttgtgctaaggccttgaaatggtaatgttaaatttaatgatttaaattttttagtagccccatttaaaaaaagtaaaaagaaacaagtgaaatgaattttaataatacatcttatttaacttaaatacattgaaaatatttcaatatgtaatcaacataaaaattaatgagatattttacattctttttttgtgtgtctatgctgaggctttgaaatccattgtgtattttacatttacagcacatcttttttttttttttttttttttttaaagacagtgtctctctctgtcatccaggctggagtgcagtggcgtgatctcggctcactgcaacctctgcctcccgggttcaagggattctcctgcctcagcctcccaagtagctgggattacaggcgcctgccactacacaccctgctaatttttagtagagatggggtttcaccatgtcggccaggctgatcttgaactcctgacctcaggtgatccacccaccttggcttcccaaagtgttgggattacaggcgtgagccaccgtgcccagcatttatagcatatcttgattttgccttgccatacttcaagtgctcaatagctacacatgagtagtatctaccatatgggacagcacagccatagaatagttgttctggcataactccgttttgttccttttttggcatagtttttacattctgaggaagatacatggttgttccccactcaaacttgagctggtagttctgtagcaattgaaattgttgcctgatgaatagccgtgttccagattaaagcatatttgagacatctttttctggaagagaacgtccaccttacactattgaggtcactgctggaagccgggatggggtggttcccccacctccttctctgtgttttttgcttctttctttccatagctcttcattttaggttctttctttctccttaacaaaatcttaagtgttccctagaatagactgagtgggccgaagcagttccttgttttctttagctgtaatgcaatggaacaagtacagagcactccatggtatgacaggagtttgctggaccctctgcagcctcacactgactacctctgtggtagcatattattttgagaacgccatttaacctcttagtctcaggtttccacatccatggaatgggtgactctagagagcctctgatctgactccatattccatgggttgtgagccccaacatgatccctgccaaagcttagattcctaggacactaggcaggtggaacatttataaaagaaaattctttttcattgttatggcagctctaatttctcctatgaatccttatatctttcctagatggtcatgtaaaactggttatggtggtgttaacgttaccctccatcaatcaagttgaattgcagaaggcaaactgagagggaaaaaaatagtggaattaaaaaaatttttattgctgggtgtggtggctcacacctataatcccagcactttgggaggccgagatgggcggatcacctgaggtcaggagttcgagaccagcctggccaacatggcgaaatgccgtctctactaaaaatacaaaaattagctgggtgtggtggtgggcacctgtaaccccaactacttgggaggctgaggcaggagaatttcttgaacccgggaggtggaggttgcagtgagccgagattgcgcctttacactccagcctgggcaacagagtgagactaaaaaaaaaaaaaattattgaagcattcaggatcccatttataaggccagttggaggccaatcccagtttaatccaccttgcggactttgtgatggaatgcatatgttgttttcatgctatgtatttgcagctattggattttagactggaaacttgtcttggaatagatttctgattgcagtattgcaagtgcagaataccttcttgagttcatatggtagagcccaggaatttaggaaaggagtctggccctcaccttggaatggtggagttacttgttcaacgtttgcctcagctgaaatactgaaataatttctgtttcccacctgtcagtggggcgtttgcaaacttacagtgaggatatttagaaagatgtttgagtttccctaagaaagtgtggtcagtaagtatgagaaaaagtttatatatttgtcttgctttgagacaggttgaatctgccagtaggtcagaggaatacatttacctagtagcctgtgctggtagggcagagagagtcagtcgtttttcctgagggcgttaggtgatttgagacctcaagtgttgtcactgtaagagaatcctccttataattaccattgttaatagaattgaaactttgcatttgtcttttatccctaacaaagaaagactcccagagagtctaatgatgagccctgcctacatccattctgaaaggcactctatggatatgagggtgtagacgttaattcctttctgtagaatttgcatgcagaggctctagggccaatgcaccctgcttacattaataaatatttaaaaacaaagagcgggtaacacaagcacatctttcctttgtgcatcctccttactagggtgcctgtaatacctaacatcttgggaaggaaatgtctgggtgggtgcgggtgggtggtgatgctgcgcgcagcaccaagtataaaggcccaagaagtaaccacatcgtgtgaggaataaattaaagcagcttcatccggaggccaattaaggaagaatgggaaaaaagaaaaaacaaaacccagcaacaataaaacccaagagatgagagagcatgttcgttcagaccacgtagaaaagagaaattgaagtcgtctggaaggagtttaaggggatgcatcacaaaataaaacttttggaaccaagaaacagtggagaagcccggtggcgagccacatggccttgtgctaagacgagatgcccttttcagaaaggataatgatgatgctgggagctggaccgtcgtagattgtcgcctgagtcttgctgtaagacgctgcacaattagattagaggagagggctaggggtggccgcgaaccccctcgcaaatctgttgacttcaccgcagggctgatgcgcgcagcatagaggacgcttgggagcgcccggccactgcccggtccgccggcgcggcgccgcgtcgcacccggtcttctctgcaccctgcgccttgcaccggctccctctcccgttcgggcgtgcggcccccctcagactctgcccttgagttcccagcgcaggccgcacgtcaccggccgccagcgcgcggaccgcgaagccaagtgtcccccaagcggggcttgctgtgttttcatcatttcccttgcctggcccgggttgcagtggtcagccgcagcggtctgctcccggcggcggcccgaggctcccccgccacctcttctgtcccggctgacttaactcttctcccaaagggtggtaaagagagggccgccgccccccagggggaagacatcctcttgggagccatacttcctttattaaacacctctcaatgtgggcttggagtcacattcagagcctctgaggcagaggggtgcctgcggtctgttcccagggagccgggcctagggtctgttcctgggaaggatctgttccgtggggcccgctggagccgcgttttcaatatgcaaagtgccggtgctgtgcagacctcggtggtggtggttttgcatgcagaagtgaaattcagaaggccgcgtgtgagcacgtgggtgagtgtgtgtatgtgctaacacgcacgcgtattaatttgcagctccttagttggccgtgtgttgtctcagctgtattcgataaatattcgagttgttgctttatggtaatgaaatgaattaaataatataatctggagttactgcagaaaccctcccgtcttttctgtctctcagctcttacagggagtgcgtcatcttcccctagggagatttttaacccaaagaaccttgatgtactttaaacagcactgacatttgttttccttaagctcagtctgatttctttaacacttgaagaaggtttggggccttcagacatagctagtttcttatatggcggcttgtcttgtctcagaggaatgtttaaaggggcttcaagctgccttatttttaccagtcttcagaaaatagagaattgattttggtagtttgccccctcctgcccatgcacgcatagttgcctcccttcccccacctagcctgctggagcccaggcaggaaggggctgtcatcatacacatgcctaagccatattactttatttttcttcttagaaagttacactaggaaagatgttcttgatgtgtgattattattcttaagtgtattctagtgcttgcttattattgctctgttacagcttcacaggaaaccagcaggtcctgcagtagacggtccagaaactttctattgaatgaatgtgggagagctagaagtcaggaaggttgaattccctcattacttcgaaaatctataaattaattccctctataaatttccaccagcctagtctctgatccaccagctggagaatcaagcccattattaatttcacaggatgaatttctcatcctagtaactctgggggagaggacgaaagggttattatgtaggttgagagttctcttgttgcttctgactgttacagatgttgcagctaaaatataagcatagcaataataatatcagcaatggtgatagtaaagaatggaaataactgcttccttctgctcctgatttggacacccccatcctcctactcatttattctattgactcctctctaggtgtttcaagtagagatgttttggtgacttcctaggggagagaagcatctctccagtggcttccatttgggtataagtatgcaaagattgtttgtgttgtcaagatcccactggagtatatcttcttacctataatgtcacctcctgcatgttgccctttgtaagtagaggttatggaagctcaattattttttaagtaagtttcataaaatatttttgaatgccctatgttctggagatgttggtgaaaactctttatcttccacaggttgtatagtgaaaaagttaaaaatgaatctctatcctggttggatttattttttcatttgagaaataccgttcaacatttttgttttagacctcctggagggcatgatgggactgaagagtctttattccattttggtctaattattgctttagcaaatatttgtgaaacttctcccatgcctgaagtgttgtgacagagactgaaaaatacagatatgtgtgagttgtggcccttaccctcaaggagcttccaggggcctgaatcatgggcagaatcaatgtgacatgggcaggtccatcactcccaaagcccatgacaggagcctggaatgtgttccccagagccaggagtgtggctgtaaaggtcattcttgaccaaagttcattgctgccctggtgatacatgcagaagcatgctttctttgaatcaaggagttctagtttttttacctggatgcctcagaaatgttctatgtttgagtccttgcatactgggccttcctgcctttcctcaagcactgtaacctcctttatttcctttctgcctttcccctttcactctcttttgttctcttcctcccctctactggggcctacccacccctccacgccctccccgcccccattgctatttgccaaacttgtgacctgagaccacttggcatttccgtgggatggctgaaatttaccacccgctgaataggcattctgtgacatttgctcacctgggcagcttaagctacatggtctgcttctgccttgaaggagtactgagaggaagtgtgaaatttacctctgtgctccagggttcttgctagcagggagacaaacagcaatgctttctagaagctggaattaatttttatcatagtgcacatatatgtttataccctacatttattatatattcaataagtacatgtagacaatttgtgcattgtcttccatttttttaacaaattaaattttcatgcttagcgtcatctttcactttcataccctccccttctctccctccctgctagtagaacatactgggttaacttaatgctctttgaggccttgtgtcattagaccacctgtctccttaaggtttgtgatattccgtgtgatgtctttctcactgtggcctgcccagtcctgctggtaaggaaatagctgcctgtctctttggatcaaactggtctaggagcttgttcagcccagttactggggcagaccagccctggaggcgtctctgactcttggaacacacagacagcacagtctgtctgtcctggctgtcagtcgaagaagggaaacatgcaatatagatggttaagctgttactttatacttgtgtgctccaagtgatttgaaggaaagagtgctctgggccccagtagtggtggatcatcctggaatgaaactgaacagagaatgtcggcagaagtgatgtttcatactttcctgtatgaaacaggagcccagaattctcctgttcatatgtaataggagttaatgcatatttaaaaaatgtgttaggtacagcgctattattactctgatttttaagatgaggaaactgaggcatagagagtttagtgaatcttcctaaagtcacatagctaatgagagagaggctgacttggagattttacttggtaagttttactaagtgtagatttttctatgaaaatattcattcccattgagtgacagcccatcaaattgtgattcttccaaggaaatccagtggaatcttacttggttgtccaaataacaaattgtctggctctactcatttctgatcctgtttctcaggtacagaaatttaattatctcatgactgtggctggctgcaaaacaagtaaagaggataagttcaaaactcgccttgagcttatttcctgattttcattaggcctctgcctattctgtttttagaatccacctgactttttttattttttgagatggaatctcactctgttgctcaggctggagtgcagtggcatgatcttggctcactgcaacctccgcctcccgggttcaagcaattcttgtgccttagcctcccgagtagctgggattacaggcgtgcgccaccatgcccggctaatttttgtatttttagtagagacagaggtttcaccatgttggccaggctggtcttgaactcctgacctcaagtgatccacctgcctcggcctcccacagtgctgggattacaggcgttgagccaccattcccagccaagtttgttttttgagatggagttttgctctggttgcccaggctagagtgcaatgatgcaatcttggcttactgcaacctctgtctcctgggttcaagcgattctcctgcctcagcctcccgagtagctgggattacaggagcacgccaacacacttggctaatttttttgtgtttttagtagagacggggtttcaccatgttggccaggctggcctggaactcctgacctcaggtgatccaccctcctcgacctcccagagtgctgggattataggtatgagccaccgcacctggctctagaatccacctgacttctttcaggtaacaagcatgacttatttttgcagggggtctaaagcttgaccaccgctgttgtatatgtcacctttcctagttccttctcagaagtccagcattttgacagaagcataaagcagggcacagggtcctgcctttgcacacccttcctgtgcccattgtcctatcacaccacctccctggtgcagccagactctaggccctgggccctccagtgattctacgtggtgcggatggatgcttccatggtgagacccaaaagtctcatctgtccagttacagagcctctgtttttggaaaggcatatccagcagctccccgaccgccatttttttttttttttttgagatggagtctcactctgtcacccaggctgtagtgcagtggcgcaatctcggctcactgcaacctccgcctctcgggttcaagtgattcttctgtctcagcctcccgagtagctgggattacaggcacgggccaccgcgcctggctaatttttgtatttttagtaaagacgggatttcaccatattggccaggctggtctcaaactcctgaccttgtgatccgcctgcctcggcctcccaaagtggtgggattacaggcatgagccaccgcacccagcccccttttgtgattagtgggtgttttcagttttgaggagggaagatctaccttccaaattgcagtggtggcccagagaacagcctggtatgcaggaccagggtgaaggtgaagctgttcatatcaccccaggtctttgaaggggaagaaaaagttcaaggcatttcatgttaaaacttactgtttagaaaacaatactgttgatattaaaaatataataatagcatcattattaccaagaagaccttaataaagaaaattttacaaaagaaaatcataaatctactaatttacctttaatcatactatcctagttcaacgtctattttcagttttcttgtgtttacattttcttgtgttactttccttatggctgtgtaaattttccatgtcttggggatgattgtgtactcagggaacatatttatccacagaacctgttatgtatcttatttatttgtttattgcttatttcatttcaaaaaggcatgcaagaagcttaccaaaagatgtgagagataccaagagatttactaaataaatgaggaaattagaagaaaaaaattcaggtagggcaataaaataacatgcaagggaatgttagtatgtaaaatggtatccataagatcctttcttattgtgaacttctcaggccttttgctagtaaggaagtagctactgtctctttgggtcaaactagtctaggaccttgttcagtccatatcctagaaaggttggctacagatttgattctgtgcttcctagtagcaaaagcaaaaaagggaaataggatccgtttcaaattgccaaacatttagaattggaaactaatcagttatttaaggagaagcagatttttttcctggtactggaccccatgcaaaatttctttcataatttctttttttttttttttgagacggagtttcgctcttgttccccaggctggagtgcagtgacgcgatctcagctcactgcaacctctgcctcctgggttcaagcaattctcctgcctcagcctcccgagtagctgggattacaggcacatgccaccacacccagctaatttttgtatttttagtagagatggggtttcatcatattggtcaggttggtctggagctcctgacctcaggtgatctgcctgccttggccacccaaagtgctgggaattacaagtgtgagccaccgtgcccggcctcataatttctagtaagaagatgctagtgatatgataggcattgccctcaacgacatgataaaaaattatatttcatgttttaccatagccctttatgcataacccatccacagcactcatcagatgttatcataattattggtttactatgtaattctcttgttagactcagaatttcttgaaaatgatgaacaggatttgtatgctcagcccatagtacatattcagttaatatatttttgaattgaaacactgttttatctgcttattcaaaaggggaaaatttaatttattaacacttactgagtacttgctactctttactctgaaataaaaagagggatgaatcaaaagtccctgtccttgaggaaggtatgatttactgggaataaacatgtattaatagttatattgtactctagctggataattgctacatgatagaagtgtgaacattcttttgtgaaatgacttatagattgcttaaactacactctcattacagccagcttcaccttttagaatttggggtttggatctttaagccaagagaggcgggaaaaaaaaaaaaagaataatagggcatgtgagagttttctgagaggagagaggctattgtcttgtagatttggttttttgcttccattcttttttagggaagagggttccattcctgggctaactaacccagcctctctgaatctcaggtcacagggtgagaggggagtggggcccctcttttagtctactcctgacttgacctggcagccttagctgggagacactgttccatttttcatgggcagctggagttgtggccaccattgtgattcttgtgactggcttacagaagaaacatggttcctaagaaggccaggagggacagtccctgagacatacgtgtaaaatgaagagtataaaaagcaaataactaccacaactggttttatccagggctgttaatttttagatactcattgctacacttattagaaataatgtttaccttatttccttttcttcctcctttctcctcttccttctttctatttaaaaaccatttgccaggtacttctatggcaggcagagtgagaaatataagataggaacttgtcctcaaattgcttacctctgggagaaaacgaaggcgctttagggcagctcttgatcaggcccttgaagataacttaagtatagcatagcacttaacccacaatatgttctcaaagaaagtcctgaaagatgaatccagttttctccaagattgcaagctcccccttgaagatggtaaggtcctagtgagccatgctttattcatctttgcatgtctagaccagtgcctggtatatatatttgatgcccaacaaatgctagttgaaggaaggaagggagggagaggggaaggaggaaaggaatcacaaataattcacctaaatctactttggatttacttatatttttagagtgaatatcttaagaaattatttccaaaagccaagtgcagtacggtgcatacctataaatcccagctactagggaggttgaggtgggaggatcacttgagcacaggagttctagtccggcctggacagcatagtcagactcagtctctaggaaggagggagggagagagagagaaagagagagagagagagagagatctaaaagtagtattgtctgcttgaaggatactagtttgttcatcttatgtatgctcttatgtgatgtgtcgagaattagaagacaggatggaaaagcctcttagatctcttagatctattggatcactccagttaagtgctcagagagaaaggtttctggtttggatcagcatgttactgaatggggagaagttcttgaatagctctctgttttctgagttaagattttgtgttttggtgtgtgaagagtaagaggggtatcatggagtagatgggggtgaggtagaatgggaggtgtgcaagagaggacacctgaggaccgtgtgaaggcaagtgataatcagactaggaagctggctggacacaaccttccagtgggagaggcggaggtgagggggcagctgcttctttaactaatcaagggctcaggttccagtaccttccttttatccccatccacagtttggcctgtctcttctcatctgcaaaatctcctcttttctttttccccctcttttaaaagctaaactaattttctgtctgttcatgttgaccttttgtccagttttcctcccatcagatgaaccaaaatactagaaaaggactcttccatctactactactgctagtaataataatagtaataaaataaataaaaccaggaagctaaaaatggaaattaactaattaatttgacatcaatgaaagaggttgtagaactggaggcaagggaaagaatggaatggacatctttctgggcacactcctcactccttccccaaccccttccaatgtgagtatgtgtaatttaaacctcttcctggggaagagtgaaagaagaattttacccacctttttccattcccctcctcccttagtgaaaattcctagtcatggtctgtgatatctcaaacttggctgtcactttttggggtcattccctggggatacccttcccccaatcccagggcagttctaatgtttctgagtaaggagtagtgagaaactcagttttccctgcaaacttccctcctcatcagccccactcagtgttgagtttagcatttgctttagtggctttgctatttatagacttgtctggggaggttggggttgggggacagtgtcaggcaaggaatctcactgtagtctttgaggggggtagtcaggcattgagaaccagtgcatttaaataaaaatgtcctgaacatttcttttggcttggtttagagaccactagaaccagttcctttctctgattcttttctgtggttgcttcactttcttgctcagtagaaccacaatctattaagatttcttatttatgttcttcttagttgccaaggctgccatcctgacttgggcatcttggcagctaataacaatgtatgtctagctgagaagcttttagcattttgggttgtaaactttttctttacatccaatgttcatgggaagtcctttcttaaacaagaacccccttcctttctgtaattaatgaaataaatgtcaatatatagtttcacctcttctgtataacatcctttgaataagtagtgcttatgacattcattcattcattcattcattcagatattcaacaaatggctttttccaggagtacttagtaaaaaagagagaagaacaactggggaacctggcagtacaactttgatattcacagataggtgctgtactacacacatgttgaaagaactgtaaatgtaggtgattgctctcatagtcctatgggcacacacatcttatgtttaggggtttacattggtggactgacttattgctgtaatgtgttcagacaaataggaataagaagagcaaaggggtgtgtactatctgcagaagacacatgtgcatgtatttcattgctgtgctagaggaagctgctcatggtaaacgtgctgaagttatccctgttgcaagaacaagcatcaaacacaggactgggcacgtgatgaatgttcaataaatgcatgctttccccttttcatttccaaggtggaatggaaacatctgagcccatgtggagcagcattatgatgcaagggaacaattactggactgttctatgttgagttgataggtaatgagggggcacctcactcagaacaatttcttatctgtaatgggggcactagttacactcattatccaggccctgtccacttccagggaggttgtgaatctctagtgagatgggcgtaaaatgctttgtaaattataaagcaccatgtaactaagatttctttgttaacctatactgtcacaattgcttataaaatcaaagcaagagaaagaagtcacagattggcaggcatgtggagggctgatttagaacatggcatagatttagaaatcctgttgaacacagaattcgtggggcatgcagtgaatatggagctggagatctcaagggagttgaacagagaggtgtgattgagagtcagatgatggtgagtcgagaccattatccgcagagggaacttgaaaatagaggttatctgcccacagagagaacagtggcaacagtccaccaggattttatatggagaatgagatttgaatgtcgacctcacacccaatttcagcagcagctctgcgttgtaaggatgtcatgcataacgaggtataccagcgaaatagcaagcccatgcttgacattgagcagcatagggtgttgtttgtgtgtgtgtgtccctgtttctcattcccggttttacataactgggatgtaggatgctacaactactgctgtatcttcaggtaagatgtactgctatctttcacttttatgtagatgtgttcctaaaaagtgtatgggtgtgattttggtaatccttatcctaaacttaagtccattccttagtttcatggaagcaatgtatatgacagaaggaacaccagaggggagtgttgtggagagtgttgtggtgacttggtaagttgcttacacattgggggtcttggctgtctcatctctaagtgaaggggttagatatgaatgattaataagatccctttcaggtctatgcttctagcactcccttttgtcgggtgaggagccctttttgtattgtgtatactcacccagcactttatctgcctctttgttgttagctgatgatctttgtgtgtctgatttttttttttaagagtaaggatgtcatgcactcttattcaaagtgtagagtttattctcccattcataggaatgcaaaatgagaagttttaaatacacggattcacttcctaacccagtttctcagaagattaatgaatagtcatcctgttgacccatctgcttctcttcttcacatcgttttgtgcggatgaggcacacacagacacagagttctcacttgcagcagtccggcacatacagcctcacacgcgccacaccagggggtgtccccaggagaggtagaacaggtgccagatgttgcagcagtacactcctccctgatcctccttctcatcccccaccccttttctgaatctcctgcacagtcactgaagtcccatttttatatgcaagaagagaagagaaagagccctaggatgcaaggatgccttgtcacctctcatcttctgtgctgggatagacacctgatctttttggaagtgaaatccagagtctggggcaaagaccaaaggacagaggccaaaccaaaagtgactgcatggttgcatgcgggccccaaatgattgaatgaagcaaggatacccatcgcagggagctgaaaaacctcacatccagatgcggtcagagaggttcacagaatgaaaggcagtctgatgagtgagtgagatacacccgcctgtagagcacaatagaaaaatcaatagtaaggggaggtgaaagagtttcagctgggttttattgagcacaaagaagacaaactggcttttgctgtgacttcaactgtatgttaatagtgctttttaaaaactacagtacaggatttggggaaaaaaaatcacacggtaaaagttgccagccagtatatgtaagtgcacacacacacagagatgaggaaaaagagaaaagagaaatacactccggactaagctttttttttttttttttttttttttttagtttcgaagcatatggtgaagtgtgctataattttatatgcatatatattctttattctggacttccagaaagcaatgagtttcatctgtttttttccccacctctggttccttcttcctttcccttgctctctacaagtctgctgtggctttattaggaattccctttggtttagggggaaaaaaaataagagggagagagagagaggctggagggggaagaaacaaaactagctcttggctggccgcccacagcatgggcccaacagccttgtttgagcgcgttgccccggccttctgttttcttaagctcagccccctttatccctccgcccccaccatgccctccttttcctaactgggctgagggaggctgtttctaccctcctaaccctcttttttcctttctgttgtttaaagagaatctttctctcttttttgaggctccagcggcgagaacagcagcggatttctccttgccggcctctcccctcctccccagccccctccccgatgaagggttcatccaaagttcgaatccagactctgaacaaagtggcgcagaccttttcctgactcctcaccctttgtcctcatcactcagtgacagacaggaatcaaatgctgaggacccaggcgggagaggggcagtgggggagggaggggagaggagaaaagttcccattaactcgccgggcccttaacaaccactggaaggaggaggggggcgcggctgagaaaggatttttgtttaagtttctgcaggcacacacacagcattcccaagttgtttgcagatggtttcatctggtttctgtttgaggggaagagagtatgggatgatcagtaaggagagggggcggggagagggaagagtcttctcttgaccagaaaatgatacctgtggtgtcttttcctgaaactgaaaacattaaagcgttctgatcccagagaaaacaaattctctgggatataagggttcaccttttggaggtggattacacttttcaggacaccagagaaccatagagcaaattacttcttccagagtgctaaatgatcccctggtgccctggaaagagaccgtttacctccaaaaggtgagttgtttattgccagagagtagaatattggctgtaatgcctgctcatccatccttctccatccctgcgaggtatttagggtggaggagatattatccacctgtcaccatggggaaggagactgacaaatacttttctgattcctgttcctaagattgaattgctggggaggaaggtgaagtgacttttccaaggtcttatagtgatccagtgattgaagttgaattagatttctgttcctgttgtggtgctcttgtttgtcagagaaaaataaatatcttaatgctcacacggagcctcccgtaaaaaggctgataagaaaggccaggtgcggtggctcatgtctttcatcccaacattttgggaggctgaggtgagacatggcttgagcctaggatttcaagaccagcctgggcaacatagtgagatcctgtttctacaaatagtaataataataagacatccaggtgtggtggcacatgcctctagtcccagctactcgggaggctgaggtgggaagattgctgagcctgggaggtcaaggctgcagtgagccgtgatcgtgctgctgtgctccagcctgggcaacagagcgagaccctgtgttgaaaaaaaaaaaagctgggggtcagggagcagatagaagaaataccttggccagcgcaactggaaagggaggagccaaaaggggaacactttcttgattgtcccagcctcattaggagctaccacagggctctcctgcatgctccttgttttctttgtgctctggacttgctcacttgcactgcttgcttcttcccaatcgccgccgcccccctgtgcttcaggtaaacaagctgctctgtgggaagtgaataatggggcctaaactgacgaggaggaagttaagttgagaggtgccgtttttggtgagccttaatgaggaggacaacagtgtgaaatcttacttggcattgtgaccaggagatctattgccttttcctcccctaaatcttcagaatcatagtggactatatatgactcccaaaagtgtatgcttttacctagcccttggaagcttggatggttagagcaattgggagtttagtctgttggggtaaacagggcattgatctaaggatttgttaaactgtaaaccaaataaagagcaaagtctgctctacagggatgttgaagattcaggatattaaaaaaaaaatctctgactgcatgattacccttccagacatttattgaggtttttgtttgtttgtttgagacaagatcttactctgtcacccaggctggagggcagtggtgcgatctcggctcactgcaacctccgcttcctgggctcaagtgattctccttcttcagcctcgtgagtagctgggactacaggcgtgtgccaccacacttggctaatttttttttttttttttttgagatggagtcttgctctgttgccaggctggagtgcagtgacatgatcttggctcactgcatcctctgcctcccaggttcaagcgattctcctgcctcagcctcccaagtagctgggactacaggcatgtgtcaccatgcccagctaatttttgtatttttcgtagagacggggtttcaccatgttggccaggatggtctggaactcctggcctcaagtgatctgcctgcctcagcttcccaaagtgctgggattacaggcgtcagccaccgctcctggcccccagttaaatatttctggaaaagagttctgttcacaaaaaattttggaatcaagggaaaaccttattaattaagatctttgataatgtggattctaaataatttcgggctaagttgaatgaaaacttaccttttcacccatgaaaaaaggagctctgtaactatattagtagcacaaacgggttcatgtgaatgtttaccctgcttaagagagtaaacttttcagagttagcagcagcatttgcatacaataaatgttctaattactaatgatccttgccaattaattaaaagtatgtctgtcatggcgctgctttcttggcagtgcttttattgatgatgagcttgtgtgcatattaaataatacagtgacatttctttttaatgtttcctaacccaggctttgtatggcagaacattctgttagcagacttgtgcaggttttcctatcctacaagtagagaaatggagagatccatgccctaccctgagcctgagagtaacttggtgatagtgtctgcattctaacccagtgctcctgtatttccttggattcttgtttcttgtgagcctgtaaaggcatttgcaaagttggggccttctgtgaacaggggtgctgtggcactgcagttcattgcagtctagactttccacctcccctgtggcacttttggcaagttgacaggtataattgatgagttattctaagaatgtgattcctgagtaactctagagtggagtgactgtgtttctgagtagttaatgtggctggggggaaaggcagatgaaggggatgggggttgggaagctggagggaggtggggaggagggcctttgttcaaatcaagttgtgttcaagtctgtggttttaagagagagcaacagcgattctttcctagcatatgaaatcttcacagggctcatagtttgagtgtgagagtctggatgaggttcatcccagtatatgtcctaggaaaggaaatagaaacacttagctttgacgtgtaaacctccatgccaaccattttggttgagtttaagggaaatcacaaagcagcttctattgctgcaaatttgcctagtagcccaactttccaaagttaagatcatccctggcaggcctttaattctcaagggtctgcaaagttgatggtctgttgagaaaggaaaggagaagttgaggccacagttgtgattaccatttctccttgtcattgagaagcagcagtgtctgagcagagtctgagggtgctggccctggccacagaggctttggggcagagtctagcctggaccagggggagtgaaagggaatggccttgttggaattggcatggcatctccacacagtaagttgaaaagcagtacaggatctacgaccacatgtggccagccaggtgtcagggcttattgctcctcaggctttgaattctgtatccccaaccatccctcctgagtagagtctctgctgcttcctggacacaccaggctcccacgcgctggccttgctgaggataaagactgcccctgggttttctgtcgtgagcactcacctgtgacaggctgctctctctccttccccacaatgggaacttgggagctagtactttcccagcatttgtatgtagcacacaatccttagattttttttttttttttaatttgagacagagtcttgctctgtagcccaggctggagtgcagtgccgtgatcttggctcactgcaacctctgtctcctgggttcaagggattctcatgcctcagcctcccaagtaactggcattacaggtgtgtgccaccacacccagctaatttttgtatttttaatagagatggggtttcgccatgttgcccagactggtcctgaactcctgggctcaagtgatctgcctgcctcggccttgcaaagtgcgggaataacaggcatgagccaccacgcctggccaacccttagattcttttttaacccaacttatctctttataattccagacatcattttgttggattttgactcctggtgggttgctgtagtagcacttttatttttcaaatgttaggtggaccccaggtgccaaggttacttccaaagaattaatctatgcccccaaaaggttagaaatactgtgtctgctcccatactgtctcaccttttacctgatgagaaaaataatcagagagtcctggttgtaaaccccagcttcagtggttaccagtggcacaacccagggcaagttacttctgtaagcctctgttttgttttcatctataaaaatgtgggtatttggtttacctctaaaggttgtggcggcggggtgggggctggaaaaataataaatagccagaattttgcaaaaatattgctaagttttttcttccttttttagttttcactgggttgaaaacacaccatgtacttcctttaaaatataaagtgccttgtgcttggggaccaaggtgcttttcacacataatgcaggcacttattgttattatctccgtttcttccgtggctctgcatgactgttctgagaatctcttgctctcgagagattgagctcctgattctctcagagttcattcatgcctgtaagcttggaaactttaaggtgaggctgatattttcttcctttgggagaagcttcacttttcccactttagccttctttcacctgtcataccaggttgctgtttcttggtagaacctcctgggaattaatagcatagtgtgattattataataacttaatttctatagcactttattaatttcatgtcactttcctatttcatctcacatcaaaggtggcattatccccattttagagataaggacgttgagcctctataaagacatgatttaaattctccttctaacttgctgtaggaagatcacgcagaagcacaagatgaaacacagaatgctaaagctgcaacagagacttgggagatcatttagtacagcactgagaaaaagagagatacttttctttttttttgagacggagtcttgcttttgtcgaccaggctcgagtgcaatggcatgatctcggctcactgcaacctctgcctcctgggttcaagcgattctcctgcctcagcttaccgagtagctgggattacaggcacctgccaaatttttgtatttttagtggagacggggtttcgccgtgttggccaggctggtctcgaactcctgacatggtgatcctcctgccttggcctcccaaagtgctgggattacaggcatgagccactgtgcccggccaaaatagagttactttaaatttaagtagaaaatttaaaatttttaattgccacattaagaaaagtttaaaaaaggtgaaattaattttaataaaatattttccagtatattcagaatactatttcaacatgtaatcaacataaaaatgttaatgagatattttataatctcttttgtcctaagtcttcactattttgcatgtattttaccaatttagaccagccacattaagtgctcagtagccacagtggctagtggcaaccttactagacagcacagatctactccaaatatttaattttatagatcaggacactgaggcccagaactgtgattaactaataagtggcagaaatgaaacacgtctccctccagagctcttttcattatactgtcttcactctactgctttgaacgtgaagacaaaagaacccggtttctgttcatacttttatatcctctcttatgcagtctatagcctgggcttggaacttagagccttaacagactttaagacagtaccacgtctgaacctagagttatattgtattctttctattagcagagagctttctgattcctaagaatttccttactctacaagaaatgggatttctgctttgcaaagttcccttcagtggaatgaagttattgttgcccagagcttccctggtacaactctatggacttgggcatgattctccctaaaaatccgtggaagccgtgatcagagcccttggaaaattgctctggtgagccaagtgggcagtggcagtagagcagttttcagtagtggtcccacggtggcaagttggctgtgaagcagttgaggatgacatgaatgatggctcttcaagctaagactgagtagttgtaatggaaaacaaggtcagtcacctggctagttgatgatggtgggagccttttttttttttttaaaggagaagaggagccatttattaatccccacttttggcatgattcatttgctcattgtcagcgcctagctcagctttgcttttagtaggtgattgccaaactgatatgatcgttgtatattcactggcttcaagaaaccaccagtgggaaatcttatttatggagatgatggttatggttatgattattgacagccattattataaacatcattattatttagtgttaatcaacaacaggatgaaaggtgctctaaagaacacagaattagaccctgtctttgcaaatgggctcataagaaaagaatgacagaaagagacacccagcctgggctagctaggaaaaatacgttttagggaaatacagctgacaaaatagctccaaaggttgtaatttttagggctttggtggagttcaatatggtactctgaacacagaaaaatggaaagtagaatttctcagtaaaagaaagtctgttgtttcagtccagttttactattagagtgagttgtaaagaacaagtaaaagggaaaaattggatatgtgtttttgttttgttttattgccctgcaggtcccctctttttttttttttcttggtttctcaattttgaactttaatgcattaatacatcaggtatcttttacaactaaagtagcccctgaaatattttctgtgcagaaaggttaccttcaagtgcattagggtctcacattgacatacaaattcaggtttgaatccttgcaaaatcacatggtaaaatcgggcctcatttcctacatggtaaatatgcactctccttgagatggtgcatgagctttctagttcatcatagtccctcccatgcaaacaccttactcattaacttttatatgcctgttccttacaaaggcatttttagtttcaacccatatatttagagcagtggttctaaccatgggtgatttgcccccaggggccatttggcaatatctggggacattactggtttgtcataatgcaagttcatttttatgtcatatttttactgtgtactttttgcattttcaaatgactttgactattgccagagtcattatagacctgcctatgatgtaggagtttattgtatctagtggaaaacatacctgtttgtggggcagaagcttctgttccattcatcctgattttagacacagcatttaacttttcaggttcagttccatatgtataaagtagggataatagtgacatcctagtgtattaagaattaaggtgttattatttctgtcactgttacttcaccctaattttgtttccacactcatctctgagcttttttacttcttatgttgttcagtgttttctaaattaaaaaaaaaaaaagaaattatccaggaggaactccagggtcagagaaatttagttccttggccaaggccacaccacaggtaagtggtacagcgtggatatgagactcagtctcctgaattggatcagttacttgcatgcaccctgtaccctctgtctttatttgggttggaaccctgggggttcagtgatcctgttccaggatctacacttagcttggacttcttgttggttttcttatgcttatttttgttttataaaatgctcaatggtgtaacatttcctttgaggaatcgttattcattaaaaagtctgaaaacagtgctttaaatcatgtctgcttctttttgtacaaccagttacctcacttcttcagccaggatgggtttatgtggcccctcagggccttctaagaagactatcttccctgtcttttgtggaaggaacagagttggttgttgtcccctagaagggtggtcatctcttctcctttgtaagtagatggtgacatcaagggttgacacttggaaaatataacatagttctatgacgacgtggaactatctagttttcttggaataatggtattgaaatggagctatttgggggtgcagagataattttctaccacactttgaaatttgttggccaaggatcaagaatttcccaaatctttatacagccttcagaggaccatgatattcatcttgttgttcccacctatgataattctaaagttattgccttgaagccaggacctggtatgtactttttctccatgaatttgtgaagtttctgctatattttaggacattacctttaagaatagactttttatggccttcgttttggggtctcgcagccatgttgtaaatataatacctcaggagagtttgtaggttataactctgggcctttaagatgccttggccttaaattttttatttaaaaattaaataaataattaatttaagagacttaaattaattattgctgtacatttctggagagttccccaattcctgggtttctggttctcctggtattttagtccatattctgttggtataacaataccacagactggggaattcacaaagaagtgtatttggcttgtggttctggagaatgggaagtcccagagcatggctctggcatttggtgagggccttcttggtaacatggtggagttcatcacatggtgagagggcaggagcaagagagccagactgcttgcttttataacaaagcaattcccacagtaacaaacccactcctaggatagcaatgttaatccatttgtatccattcgtgagggcagagggattcagtttccaacacatgaatttttgggagacatattcaaaccatagccagtttgtttgtttttatctggctactagagtaagaattctttttttcttttctctctttcccctttctccttcctttgttccctcccttcctagagggtggtagagaccagagctggaaaatttcagacaggagttaggtgtcgagaccaaggcacactgtggagggttaagtcattgtcttccattgtcttagggcttctttgtgtatctctccagtccaaaccttgtggatggatgactaccggcactcttagagataggagagacatcagttgagctgaactagtttaattcccagagttctctgaggaacatactagtgtttgttgattttctgttggattactggaactctcagtatgtggtaaattccttgaaaaacctgattgcatttgattttgtcattggttcttatcctttctgagcaacaagcaccaccctttccaatgacactctgccttttttattctttttaacttttagaagagctacctgggcagccaaatttttcataaagagccttacacctgaaatagcttgacattgtgtcatacctcggagcgtatagcatatttcatttatgtgattagatttgacctttaaaactacccggaggtaggaaggggagggatcattatcccacttttacataaaagaaaacagaggctcagttgccccaggttattcaacaggtgtgtggctgagcgttaatttgaatcctggtttgtccagctccagtctatgtcctgaccaaccccgccctgctgatagacatcacggtgtttctttacaccagatttattttctgtctcttttttcctcctgatttttttttttttttttgcaaagaagagtgtttctgccagtagctttatcagatgattttgcccctcttttcattctctcccaatagatctcatgtctaacactactctaactttgctcccctctgagaccagcatgaactccagttctttctaaattgtgtaattctttttttttaaaattaattaattattaattttaagttctgggatacatgatgtgcaggtataattctttcttaatagattctgagcttgaccttccagtcgtcttctactgctcagccacacccccctccatttttgtttcttttctctttcttcgggcaaatctgcaattgtgggcgcatatttaccttgttattttttacagtattcccatgtgaacattttgccagcggcctcttcttaattttagtcctttctggggaagggttaatagttcaaacccattgtttttcttttgagggttgagacttgttataaaagctgcctggagtgggactgtccctcaggaggggaggggcacaggcctggcatggggataactgggaatggggtttggacacaggatgcctggcgactgtagggacacttgtctcatttcttgctctgttatataatataaatgcttagggaagcttagattcaatgggttgtgcccttccaaaagcctactgctggagtgaaaactggaaatacatctttgcatatgtgttctttcattttatttttcctactggtttgctaagcaaagagctggctttgtacaaaccccctctccccgctttttttttcttcttttcttaaaaagcttctgtgctcttttgaaacaagccaacaaaagttgaagccagtgtgtgtgcaactcagacctcatgagcaattcttttccaaaccaaattttaattcacagctgccagtttaggggcaatgctaagacccaaatcgtcctggcatctgaagcacctgtcctaatgttgagtactttaaatatggtgttcccatttcctaaatctcaatttagtctgtttggtcttacaattgtgagtataattatgggaaaatttaaatgggatacttgagtcaggactgtgttaaaaaatccaagatgtattgcttctgtaaggctagactaaaataatgaaaatattaagagcctaaagtatgctgctgctttttttttttttttttttttttgatacagagtcttactctgtcgcccaggctggagtgcagtggcgtgatctcggctcaccgcaacctccacctcctgggttcaagtgattttcctgcctcagcctcccgagtagctgggattacaggtgcccgccaccatcggctgatttttgtatttttagtagatatggggtttcacaatgttagtcaggctggtctcgaactcctgacctcaggtgatctacccgcctcagcctcccaaagttttgggattacaggcgtgagccactgcgcctagcctactactgctttttaactaaagtctgcctgcattccctctcttgccacaaaaggcaaacagagcttttggcacatttgattcctgaggcagccccatgcctgtttaacacagtgtagcttaactggttaaagcaccgggctagtaaacacatgactaggggctcaatcccttgtgggcctgttagtttatttactgcattcattggccacagacttcatccctaaagtggtcaagccatctcagacacgtttgcttctggtcacaccgatcaagattgatccagccactgaagtaatccaaacaactcacttctaatgggccagaggttgtcatcttcatacctgaggaatggcttgcattttataaaaattggagattcttctgctctcagaatagcagacacagggctgggcgcagtggctcatgcctgtaatcccagcactttgggaggccgaggcgggcagatcacctgaggtgtcaggagtttgagaccagcctaaccagtgtggtgaaaccccgtctctactaaaaatacaaaaattagccgggcgtggcggtgggcgcctgtagtcccagctactcgggaggctgagaaagaattgcttgaacctgggaggccgaggttgcagtgagccgagattgtgccattgcactccagcctgggcgacagagcaagattctgtctcaaaaaaaaaaaaaaaaaaaaaaaaaaagcagacacagaggtgaacttaacctgagattaaccagattcacagttcaatagcaaccacctttagagtccctaagctaagaaactgctatgattttgatgaaacagaaaggaggaaggtaactctagttctttctgaggcatccgacactcctttagaagggttttcccaggaagcctcattcactttcaggtaagcccattatgaagggataaggattttaccgtattccactggaataggggaaaaaaccatctcactttaacagaaagcatgcaagtgcccttttctggaggaggtgggaatgagggagtacacagactttagcttaaactgtggcaggagggtcttaattttggcagaacagggcatggtgttgcatctcacctgttccacgcttagtacaagcccttcttcccagtccctgtcacctgcctcattttgagctttcactgtattttcctgttgttccagggaagatgaagtgcatttaaatgctgcagttggatactgtgaagatgagaccccttagcctgtgggattaactttccatggagcccattctggagagacttgagagagcacctttaaaaggaagttagctaagatactgccctccgtttcagacagaggttggaaccagatcctggctgagagcagagaccagcttccactcagccatgcaccctaggagtggggattcagctctgtggctccaggaaggttaatcttcaatgttaatccgtttagataaagttgttagttaaaaggtaatctgtttagcctccctttccccattctcctgccagaaaagagggagttcaagtcttctttccaggactcctgtgttttggctgagactgattcttcactgtggccttgggagaaaagctgcctaaccagttctgggccctggctagttacaaccatgtgtgagttgtttacagtacgcacaggtatgggctgaagggaaacaaagcttaagggatgactagaaaggcttgctgaaattgctatgggagggccccaccctccaagccatctcccctcacaccccgctcggtttcagtttctgcagcttggttatgcgacattctcttaatccttttttgaatctggtctctacttaagcactcaagaaaactgctccacaaggattgttttagtggggttttaattttttaaaatgttcttgtttatttaaattgcttgaacaagggtttagctgtatgggaagagttcctgcctttagctatacatgtttccacccacttagacatgctgctcacccacagactcatacagcctccacagacacaaagcttctgtgtatcctacatgtacctgcaccccaattctgtcaacctccccacagctcttgactggctgtttatctattccattccactaccttcccaccccagccctcaaagtcccaaacagattgaaaaaaaaaaaaaaaatgggaggcagcaaaattgcttacttgcacgaaagggctcttgcctttgaggggagctctctaggcacctaatttctcttagatttctttctgccctcaaaggtacttgtggaatgtttgccgttaaacggttgtaaattaagggctgagtgtatgaagcgttaatgaaggctgccattggaaccagtccacgtcccgtcccggctggcaggtttgctgtccaagaagtctcttgctggaggcctgagttcctgagtgtcgggtttcagctctcctttcttcttttttcgtcttttcttctgcagctattttttcccctaccttccttataatccgtcccttcccttccttcttccatacccactccacccctacccctttggctttttctgaaagtaaccatgaggaacagagtcagaatgaggctagggaagcagcatttttttttttcttttcctgtagaaagcagggccaaaagggtgcattttatttttttctgcttttccttttatctctttgtgtttgcttcatttctttctctttaagtcaaggttgaaattgatgtttgcaaaagacaggaattttgaataactgcctgagttaaacagaatatggagaaactttgactctgtcccatgtattaaaaattaaaattagggcaaaataatgcggatttgtcctggaggacctggccagatgtagctagaggactttcacagtgctggtataattatacctggatatgggataatcttcactttaagcaactccattatgtgaaaatacagatccacagatacatatacaaataaacacttccaaaagaaatccttgtataattcaatgtaatatgtgtttttaagctacaatatgtaagccatcaaagtactgcattatttttagataacagacttttcagtttgtttaaggtgtgattacctttaccaaacatcatttctactcaaatagaatgcttacaataaactgtatggaggatacctacataagtcatgtcctgagtttatactatttcctagagacatctcttttatacatttcaagttttaagtttagtctgatgttttatacttttcagtttagtacctgaattgtatctatctatgaaataataacagataataattttaagcagatactgtttgctagacattaatgcaagacactctgtacattatgtcatttcatttttttttttttttttttttttttttttttttagagatgagtctctgtcacccaggctggagtgcagtggcacgatcacggctcactgcagcctctgcctcccaggttcaagcagttctcctgcctcagcctcccaggtagctgggactataggtgtgtgccaccacatccagctaatcttttgtattttagtagaaatgaggtttcactatgttgttcaggctagtctcgaacttctgagctcaggcaatccgcctgcctcagcttcccaaagtgctatgattacaggcgtgagccactgcgtccggcctatcatttaattctattgccacttccattttagaaatgaagtgacaaagcctcacagaggatatgtaagttgttcttgaccacactatgtttggttgcttgcctttgtatccacctgtgtttcatcattattgcacagtgttcccattactctaagggttacaatctgaggtcccttccaccctgacattcattcatttgtgcattcagcagttacatgtattgagtgcctactgtgtgccaggatgccctgccagtcaggccagcactcagtgataactactggtcacaggatctagtgatttggccttaacaaatgaaggctggacatgacccttttttattctgtcctgagagccgttgcctatgctatccacttattatagcggcattcatatgtaataaataacttatcaaaatagtcataaaggacttggcagacaaaatgaactgctagagaagactgcattaaattttaataggaagaattcttagtaataagtaggaaatgcatcttggtgtagaactgagtcattcttttgtggctttccctaagacatcttcatatcagtgactattttttttttcatttatgaaatactgtgcttttagacaaagtgtatttgaaatttctcactctgtttcccaagtaaataaacaaataaaagtaaagaatggaaaaagacaagacaaaccatcttcctttattccatagaggtggagtgccttctagtaacaagtgctgtgtgccgtgtatggaagacaccagtaatcacatcatagaccctaatctcaaggaacctgtgttcttgtggggcagtcaaagaaataggcctagtccagggtattaaatgctgtgatggggatactgagagagtatcctgggaatgtttaggagggcaccttattgtcttggtgaggatgacgcagtcacagaagtttcttctaaagagaagacacataggcagagatctaagaatgaattagagttctccagataaaggggatgtaaggggcagaggggagcagactggccgaagaacatttttgttaaaatccttttttttttgttttgaagaaatatgacttttgtcctaaaattccacagcagagcttccagggctatggtagggattaaggtattctacaacagatgaacaagtcttttagggacagcctggtgagtttaacctctgtagggctcctgtagaggaggcactctttgttatgggaagaacagggccctttttagtgagaagaggggccttgggtctctccagttttcctgattggctgtgctgatggcttttactcttctttaaaggaggcataatacaaccccgttaattgaaactccagtgtttagaatgtttggtggtttgtgaagccctcctgtaaaaggcaactgaccaagcatataaataaagctatgaaattaatacatacatgttgagcatttaaatgtgtagggtgctgggtttatgtactcaaggttgcttgcggggattatttagctggtttaaataaacaaacttttaaaaggctttataaagtaaacaacatctatttgcataccaattccaatttatactctgctcaaaaataggtctgatggtgcctctttgtggaaacagtttatcagtagttagagtttatgtctcataaagttttaagattttatttttcattaaaattctttgaattcagacacttttggtaattcatgccttccctccagtttccctagattgggtagattttcctggagttgcactctctatttttataataacataagcatattgatgatagtgaataggcaaaaggctgtgggtagtgtaagagcaattcttttcagcttcaagggatttttaaaaattctttcattattcaagagttgtaatttgttgtgtatatttaaaataactctcatctttcagtctctccaataaatgcattctgctatatggccaggtgtggtggctcacgcctgttatcccagtgctttgggaggccaaggcgggtagattgcttgaggccaggagtttgagaccagcctggccaacatgatgaaaccccatctgtattaaaagtacaaaaattagctgggagtggtggtggacgcctgtattcccagctcctcaggaggctgaggcacaagaattgtttgaacctgggaggcggaggttgcagtgagctacgaaaattgtttgaacctgggaggcggaggttgcagtgagctatgagaattgtttgaacctgggaggcgaaggtttcagtgagctgaggtagcgccgctgcactccagcctgaacaacagagtgagactctgtctcaataaaaagcattctgtataaatctatgatatctgagaatccgatgtcgtatttgcttattgtctctctttcctgctggaacataagctccatgatggcagggactttgtcttgttgctgtatccttagcaactagaacagtccctgctgcatggtagagtcttcatatttatttaatgagtgtatgaaacagttcattctttgtgcatggaaacatgatatttgcacattttataagatatattacattaatactaatattaatactgccttacatataacaagtttttttatgagaggaatttcagactcttataaaatcatttatttacagaagatggtataactaactctgacatgaggtactggggaagtatttcaaagtgacgttggaatgggatttctggatattgcaggatgcaagaggttgctgaagagcaagtttgtggcacaccaggctgtgagagcaccgcatgggcaaaggcccagggtcatatgatctgcagggccataacaggagtaagtagattggggtcagattatgccaggcgaggaattttatcttgaaggcagttggggactattgaaaaatcagaggacagtgcaagggaaggggatgagaggtaacaagatcagatttgtactttaaggtaattttggtgtctctgtggaggatggattaaagtgggggtgagattagaaaaaaatgagctagaaggtgagagatggtgtagtaagtgggatgaatgagtttaaaaagctatttttgcgattaaatttaagcaatttgctaatgggaaggtggtttgagggagaaggaagagttgatgttaataccaaggtttctagtttgtaagtgaagaatagcaatgtctcaaaggatatcaagattaccagaggctgaagaaagctactgaggaaggttagaaggagagagttgacgagttagattttgagtagcctgtaggatattcaagtggagctgtccaggaggcagttggaaatatatgactgaagcttcagagagaggtcagggctagagacataaatttggatataatcagtgtgtaaatagcgattgatgccgtgagagggaatgcagtgatccaagagagcctacacagtatagaagcagaccagggccaaaccctgagaaggccaaatatttggcaaggtggttagtggagaggttaagaacaggattatcagagaggcaagagaaaaatctggagggagtagcatcttaaaagccaaggggagtttgagaactataggttcatccgcatcattagatgccacagccttcctctgggctcttatacttctatcttaacatatattatgttaacttcatgtattttctatcaggttttcctatgtctgtgagctctgtgaaagcagggataaaaagtgtttcatctttgtgcataggccagaaatggcaaataggtttcatttcatgttccaagtctgagtattctcagctgagtccagagtctgcagagaagagtgccttcatccattagtgatttctgattagtgatttcaggatcagggactgatggcaacttgccctgtatttctcatgtctgcattaggcacttattcattcattattcaacagatacttactgagtgcccagcatgtgccaagtactgtgccaggtgctcaataaatgtttattgaataaatgttgaatggttaaaggaaggctcgcaacatcctttagaaggaatgggaaaggacctgagtgaggtgagccacctctgagagcccagctgaggccattttcagtgttgtgtgcctcaggtcatcctgccttccacctatgcggagtgtactggttaacacaaagtctctggtaaaagaatgccagattttaatgatttttaacaaaaatactttccacttttgtaagtatttaacttattagtgtgcacttgcatctcacttgatctttgcattaatccagcaagagagataggccatatgttgtcatctctattagacagatgaggaaatagagatatttattactaaaaatttgagtaagaaagcaaacactgagccagaattggaactgaggtctgactcccacttctaactcttgagagtatggctcagaaatgggcatctctagtcacaaaatgtggctgagctgtttgggcaactagcagagctggacaccttgtgattcagaggggctttcccatggaatgcagggggccacaggcagcattttggatggtacaaggttggtaggaggaagagaagaaatgattggctcccagaggcttcatgggctcccaattcatgattctttctctgtggctaatttttgttaagtataagaattccaggaatctcttaggaattgtggagactgctttctcctgaaatataaaacatctgctcttggtctctttggagctccactgtctgaggggaaaacagggaaaaagaggtaatataaaacagacattgtttcagacaataaatccccctttactcattaatgagaaaataaatttagggccagaggtgtcagacttttcaggaggcctctttgttcttttcttttctttttttttaataatttaaaaaagttcccacactacactgatgtacaggaaacttctcttaacattgccttttttattttttctttcctgagtgataagttcagaacaagagaccaagtctctggggacacaaaattgagcgtgctggttggacacagctgttccctgtaacccaccctgcttcagcatgttaggcacatttttttgtaccagtattttcttcctgaaatcctaggtaagaacacctgaggggatagatggcatggcaggacacgtataacagtctgaaaaatgtgtaggcaaattcctaaaatcaccattttcctgtcgccacacccttctttcccttttcttttaaatgtcctccatcccctcaaatcccatttctctcctcaggctccttgaggctttcccattccacatttctctggatcctctgagattctcggcttcttctagagtactagggactgctttttgagcaaatctgtgtgagccgcatggatttcatgaaatcacctaaaacctttctgttgcgcttggtaagagccttggatagggaaaggaaggggtagacaggcttagaggcagagactattcttacctggcttacagttgtattcccagcacctaagccagtgactggcacgtagtaggcactcagtctttctttagttaaatacaatgaataatttaatgttgggggggatatggtaaaagaagaagaggagagttggaaaactcatgggcatcttcaacagacaggagccccatgactggggggtgtcttagcaaaaggcttcctggcgtcataacagaagtagtcacagaacccccaagaccggaacctgttacaccagagggttggtgcacattcacgatgccctctgtcgaagggccccaccttccatgcctgcgcgtctccttttgttctgtcaggtttagcattgaggcaattggtggccgccgcctcctttgcctcatctgccccaaatccctgcttgccatcagcccaatgcagcaggctctggtgccaaccacaatctccccgggaaagagatttgagggactggaattgtgagagaaatgtaagctctgagcttgacggtggtccatgagcccctccccttctcacctttgaagcaagaaggggctggttccagggctctgtgggaaagctgctttgaagaatggtgaacttgggccacggggcatcattctgctttagttgagggggtccctgttgggttccaaagagaatgcggtggggttaacataaaagcagagtttagcagtgaggaacccattggtctatggcctgctttcttaattgttagtgaattaagccaggaaggcactgggggtggctggggagatcctttgtaagaggttaaggtcttcatagagtgatgataggattagcaataatttggtggaaacaaacaagcagaataccaggagagctacaagcgatcggttctgtactgtgtccctgtgttctctggttcaccaaggaccttaggcctgttgtcctaaatgatcacagggctggcatcacccttgctgtgatgggctggcaggccaatgtgcttggccctcctgccaaaagtatctacgcacattctgccatggatggtacatttgcatgctcccctctccttaaaatctgagctgggagatggggaagaatgaaaggagaaaatcaaattaaatgtttgaccagcagaatgaattctgtctccagtgaggctggcttgcatttgtcttgctttttattttctgaactttctctcaccataaatcctttttcctttccttttacccattaaaatgtttttactctttgtgccagcactttgtcctttggctctttctgtgtctgtcccagctccataatcctccccatgttcttttgctcactttcttgtctcctgatctgaaccccagcctttcactttgaaatgcttttttctttctcagatttcaggatttctttcttgccttagagtgggatgttcacttaaccctttttggggtctgtttttctctctaactttgggcctttttcacatttctgtgtttcttttttctctttttgagacggagtcttactctgtcgcccaggctagagtgcagtggcgcaatctcggctcactgcaagctccgcctcccgggttcatgccattcttctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccttctgtgtttcaaataatgatgcttgtgtatacataatcactggggctcagttctctttttgattgtctgtttagaggaatgccttggttaggaaaaaaaaaaaattggctcctggactttgccatccaatgcctgtttctttgctttgaggcttgggaataaaaattacttagctcatctactctgctggaagagtagagaagagggtgacataccccacaggaaatggggacaagcccattttggagggaggctgcctgattttttaggagatagggagtgaggacctgctctgtgcctggcctcccactaacatttctcgcatctcactttacctccagcaagaggagagctgacagcctgcaacaatgccctcctttcttctcccagggccggtgttttgatagtgtcaggttacaccccagcctccccttggcccatttataaacctgacacaggcaacatgatgtaatgttatttttcaggatctcaatgaggaaattttttgccccaggtcagaagaatgctagttgatttttgctgaaatgaaccatggcacagtataatatatgggctcctagttcaagaaggtggaggcggggctagggtggtgtattgcactgaagttggtaggttgtaataaagctttttctgcttggaccttccacctctgggcgcctcagccaacctatcattgttgagaaacacccttgtagaagcaggcttgggagctgccccttttaatgcaattttgcattgttctggtgccatagtcttgatttcaaatgcgtcgccattgagcagctgcaacggttgagactaatctagaaagtgaccacagaaaggaaagggggatggggggacttctatgtgaccaagtttgtcttctaggctagcgtttagccacctctcgtagctctggtttctctggctctgctcgagcagtgctgctggacttggtggcgggaatagaaagggaaactggctatggcttccttttacttcctgcctcttcctccttccctcaccccatgatatctgtacctaaaaaatgtcagaaaagtcccatttttgtatttacattttttttttgtgaatgaaaagagacaaaagattctagactggaaaggtgcctggcactcagctggagcactgccctaggcggaggaagagatgcagaatatgatggggctcccacctctgttcccgtcttcctggtccctctccccttctggaggtgactgagttgctggtgtctcatgagatgtgataaagcatcctggttaagagcactggagatagtatccagcttggctttccatcctgttatgaattggcagattaaccttggacaagtgatttgaactctgcctcagttcttaatctgttgagtatgaagaaaaatagacctacctcccagggttattgggcagtttaaatgagttaatgtatacaaagtatttacatcagtgtgtggcacccagggatcactgtatgagaatttcctgaacaacaacaacaaaaaaacccttctagaaatatttttacaaattatgaatgtattttcctaattttgaaaatacaactagtagaataccatgaatactgttctgcaccttgcttttatttatttatgtatttagcttgtttcttagcaatgtcaagccttatgttccaatttgtgagctatagtgttttgttaccatccctgtaagacaaagcatctaaagtaatcacctaggtatgcatacggaaaacctttctggactgtcagggaaagcattttatcccaactgccctgaacttgtcactcttctctgagcaggtcacaccccttgctgactcagcctttgtactgtgttctctgccttgaattcattctctcttctccacgctacctggcaaactgtttttcctccttcaggaatcagctgaagtatcaggattgccgtaaagctattcctaactttctccaggctctcctgtgagcccccctagcattgtgtgtctgtctgtgagccagccttggcacacagtgttgcggttatgatctgtgtatatgtgcacgtgggggcccagagctctcccacgctgaacaccagcaattagtacagtgtctgttacatagtcatgctccatgtttttaacaaataaacaataagtactttttggtgacaacatcagtttccttgtcttccttctcttctggtgagagtgtcttgaggtagaaacgaagaaatctgactccaccctagcacctgaccaaactcttagtcccactccaaagcatgctctaagctggactttacctgggggctgcaggtagattgccccttcagctactctgtcttctcctggaacctacagtggagatcccagtatgcaccgagaaccttagaagactttctggcatgtacttattgctttgctagtaaagcagcacttgagcagatcaactccatcaactcccaggatgaccttcctctggtatttctgtggggtgtctgttgttggggaagcagaagcacaaagcagaagaaaccaagcacagttccttgcccagaatcactcgggaggcaaagtacaattccgttcttccttatgttgggaccttcggtgattgggtcctccttgtgtgtggaagtacatgaaagaaggatagacaaaattagagcatgttttcgagaccatttggttcagcctctctgattttacaaatgaggagagtgatgcaaagtgtggttaagtgactataccgaggacacagacctactttatgacagaggcttgggagccagattttaggatgccggtagttctaaagtatctagctgtgctgccgtctgaatttctggttcactccatcaggtcagcccatagacacctcctttttcttaggtcggacctatcttattcgtttcctcttttgttctctgcagctgccacccccactcctacctcccctattctctatgttgacatgtgacttggggcacttgcaacgtccctacctaaaattgatgtttgccacctggctgctgactggtgcgctatgctgcttcactctgcctgtttcaaccctgtgaaatatggaagcagatcataaaaaaatggactcccacacattttgcagatctaaattgggccttaatataatgtacttggttatgacaaacaggttttctagggcatgaccggcagcttaggctggcttccctggtcatgtcagttgaattctttttttctttttttgagttgggagtctcactctgccgcccaggctatagtgcagtggcatgatcttggcttaccacagcctccacctcctgggttcaagcgattctcttgcctcagcctcctgagtagctgggactacaggagcctgtcaccacgcctggctaattttttgtgtttttaatagagtcagggtttcaccatgttgaccaggctggtcttgaactcctgacctcaggtgatctgcccacttcggcctcccaaagtgctgagattacaggtgtgattcactgtgcctggcctcagttgaactctttaagattattcaactctttccttaattcttaggtagtcaggattcttcaaaactttatgtttctctgggagtcaaaggaagtttatggacacaatttctccatatagtagcttatttctgaaaataagaaaaatgagtaagttggacctcatttctttttctaacaatgtgtgggttaccctggtcttgttgaccagtttatttccatttctacttgttgaaataacctttcaaataaccacaaggaatttttaaataactaagtcactatctttttctctaggttcaattttctagcactgatagatataaaagaaagtaataataacattcttttttttagaataattttttttttcttttcaggcaagtaactatttgttcaggtgtaatattcctgattttatactgtggtgattccctatagatgacaactgctcaaactctagccttctaaatgttaggtaccaaattgacctttttgtaatcaatttgtttttatctagctttattaacagccagccgccgcaccgttgattggatcgacgaggtggtgatgtgaaacaatcgctaaacgtggccaaagtaaccagactgacttttgtgtggtttttgttttctggacaaggattctgttagttagaacagcatttaattgtgcccaccacaactaaataaaacccacgagacagttacaaatgaactgtcacaagaggggaggagtgaagtagaaggagccagagggagagcctacaggccttctgtgaatgaccacaaaccctctcgactttgggatttggcctccctgggttggatatgcctggaagggtcgcagaggttaagagccaggagtctggggaggccagggtattgtgtttggttacagaggtgccttccaggtgatcaccatggaaatgcctttcactggggtctccagagatgaaaaattcaggatatgtctatgtgaaatatggtcttgtaaaccatgggatagggatgggaaaagttggcttagtctctctctctctctccacctctggagtggcagctgtgtgactccctgtaaactttcaaatggtggttcttcatgcccggggatgattccgtgtgtcaacaagtctgggcagtctttgatgtagccaccagcgtctaggccaggaggcacactgctgctgcctggtgccctcatgatcattctctgtgccttctgctgccctctcagcccctgggtctccctccccaggtcctccttactcctgctcctgtgacgaggggtgggaagctccgtttactgatctatatattattgtgttggtgggaaacactggctaggccaaataataatgtcttgcaattacttagcattatcttgggtgtatctcccttgagaaatatattcctggaaatataccagtaaaatgagtttcggttagctgaatcatattttatagccattgaagttattaatgtagaaatttttctcaaggacaaaaacctgactgaggccatctcaacctcactgaaattttcagtgaaggttaagaggcatattctctgataaatacaaggtaagaacacttcatgtgacagaaaaaaaaatccaaaattgcatgttcccaatgctaacttcagagggagctgcattttctgagattattccgtccttttacatgcagtgataattactaatatgtattgatactcatcatgtgctaggcatagtgctaaacccattgacatagatcatttcacataatcctcataataatcctttgagaaatggaatatgtttattctgatttacagattttgagactgaggttcaaataagttaagtaatttgctcaaggccatacagctgttaaatggtagaactgggacttgaacccacctggagtccagatccagaggtcatattttattacctcttgactatctttttcctgttataaaatagtataacttcatcttaaatattattttaaaaactcctcaaatttatatgctaaagctcattggccatgtgctggtgcctttaaatttttatcccccctagagattataactaagactaatgtctgtggctactcaacccagttggttagagctaatgggaccaaggtgacaaggttcagcccccatttgagtctgttagctgggctgagtttcatggccacagaattaacctttcaccttggccagctgcctcacaaatgcatgttgttgatcagagagaataaggaggagattgtggataaaatggcacagaccgctagatcagccacccaagactatggatggtggttcagtaatgttttctttccaatatgggatcagacattattgccatgtatagtagtttaaaacagcatttcttggtgtgctccttggagctggttatttgttttagtgtttgtatgtgaggaagcgttgtattgccaagtaagattgggagttaaaagagctttctgaactacagggcttccccgaggtttaatatgttaatgtgtgttgtaaatctctcagaggggtgtgtgtggtggagtggttagcattttcagaatttatttgacctgaggaccttttccctggaccaggattcttaaaaacacactttagaaaattgtgtcttaaaaatgtacttgctttgttctgttattttaaatccctatagtagtctttccacattggggatcagttacagttaaaaaagaccagtttccatattccactaacttctacatgtgtggatctcctttcagcaggctctatctttacctccaaagtgcttccgcatctcttgtcccattttcttttttttgccctatattttaaaccaggattctgttgctggccataacacataccccaaatcagtaacatctcagggattagaacccagatctctggcccatttttctttccagcggcctatgctgcctcccagtggacagagcatttgcaaagagcagagatcataatgcttaattcttttctagaaagcgtttgcctggtgtctgtgagcatttctctggcctgccattgctcttgaattataaggtggcattgtcgtaactctgtaagcaagactgaacaactctcctcctccccgcctccccaccaccaaaattaagtgcattattagcaaacacttaaaagttcggagaggagattctaagttgacttaccccagggagaataatcacggcgggggggggggggcactcaagatgatcagcactagcccagccttctcccaggctggggtaagggtttcctggggagtgctgaagtgcacttgaaccttgtcaatgactgtctcctactccgttgctcacttgctcttgtctcggtttaattttgcacagctccagtggaaatttcagtgatctgataatttggaaaataaatgaaagagtggaagataaatttttattttccttttctcaaaaaaattacacccaagtgaataatctttatgctctatttctcagtaatatttagatgctactcctgaagaatagcagagctgccaaaatcagtagggtttttttaccaagctctgcttcagtaatcctatcacttgcctgaagaattcattataacgaaataaacacattaggaactccttggtcttttacatctctaatatttatgaagtactgaggctctgagccagccaataaggaagctggcaattcacagcaatcagtttaataggcattggttgatttggattgcaaaatataggtgccctgattagccctctatatggacttgcgttgttcttcagccattcaaaagctacctaattatgaatattgaagtataatgttctggcttttaacataaggcacttaccttttaattggccatcagctttgtttttagcgcttatgtacctccactgggattcaaatgaaatggggagataatcaaccagtaagcagagaaaagggtaaaatgatcagggataattaagtggcagcagggaaatttagggttagacaacagggagagaaacaaaagaaggaaactcacaggaaaccagctctctgccacactgccaggcacaccccttttgaaaccacctttgattccctctttagcttacaggtgggacacatatagactttgtggctgacatctatcagcttgagcacaaacttgattcctccctgcgcctaaactcagagccaggcagagggtggggcattggatcttcactgcacaaacttggcagaggaaaaaagaccattaagtgaaggctaattggaatctgccccaaactgcactttgttggagctatttacaatatctttcaagcagctgacttacttactgggttattcagtgaaggggcagtgagtgaggggatcggtggggagtgctcaaggagaggaaaatgacctatacaaggcagtgggtgctttcttacacctttgaaaaattaactcctacaccatcttagtccttggtacaaagcctaagtactcgccttgaccacagggagcagttcacctcccttgggtcatgtgtccctttattttctgaggaaatttatggtctagttccagaaaattagcctagatacacacattttttttttccccatggaatttcaggaagctgaggaactcctgaaagaccatccatggatcttctagttttttcaggttaaaaaaaatcctgtttttagatccagaagtagggctggaagcaatttttatacataattgtggagagtgaagtggagaaagcctaggaaaaataatgagtttgccttttaaatatttctttggaggccaggcgccgtggcccatgcctgtaatcccagcactttgggaggccgaggtgggaggatcacttgagcctaggagtttgagaccagcctaagcatttgagaccagcctggtcaacatagtgagaccctgtttctacaaaaaattaaagaattagccaggcgtggtagcacacatctgtagtcctagctactcaggaggctgaggtgggaggatcacttgagcccagggaggtcaaggctgcagtgagccatgattggacctggcagcagagtgagatcctatcaaaaaaccagcaaaaccagcaaatctttatagaaaaacatgaacttcttttaaaaaatttgtattaaggtactttaaaaacaccatttgtatttgaagatccaaaatagcacatctgttttacttattcaagcagatttcataaggcattattttgaggctatattttgttagtgtaattctagctaattctaatttttatatgcattgaaacatgataaaattatgcatctttaaaaatagccctttttgcagtttaggcttaaggaagttcatatgcgtgcatgtgcatttgtgagtatgtgggtgtgtgtgtgcaatcttttttcttttttgttccacctcaccaccctgtgacatgaaatagggacttgtctataaccatattctcgtggcctaaaatcaggtctggtgctgagtaggttgctgaatacatgattaattttgtaactgttgacttcaggttttgagaggaaagtcaaagaaatgttttcccctatattcttttcttttctttttttttttgtgatggagtcttgctctgtcacccaggctggagtgcagtggtgcgatctcgcctcactgcaacctctgcctcccgggcttaagcgattttcctgcttcagcctcccgagtagctgggattacaggcacctgctgccacgccaagctaatttttatattttgattagaaacagggtttcactgtgttggccaggctggtcttgaactcctgacctcaggtgatccacccacctcagcctcccaaagtgctggggttacaggcgtgagccactgcgcccggcattaaaaaaaaattaattaattttttgagatggagtcttgctctgttgccaagctggagtgcagtggcacagtcttggctcactgcaacctccgcctcccggattcaagcgattctcctgcctcagcctctggagtagctgggactacaggcgcgtgacaccatgcccagctaatttttgtatttttagtagagacggggtttcgctatgttggcctggatggtctcgatctcttgaccttgtgatccgcctgcctcagcctcccaaagtgctggaattacaggcatgagccaccgcgcccttcctcccctattttcttaacagtcttccttctctttctgtctgtctgtatttgtattttgccttccttttcttttatccccaacgggggcgagaattaggttcccagaaactattatgaacattttccttggctgatagcactatgagaaagcatcgcaaaggactgcctggggggtgctatttagtacagggggatgggatacggactggtttactgtaggttctccttcaggggctgatttagcttggtggctctgcagtcttaggctggcctagttgcccatttcataagccacacaaggctactggactgaaataatcatgaaacaagaggccatccctcttgttgcacagtctatctttttggccataattaagaatcattcacgtccagggtgcacatttagccaatggagtttcttaactcctttgagaaaaggatcaatggacatacctgaacagaaaggtttctgtggttccataatgtaagagttccaagtgcacagaggatgattcctgagtctgcccatcgaataggcatttgggtagattttttttttctacaatttgacttccatcttccttaagaatgagaagttaggaccagaagaaaagctcccatctttcacactaaatacgttctataaaaccaagcaactttgattcttcctccctgtaaatgaaccctggttgcatagcttttgatgtgtcaagtcaggtgtcagacaagctagagggtataggaaatacttccatttaggcaccatctaagtttacccagcctctcttctgcattgacattggctgtaatccttgtaaatgctgagtatactcttctttccgtgtgggcccaggaggcaaggctaggctggaagtgatcactaggtaggagaaggcgtcttgttggaaggagctggtgtaaaacagcgggttgccaggcctctgttcccagcgttgtctcttgtgaagctgttccaaggaagccacatttctctctgggccgcactgttgtgagtgcctaggatgcttccggtggatctgtgtgaaatgtcaagtccacagaggttagcctagaatctctgtgctgaaagactagcaggatttttggactccaaagttctggattgatctttttctatcgtaatgactagatgagtgaggttctcctgattgtttctgaggctgcttgttccctatgccctcagcctgtgaccaaggtatagctcactcggactgagtgcttccttgttcaggatgaattaagcacttgatgtgcacatgctgttaactcatctcccccaactcctttgaattctctacccatcatgtacttggccactttcctgagccaagcacttcattatcttcttgtcctgtgagtcctaatagatatatttagaaacacttctatgaaatatggaatccaggcttaaccagctgtttgaaatcacaacccacaaccactttgctggtgtgtgctcacacacacacacacactgacacatgcttgctatacatacatacacacagtttccatcttttttttttttttttttttgagacagagtcttgctctttcgcccaggctggagtgcacttggctcactgcaacctctgcctcccaggttcaagcaattctcctgcctcagcctcccaagtagctgggactacaggcacgtgccactacacccggctaatttttgtatttttagtagagactgagttttgccgtgttggccaggctgatcttgaactcctgacctcgtgatccacctgcctcggcctcccaaagtgctaggattacaggcatgagccaacacgcctggccagttgccatcttttttatgtgctttccttccttctctcttctctagatgtagcatgtctataatctctggaggtaagccccgcctcgttacacacaagaggatcatgactaatgcggtgtatatagatagatagagatatctaccagcatgttaataaagggcctgatagggaatcgaagaacgtcacccccaggtaattgcccacagtcttctgtagccactgctggagagggcgtggtgtgggaatgggggagatgggcacacccgtgtgcaccatgtgttaggtggcaggaaagaaggagatttctgaattttatttttttcttgtctaggaaatttttaaagcttcttctgcttagagccttgccagggtctaattcccacacaggtgggagtgggtgcattaggtttcacctttttacgcccaagcagccatctcactgccaaagtcgtgcttactgatgcactcctttgactgtgtttctctgccttttcctcgtgccttgcatctcctctctgtgcttgcctttgtctctctgtgtctctgtctatgcctttgtggctagcatcttggtgcttggatattccccacttctctgtgcttcttggttcctgcagagcctgccttgtgcctttcattaccacgttaacaaactcgagtcgtgcctaacgacgtcgcctcatacgttatgctaatgatcaagagacatgttaatgatattttagaagcctaattagtggaatatataactatatgcaatttggtaatggactgtgacaacaagttgtgaaaagggggcttgacaaatccagttgcatgtggcctcagacaaacaggagctgagaatggatgagtggaaatcagacagggagatagaaggaggaagtgtgtattgggggtgtgaatgcctgtgtgtacacttaacgtgagggtcaatctttcttataggtagcattgctgtcttgtcatcattccactgtcctaaaaccacagggctaactgtatctgaagaattatttactgatgttttttaagcaattgctactgttgccattgatcatactggtatatctttgttagaaatgttattttgattatgttattcttcacaacatccttacttgcaatttgtaatgggagaggtacacatagaagataggttcttgtgccaaaaagaagttttattgtgttataaaccaacaatcaagaccatgtaagctcagaaataatctgtattgtgtctatcaacattttgatagtattggtaggagtaaaacaaggagtggtatgtgtaaaatcattcagctgtttgaatgtcattttctctcaatgaaagaattggttagaggcatgcattccttcagctggtatctttcttcctctaacatggtgattctcaatttgtgggccacggaccctgagggagccttgaagttgttaaaaaggtttagtaaattcatgcacataccaagcattgtctgtaaacagaataatgtcatggacacacatgcagataaatatacctactaaaattctttgaatgtatgaaatgctattgtggttaatgaaatgcacattcacttaaacaagcattttttcagttcctataggttttttttattcatgtgtatcattcctccatctgtagaagctaaaaatacaataactctcttatagtggtacttgcaatgttttgacattaagagagagactatacattcacagaggttgggagcttctgtctagcctgttgtccaaaactgcttataaaatttagcaactaattttcacttttgacaactattttaattctagaaaataggtttataaagattttcttaaagtgttatctatccttccaatgacttattataaattttagaatgtatttctatagggtggaaaaatctcctttagtcagaattgaacagttttcatgaagaacatgttacaccatgtagaaacatgggtactgcagggcataggtggcactagcttatgggagcctgaattccagaaacttgattttactttttgtttaggattaaaatgccaaaaagagggaggcttgcagtatcacacttcaccaccaggtaaagcttttagaaacatatattcagtgtgaaaatgccccaagtttgcagcttcttgacggataaagacagttacagagacaaagaaagttagtgttttatgaattagtcctctactcttgaagtagtatagcttatcggcaatgaggtacatttgtatttttttctcggctgttcttcctgaggaaatacaccatgttaccattgaggaagttcttcttctctctttccccgtacatttttattgtacgcagaaagacagaagaaggaagccctgaaggaagattgtgtatgaacccaggattctgttattacgtctgatgtttgtttctagttaaaaatgagaagtaatttttgggagggagacagaaatgggaaaagtttataagcgagccagtggaaaaagcacattcattatcagtgtctttctcactgagtcgtttgaaattggaaaattagcagcttctttgaagctcataagatctttcatctttgtgtatgtgagtgtgtgtgtgttaatactaagtggagattctttctcttgccacttatttggtttttctgctaataatgaaattataatgagatccctgatgggatttaaaaaaaaaaaaaaagaaaaaaaacaccttacatgaattatcccattcccccaccctccttctgcctttctgtaaaatctattctgcataataggtctttgtttctggatttgtgacagaattgaaggaggccaggagtcggaactgcccctcattgttctttttggtgactaggatacaaagttctgttcggcacagagtactctcctctgcttctacctccgggaaccccgttaccccccagcccacacaccaccaccccagttttgggtggggagaaggcaaaggtgagtgttcgatatctttgcaggctgaatggccagttgacttgagatgcatataccatgccttcccccttttatctttaaggattcatgacatgggctgctgttgagggaaccacacatctatcttgatggcagaaatacggtatttggaaatcctgggaaaacctctctcaggataacattttcagtagtaggttttcctccctgttacctctggttcctattccattgccctttatcagtacaggcttttgaaaatgccatggattaaagaggtcccactgcccagggctgagcatttctttgcccggcctggtctctgctagtgggtgggtaagtggagcctttggaagaaggaatcggtgtatggactgttcaagacagacacatacttatctaatttaggcatttctagctgtaggaaaggcaatgatgtgatctattccaatgaagagtttacactttggaaactcagtttcagaaaattcttccataatccaacctaaatcttttctgctttactattttgtcttaagccagagataggcaactgctgttttcccgtcttaaaactctagaaaactggagtgtagagaatgggcaagatgagaatgcctcgtctatgtatgtggcttagtcaaaagctatttcctgaatctctcgtgtttagattttctcatcaacgttaatgaccactttcagggcctcactccctgctccccatcatgcctgcaggttccccctctctttcttctcaccatttaacaggtataataaaggtggggaatctttacagttggtgattttatatcatagatcaaagatcaaagcagaggaatacacagcaaccataaaattaactgctttttcaattttacaatgctttcagtgatagagaatcttataaatttaatattaattaaacacttagcttttaacctcctcctgcatctccttttggctggtggctggaaaaaattaattgggcatcttaaatcttgtattactaatgccttgacaggaggggtttcagaagcacttagaacttcagcaaaatgtacttggagcatttgtccttccactcacctaattgaaaatgcccccttttttccttaaggaaaaatgaaccatttgcaaatttttttttaaaggaagcataagttacagtcccctttcatagccaaagctttaactcagtcccttggcactttaacacttcacaaaatggaagccattgaacttccattattataaatgctctattgatttttgagtgtgttggtaccgatgtgtggccggcaattgcttggcctaatcattgtgtcacctgaagcctatgcatgttcaatccagcaagaggtgcctcctgttttggtgagctcactttggcatggtagagtcagaggtggtggcatttgagaatggacccgcagcatcgtgaacaggaaagctagaatatcagtgaaaggaaataatatttctcttgaaggaagcctcaagagatgggaagccaatgtgatggaggagatgttttggggaagctagactaggctgttcacattttcttagctctggaaggaatagacgatgggcttttgttgggggacaagcatttctctctttaaaagccaggcaggcattcatggctgtgcttcagaagtggctcagtagaaataataataccaatacattgcatctcttttgtattttttttctccagtgggcttggagaactttatccagataatctcatttttctcacacatcactgtgttagagaagaaggcccctgaatttacccaagctggttctctgctatgaccgtatatttgaaactagcaactggaaattatagtgaatagagcaagaaccccaagaatggatctttctgtacctgttttagattcaggtaactgagaaaagtatgttaattgctttttggggacatctgttcctagcacagtgctcagtgaaatcccttgggtttatgagtacctgacttggagaagaattataagaaacaaaatttgggggagaatttaaaatgtcattatttactttacaaaaaagttttaaaaattttactctgaaaggcttcactgcaggtttgctttaaattgctaagttttctagtcctgtagtcatctaatgagactataaatcagtttacaactgatactttagaagcatattttttgagtaaggtaagggatatagaacatgcagcatgacagtcccctatctcctgctctgggttgcaatggtctctttctccgagtccgaacagtcaccttgacaatccttgatggcagtagggagcatttaatccaactgtgaaataataaattagctgtggagtcaccaccagaacagggaatcctggctttatgcacctggctagtttgcactccctgtgaaaccatcacggttccttctcattgcagctgagctttctgaatcttttaagaactgaattgatgggatgtggaatttgatagccgataaattaaggatattggtaaatgtagcaactctattagaagatagcatttccaagatcagtagcaacatttgcttgcgttgtttgtgagtgtatctgtggaggtcctttatatctgtatctctctctttctctctctatctagatatatatgatatgtggggtgctataaaatttttagtgccttagtttgggttgaccgccttattactcacgagtgagctatacaggtcttccttaacaagtggcaataaaggctttacagcaccccttacaccgtcacatatttttgtttaggccacatattgtctttttctttttaagtctccctttgctcatgtccctctcaagtacctttgttgccatggcaacagttccatcgtttcttagggtagagcaggatgacatctcacgcaagattcttgaagtcagtgcttgtttggactgacctcaaacactcagctggggccagtgctgtggcccttaccctggtcatctgtgacactgttttctcttttttgctcgaggctctgtttattagactgccatgtctgtctctacattaatattggccgtgtctccatggacctgttccaaggaatggaaagaagctgatactcatgatctaaaattgaaaaaaaaaatgttagtgttaagcattttgagttaaatatggagctttgtgagtggttggatgcatagtaaatactgtggcaagatggaaagagtgagggcagctcatcctctgcatgtcaatgttctctttggaattccctcacgggctcagttttgacaggttaccatgtgcatttttcagtcctctctgtgtgtctttaagacccagcagacctaccttctccctgactcatggaatattagtcctaaaagggagtcacagaactgagtccagtgcactgattacattcttagggaaactgagacccaaaggggcatgtgtcttgctaagatcactcatcctttattggtgcagatgggatgaaaacccacatctcccagtcttcagttgggcttcacctttgctacaatttgttagttttttaaaacagaaattatttgaaagattttactgtcaagctaatttcctctcaagccactgcaacatttctgtaaaaagtggctgtagccatagtggagacctcatctggcaaatgtggacaggtggtgaggctgtacctccaaatttcttaattctttttccaacaagaaggttggcttgccaattctttgatcaaaggtaggagtttctgtaatctgttctcttaaccacatttgggatgcttgtatatatgactacatatatttatatattttttatgggcaatattttgactgtttctcttttgaaagacagtgcgaatgagtatgccaaaaatcacagatgatatgagaaatgctatcaataaaagcattttttcagaaaggtgaataaagtaaccccaagataacgtaaaatttttcctaatgttattttgcaaagtcattagaaaacctaatgcttgtgaccaatggggtgatgctcgtgggacagtacgtggctgacgttgtggttttcactgggcaaaataattcagatctacgagtcttttggcatgggcatagacagaaagattgcataatttgttcttggatgacgtgaaaaagaaccctgaatatatttttcgtttctatgcttccaaagtctgagtgggatgttttacatggatgggtaagatgggattttaggagacagataatgctctgttttagatcttcacttggtctttccaacttgtaggggtggtgtggtgatcacctatttgactagtggttatgctgttttcatatttaagctgcctgtagcaattcgtgatttgctatcagtacatctgtcaatctgtaatattacactcaatatcattcttcttttacccaaatatttggtaaaagagaaagctaacatgcactaggttcctaccaagcagataagatgagataatctatgtaaagtacatagtataaccctgaaagggattattagtcccacttgacagatgtggaaaatgagccctagagagattaaataaaatagaaccttctatgactaagtgactaaattcaggtctctgatttcaaagcccatactctttcctctgagttgcattgcccctaccaggtacttggcaattactgtcttgtgcaatctttggatctttgccttgataatgtgcttaatcattcccttcacagttcatagtaaagtaagaatgacgagcatttagcatcatcacacacaagcctaagagtcagcaagactcaccttactgtaaagctagcttcatcagctccagcagctttccaggtagcaagatgtcactggcagagtggataatgaactagcacatgggctgcatcaggaagccctggggacctcgcagaagttgagagtgtggagtgggagaatgggaggagtaatatattaaccttactgatacacaaagttgctccttctttttcttgcaggttagtgcacataattgttatctcactattactgtgttgtttttgtttttgtttggctttgcagtttaagatagcttttaaaagccaccatctggtttaggtgctagatgaaagttctggttaaaaccaaacgaatagtttcataacctagtgagagagttttttttttcttttttttttttctacagtattcaaagtgctttctgaacaaacttaaatttgtttggatgtaagcaacacagagaagtcagaaaacaaggctctcagattcaagtaataaaagcatgggagctggaggagagggacaaaaaaattaagtaaaagaggaaaataaaaactctcactctgcattgacccttttactgaggtgtaaggtacaaagcataaataatccacatggagagtgacaagtccacttacttaattcattatttattttagttattggagaagctcatttctgcttagcctccgggcatatttacaagtgtgatagaaaaaagacagtccctgccattgctatttacaatctacaatagataatatataaacaagacatattattttagtagacagatgcatccagatacactttaaacaaacaagagtacagcaattaatgtgcatatgaaatccgtaagataaatcagctattgtagcacgtgaaggaaattaatacaaattaaggaattggaactgatttgggccatattcgactattttcatattaagaaacattattttagaagatctgtttggctgcagcggagtcaggaactgggcaagcagtgttgtgacttgcttgttccacaggcagagcctgggcagcactcaataacacccctcaccttcataggccatcagccgtagagaggcaaattagagcactggcataagccacaaatcacaggctgttgttagatttagtctgacccttagcatcattttatcggagtcctcttgaatttaatgtgattcccttcacaccaccccctctctggacaaatactaatattgttattgttatcgccatgattacttgtggctgacctaatacccttctgccctgaaaccacaggaccttgccgcagcctaggcattaatagccctcacagcacctcattgacatggctgcactggagttgaagttacaaagcaggaagtatcatttagtgcccctgctaccctcgcccctttcatctttattatgcagtttcttcttatggtgctgcccattttcccaaggaattaaagtcgcagatattttgatttcaggggagggtgagggggaagttgggctctgagtgtagagaagcaagagctggcacacctgtccttaggttcacagcacagcctttctcctgctggacacaggagtaggatgaaaagccaacatcaataaccttgagtatatagtttcataatccatgaataatttcaggaattacagatgtactcttagtgtagaacatgcagaatgcccaccgtggattcaacactgtgcaaactatgtgtttggggttttttctcaattggtggctttatatcaacctccccagcacacttatatctaggcttttataatgattaatacactaggaagaatcagtggtacggacacattggacatgtggtatttatggtctagaggatattattaccaggaactcattggtgctctccacaagtttgatgttggttgagcagtaaacacggaggcacaaaaggatataattaaggtgactctggaagtcatctaaaaagtgggaaatggattttatggtgcctagatcctagggttcatgtagagttaagacctggaagagactttggaaatccccagtcttgttttatagataagaaaacctagagtggatatcagtttgcttaaggtcatacaattagtcaatggcatagctaagactcaaaactagtttgcctgttaagtccaccataacatcctcaatgtagaatgtccttgaatggatgatgttactgacttcttttcttcacaaccatctctcctctctttcttttctttttttttttttgagatggacttttgctctgttgcccaagctggagtgcagtggcacaatcttggctcacttcagtctctgcctcctgggttcaagcaattctcctgcctcagcctcccgagtagctgggattacaggtgtgcgtcaccatgcccggctaattttcttatttttagtagagatggggtttcaccatgttggccaggctggtctcgaactcctgacctcaggtgttccacccaccttggccttccaaagtgctaggattacaggcgtgagccacagcacgcagcccctctctctctttagactattaatagttgggtcattttctattactagtattttcactgctaggtccattttgttattatttggggtctcagtatggactgtttcttggatctggtagaatttgaatggtgtacgttatcatgaatactgaattacctgagcctttccctgcagatttcctgtactatacaaggaaaagtgtaatgtagtggttaagagcatggactctagactgtgattgccaggatttgaatcccagctccttcaattacatgctagttgttttggacacattatttaacctctctttgcttcagtttcctaatctatgtaataggaaggataatagtagtatctacttcataggtatctgcctcggagttaatacacagaaagcaattaaaacagtgcctggtgcatgttaagcctcacagtatatttgttattattgttattattattttcttcactctccagcagtggccttgagctacccaaaaggttatgtaatttaatcttccattcaattgaggaaggagctctgttgtaacagtcccgggtggcgttatccagctctgctgtggcacagccgtggatgaacagtttcttccttgtgagccagctccccaccacctgtaatgctcagtttttagtgccagctttgtcttctggacctgcacagtgtaaggcttttccttcttcttgtttggaggtagctccagcattgctcactgagtattccctgtcctgaagcctgtaattgtggggtttctgtgaggtttggccagaggcttcttgagggatgtggccaggtgagtttcgaaggtcgagattagtgccgttgaccttctgcagtgccctgcctggccccacaccagctgacacttatctaggactaaaaggatggttataataaaacaccgatacaggtaagagctatggaaaacaaaacttatcattttcctggtccttatctcctaaagcatttattatttcatgaacactttgaaaagagagtgctttttgagcttggggtaccgttgaaactgagtggacctgactactatggcagtgcttaaaatcagtttcttctttagtccctcccacaatgctctttgggtttcgtttctggaatatgaattgccaaaattacttgaactgtctgatggaggattgtaagctcaaaaaggaagtgttggctccccattaatacaccaacaccatctgatagacacaaactttctttttacccagcataattgggcaaggtcaggactccctcggacatggtttggggtctttgttgtagggaaataagttctttgggagaaatgattactctcagttatttcctagcctatcaggacctggaaagaccccaaattttgagggtggggccttttggagagtgccaggtttcaccaactatgtgcacgtggttctatgtagacctgtccattgatcttggagcctattcttagcatcataggtgacaaggggccatgttgcctgcctgtagagatggcaattgtgggcaggagttaactctaaggctgcgaatattctgtaccttctttccttattcttataagaggcaagtgatacatcttagagaaggtagaagtgtgtgtgggggaaggggtttattgtgagggtgggggtggggagaaaaggaggaacaactgtaaaaaatgttaatttattaatcactgaatatacagcagttcatctgaaatgctgttgctatgccaacaccctgggagtttattttcttaatccaagagaggagctctcagtcccctgctcccctgctgtgtcatttgaatttgctgctgccaccgctgccaccatggtatctgttttaaaaagtggggggcgaggggggagggaggggaaccaggctaaaccaccaaagcagtcaaatgcaaagcagtaagaggcctttctcagtgcgacttagtaaaaatgacacaaattaatatactctacttaaaccagaccaagattaatggttctctttcagtgcagcttagcccaactgtcactcgacaggcgtttgtcggacaaaatcaacactaatcaacatttattcgtctcttgcccttgggtctgaggcgcgcgcgggctgcgccattctcccgctcgtctcgccacgcttttcaccctccatccagcctcgccatatatcacccttcctcctgtgcctctcctcggacggatccacacactcagctatcagggtacattagaggcatgatagattttctgttttaatttacgtctattatattgcaacataacagattttgattccgtagagaccggtgtctcctatagccagactccttgggaggatttctgcattaacttattaaggttcgttaggatgcagcttcaaatagattcccttctctctggcttgttctctctctgtgtggcaagctcagtaaagatgtcttggtgtaccttattcacaagcacagctcattttctttagacttggcttcctgtgctggatcacatgaggctggctgggttcctcctttactttctgattggactttgatcagccaacaatgggcgttgcaagctccccagtccctgcctggtctgggtaaatgggccttgacaaatctggtggcctccagtcagtgggcaccccctcccaggctttagttctagcccccagcatctttctctctctctcttttttttttctccttttgatctcagttacagttagattttatttatattgcacctcaggtctacagagatggaaggggggaggaacacagtttcttgggttaaccaaggagaaggatgttgaaaggatgactgaaagagtgagtctgaacaaggctattttcatttctacatgaccatcttgaaggcatcttatttcagcttggaacaaggtgcatgagcccagcttgtttgttgcatgtgggaagtgtatatttttagttgccttgtagagtggctttccacctcatttatgaaattggctttttatttttatccttttctctttttccctttcaccagagttggaacgtgaagcacagtttctacttgctgacgtagtatttcctcttgatttttagtggggttggggtgttttatgagtactaaggtcacattgaactttggacacctagtcaccttgttgctggctgcagagaagagcttgagaaggagacagaaatcttctcgtcttctcatcatggctttgacaaatgcccagggagactgcaactttcttctcaacttggctgtaacactggagcccttggccacttagaaggcctgagtttttttatattttccaccaagctgctgattctaaactgtggtggggtttctttcatggccagaatggggagaaaccgtgggctgagttggggatgtgtggtttgtgtgtgtttatgtgtgatcactgaagtgtaggatatggtaggaggatggcttaggacttccattttggtttcttattacacagcaataaagtaaatggggcttagtataactttgcacttatagaaatgtagctcaatttaagaaacaaaactccgccaacaggagtgctcagtatcttcagcttgggaaactgacctcgttaattttaatgaggggaaaaattctccagctggggctgagaagaaaatgaaataccaatgaggttatcactttggatgatctcactgaattcagactatacttggaacgatgcttggagaattttctaaaatcctatggagagatttagaagaaaatgcatatgcccttgatagtattgacagactgctttccctgataggcagagccgaactctatatagtgcctcctaaaggggtcatttgaaaagttaacatattaaaaagttggaccaaagtaaaactgagagaaaaaatggattaacgtgattcttatgtgggtctagcgtgaaagcagcggggctggtcggacggtggctgaggccgttgactataagccaggggctcctgagttcaagtgcctactgggatgctaacttcctgtgggattttgggcatctgttttttatcgaccaaaggcaggaggtagggtgagggagtcctgttattcagtaggcagctatttgatttgctcaataagttgatgactttggccctgctgctgaggagtgacagattgtgaccaatgaggttaagatgactgtaggacaagtttgccctcagtgaggagaggcctgccaagttccactgacgtttggttggggaccacagaaagaaacatcaccattcaaggtatttggcccttattttgtcctagttcactaaatggcagatcctggggaggagattatttcaccagtggattcttcagaggtatgggggcagacagaacaggctttcttctccaaaagttcaagcttgctgactcaagcttcttactcatctctctggcatgtcactgcactcaggagaagatttgtgcaactatcaggtgcaaactcaagtatcaccaaagggatactttctgattaaatagagccatcgtgctctggggaccatctcaatatcagtggaatattgagggggtctattaatgtttatacgttccttcgaaattcagcctttttctttgaaagctgtaaggcagcagttaagggcactcgtactgctgctatggctgtgtgtgtatgtgatgggaaaggctggttgccaagcagcggagaatggacataatcatgctgcctagcaacagcggcagcgtggtcacttgcgcagatttctgcgcctcttcctgtttggtctgctggaaaatacagatggcttctatgggtcgctctctgccctagccatagtgagaggtaggaaaacattatgaaccagggtggaaaaatacacaagtgcatgttttaaagtgattcgtttccaaactgcctagggctgagcagggattcttacatagcattcctcagtttcccctttgaagatattgtgcactggcacgttgacttgtaagcaggaagaggaatctttgaaaagtgctaggcccctctgggtgctgcctctactgagcccgagcctttactctgcatgtgtgaatataaagccaccagttttctgataaagacacacacatacactcacacacactcacaccatgggtgaaaacgacaagtggagcagagcgtgactactgattgttctttgaggccggaggaacaaagcagtcaggagcgataaaggcaggtgatccctgctggtttgccctttctcccagctctgaccgtcaccgtcacacatgacattcttgaatgaggtcacctgctcactacagattctaaaaggggcttgcttggcaaagacctccagggtcagagtgccggcctttactgtttttggcagttgtgtgcatggaacattggaagcgtttggaacggaatgcttaaggaagatattatttggcagcaagaaaaagggagtgtgcagactccccctacccctcctgggatgagtaggtactgcctgcccgttttttctctacaggagttgaatagtagccagagtacaggcttggcatcagaaggccttagttcaatccttatctcttctacctaccagcagtgtggctttatgcaagctcttgttcatctgaaccttaccgctcttgtctgtaagggatagcaatatcggttttacagagtgggctgaaaggttaaaagaggcgctagttctttttggcatgcagcaagtataaagtaattgttgctgttcacctcctctccatgattaaagagtaggaagttgggaaaagaaggtgagcactgcagctaccttgttgattccaaacttcagtgtcttggtttttgtcttccttcttagcctcctaaatgaagagcctttatttccttctgtttagattagaaaagatgagagatctctctccttttgatgctgggtgcctggatggtattaattgattttagtgatttcttaatccatacagaatcagttaggatggtttgctcccatcttatggatgatgagacagtagtacagagcagtgggatgatttgtttggaaccctggagaccattaattccaagatccaaatcctatggcctgtgctcattttggcagcacatatgctaaagttgcaatgatacagagaagattggtgtggcccctaggcaaggatgacatgcgaagtggtgaagtgttccttatttatttatttattaaaacagggtcttgctctgtcactcaggctggagtgcagtggcatgaccatggctctctgcagccttgacttcctgggcttaagcgatcctcccacctcagcctccctgttagctgggactataggcatgcaccaccatgcccagcaaattttttctattttttgtagagatgaggtcttactatgttgcctaggctagtctcaaattcctgggctcaagtgatcctcctaccttgcctctcaaaatgttgggattacagatataaggcactgtacccagctgtgttctatattaaaaaaaaaaagaaatcctatggcctgatggtatagacgaagcccctgccaaagccagaggggctggagtaggtagaaagccgccaaggagtctgagcgttctaggtattgacaagacttgaattttagacttcaaaattgtgacatcagtgaatgttccccaaacagatcgcagcctggctcctggaggtctggatgtgctaggtgggtcagtagggttggaagagggcccttgcatcttttttgctctgtttacatttgtatgtctgctagtatacagagtagctaagggatccaaatgggggaaggccttgggttctaaactggcctttcatccaagtcctgctaagagctcttgttcctcagtttccccggctagaatgatgaaaacattgacctatttctcagaacaaggtaggtcaggggtttggaattacttatctggactactgcataagtgctccactcagcagattgctcctggtgcaacacacatactgggaaacgatgtgatgacactagcacaaaggacagtttatagttattttctgtggttcctcgttttttggtgttttttttttgtgtttttttttttttttttagacgaaattttgctctgttgcccaggctggagtgcagtggcacgatctcagctcactgcaacctctgcctcccagggtcaaacaattctcatgcctcagcctcctgagtagctgggattacagatgcccaccaccatgcctggctgatttttttgtattttagtagagacggggtttcaccatgttgcccaggctggtctccaactcctgagctcaggcaatccgcctgtcttggcctcccaaagtgctaggattacaggcatgagccactgcagcggccggttccttgtgtcttaaagcaaacacaggcacagtattctgggcaaaccagatgttaatagcttgacctctctgtcaaaggaggacttggttgcttaagacccttaaagctgtcaaagttatagcttctccaggatactatcatcctcacccatttcttattctctttgcagggagagatcatctctcaaaaagctcccatcagagcaaccattctgggactttgagcagaatgcttaaggcagtggttctaaaattccacaccacctgttcttccagttgtgtcctctctgagctgcctctgacggtcacattccatggccatgtgccacagcagacttgtgatactgattttagtgttgtccttggccattgggggaagggaggaaggagagagaagagaaggggagagaagaagagaaatgggagtggggtccattcatccatctctcttgtcattaggggcccagcagttcccactatggtacctaggaaactagcttggacctggaggccatccagtgacctagtctgggccagtaaagccaccaggccattttcctgcttcggacatgctttctcagctgccctcccccttagctaaggctgaaatgactcatcttcccgtgccctagttccacggggtttcatctctgtgactcgggacagaggccttggttgccaccaaaggcagcttatggtgtagcttcaggtctggcctgactcagtggccttccctcagctattcactacagaggcagttaatgaagaagacacaagggtagcaggcctgagggataacttcaaggctaacgtgtcttttttccagtacttactcttcttttgaattttaagaattccagattttattctaagtcagagaatactgtgagaaaggattttattgtatccactctctccaaatggtgtgaacatctggatttgcatccttcccatgacagatatcacaaattgggttgggttttgcatgctgaggatgatttttggtattcagctaacacccttcctttaaggaagttagaacacttgataaattttaagcttttgatcctcagtagtacccctggaaaattaaggtccagtgaggtaaattgtcttgattaattatatgacatgcactgctttttggtggctcttttgttgtgttttgttttttctttctccttcattttgttaaaatgaattatgtgaatgtccaggttagcagtgttctattttcataggataagccccatctctagtactgtttatttccattgtgcctatttttcagggaactctgtgcatttccacatttccatcaccagctctaagaaggtacacctgcagtttgttgtgaccccgtttcagaacggacagaaccaagtgcaggcttactctatttggtagagactgagtcccagcaagtagaagtgtcttgccaaggggatgcaattatgaataggaaatggaactaaaaatagaacctaggtatgaccccagatatttgaccactctcaccaacatgatttctccttttggtctcagaccaggacattcaaggcatctctccattttcatatggagaagcatccaactatgtctcaatggttgattaggagaccatatccttcaggagtcatgttgaaacttgtcagggtagttcctaaggtcctgaggcctaggatagtactgtatcctggccccatgaaatctgtggtagatggtaagtgttcagtatgaatttatttatttggttaggtgttttttatcatggtgaatacagttcctttaatatcagcaaggacttagtgaacatgtgctctttgcctcacagaaaatagaaaatgagatattagaaggaaatagaacaaaaactatttgccttcaaggagctcacagtctagttctggagactggacataagcagtctctgctctctgcttggactggtgtcactgtgatcattctaaggtaacgagccaccttttattcttttacccagcccagttgtttcagatgaaaggatagagaagctggcgtctgctgtgatggagttgatgttttattttaagataaagtatagaagcaactgattgatggattataaactgggaggtccaggataaagcttcattctgagggcatcagtatatttcactgggagcctcctgggcattaattctgccgttaattttgttattagaaacctagccaaacaaagggaggtggcgaagcttgaggctggtttaaccttgatgaaacagtgatttcaccaaggatgatgttgccccatccatcttcatccatcaaggcactgctgaaatatgctaatgaagcccaaagataggagcacagagcagttaaatggggcgttgcagacgctctccctacccccgtgacagggtgatgccatttactctccagatttagtataggaaagagagcaatgctgacgtggtgtcgtggtggaagatagaatggaggctccacctaataaaaagaaagggcaaagttcagggtatatattctagaagaagatgggaaaacttggtttttggtgaaggggttggttttcttaattctctttggctcactttctagccagtccacacaagaaccagatatgtggcatactgcagatagggcaacatttttaagttccagaatgtgacctcccaccatgtgccaaagcaagttatttgttaccatgtcagtctgcagcactgtttgtttccaatggtacatgagctaataccttggctttatttatttatttatttaagttacaaccttttggatacttatgacatgctgggcatactactgaattattttatatgaattaatctaatcagattcttacaaatagccaacgaagaagcaaagttatcacatatattttatagatgaagtttgagaggctaaattcatgtccaaaattatgtaaccagtaagtggcatggttggggtttaaactcatgtctacctgactccaaagcccttgtacaaaatcactgtggtctgaagactcttatgtaggttatagctgagaatccctgataaccattgggagcagcttgactcacatatttattgcttgtatattctttgggttcagtttaactttaactttggcattcccttcacaattctttcttttgtaaatagactataagctctctgaggtcagcagccaagccctttctctaatctcctaaatgtcgatgatgtccctagtttctatgtggagtgtttacttttggcatcatgcttctaatatagggttaaaaaaggctggccagctgctttctggttttcatttcatacattagatgaaagccgtgggggattttacttgtctttacaagttaattctacaggattcacagttaaatttctgtttctttgaatttattggtggatccacttttgtttcctactagtacattacctatctagtctatatccaactgtacagaaaaaagtaaaccgcaaatgaaattttattattatgtattaaacagcatctttggagcagtctatattaggaggtgtgtgtcaaattctgctcatcttaggaccctagacagttcctctaagagagcctgccacccttcgcttacaaaatgcagaccctgagctaagaggtggtcttgggcaaatcaggcaaaacaattcctaaatctaaaacgtttatcagcttttgtttttttttttcctaaatggagataaagttggaagttaaaagcaaaaaagaaggatggattaaaaaatatttaaataagatgccaagtaacatgaattgcctgaaatagactgtttcaggataaaaactgtatcttggccttaatgtgtcttgtgccatttattaaatcagttctgaactttggggactccagactgttattaaagagttaataaccaaaggcttcaacgtccaggatgttgtgtgggtcagtgtatcttgccaagaggtaacatcagccagtggaatcagttgggctctccgtctggcagatctgtctctttcagctgctcctcctccagtttctagtcttggagttcatatacagtaaatctttctcttaataaagccgtttttcaaatctgactttggactagggactgctttttctccaaatgcaacagctgttaaacatggtgcattgggcacggtgtatatctctttgtttagttttgggtttttaatatgagcagagacataaaggagtgggaggactctatcgatttctttctacccatgagtcatccactgggtttggaaataaggcctccagcctcaaaaggcttctgggctccctgggcttctcacccttaaggatgaagcctattgtgccctaataaccagtacaggattcccccccttcttttggtgagatagaattgtagagctcaaggtgtccgccagcagaggccagaccttttggcccctatctgtcccatttacatggggaaaagcatttttgcccccttgctctctggtccttctgtcactgtctctgttcccaatgcactagggagcattaactccctgaaggggaaaaaagttcacaaaagaaatgaattatgcatatggaattcatttccttgatgaatagggaatctgaacaaactccatggctgtttgattttaaggcagaggagaaggggggcttagggctaaagagtatagtggggggtgatcaaaaagaacttggaacaagagaggtgggagaaaaaccatggcaggaggacttgggatggaaatattgaggacaaagtaaggggacctttgaaaatagttgagggcccattattcttgccaacacgtacacacagatatatacctcactcccgattaatgtgcaaatttgtccccagggaaattggaaatggtaatgagattatactgggcagaaatgacaacactaaggtgatgtgaccgtcctgaattaaagtttttcagtgattttttaactttcttcagtccaggttaacaatgggcgctttgaattttgaggcaggagttgtgtgataggtaaagaactgcattgagaagtggaagacttggatccaagcctcagaagacacagactgtgtgactgtgggcaagtcacctcatctttctgtctcagttatctcatctataagtggggattatggcaactgccctggggaaaaaattataagggccaaacaaaagtgcttttatgcataacacaagatgcgaatctgaagggattttatttttctctctgtgcctccttttcttgatggcattttggttattcagacctagtcttttcagcaagtcagaatttctttggagcagaagaatgaaggggaaattgattcaggagcagcatgctggttaaaggaacaaagaaacaagtgaaaaatcccattttaatcctcaccgcatctatgttatgaaaaccatttaaaataatcaatctgatgtttttggcaaatttaggtactgaatcagtagtggttactgcataactagtttgatcaacagtaggaaagcttgtcattgacagccacatacattatggaatcaactagagggtggtttttagagcttcccttgtaggctgactacctagaagaggcaacctctgacctggctgccaaagacctgtggatgcttctgatggggagatatggccaaaccgaccccttacttctaattgtgctccattattccttgtttctgaatgcaaaaaagacttggggacaccaagtcttcaggagagataataggtagaaagtcacacatacctgtgtacatttgttaggatatgtccctgctcgttgagaggagagagtttttttgatagttatggggtcttaaatccatttcaggattgagtagattgagcaggtccaactaccgccatgtctctttatttttctcaccacccaatttcagtacatgcagtttttcacagaggtgtgtttgctttacagcaaatcctttttaggggtcaggatgtgtagtggaatgccattgtatcctttaggactgcccaccgcaaacacatgctgtgcactcatacctttagtgtggtggcattcagtctggtctgcagggcatggccctcggaagagtgtggagatgtcccaggacagccttcctggtagtaaggggggcagccctacaggctcgggggtcccaccccaacttcaacccctgcacctttgtttcatggattttatttgcttgggtttgtgggaaagagtctgcttttaagtaacctttgaaacccagtggtgcagagaatagaccaatgcctagtatgaattatttatttgtttattaagattttcatggcaccttccctttcaaagctcaaggcactgaatgaactcttcaaactgatagcagttagcactaaaggttgaacaggggccgttggaggaggaaccactagggaggatgagaaaagagggaggaagagcagagagaagagcacggcagtccggaccccagagccaccactacagccaaaggaggaaaatcgtaaagactgcaggcttcccaggaaggaatccagccctgctgggaagttgttttgttatcagggaaagtcacttccttctgtcagcctcctccatgaaatcgaggtgacctagttgaccccctgggcccctcccaggtatgatcttttaagaagcctgaggagctttcctttttaggtgagcaggcctaacccttctgccaagttgttacggcaataaaaatcatcataaaattttttttaatgttatgcataaacctttcaataacaagtatatttggtacagagtggttttcaaccctggctgaacattaaaatcacctggggaacttttaaaaaatattactggtgcctgggatctaccctggaatgatgaaatcagaacatctgggggctggtgctgagcatctgtattttctcaaagcaccccagctttttttttttttttttgagacagagtcttgctcagtcgcccaggctggagtgcggtggcgcgatctcggctcactgcaaactccgcctcccgggttcatgccattctcctgcctcagcctcccgagtagctgggactacgggcgcccaccactacgcccggctaatttttttgtatttttagtagagacggggtttcaccgtattagccaggaaggtctcgatctcctgacctcgtgatctgcccatctcggtctcccaaagtgctgggattgcaggcgtgagccaccgtgcccagcccaccccagcttttgtgttatgcactggggttgtgaaatacccggggacctgggaaggctgacaataggaggtgagcttgagtgtgcccaaagaaaggcaaagaaaggcttattattaggggtgtgatttaagtgtttccaattaacagtggaggaaggaaacttaaaactgtactttgaagttaccaagctctaggttattcttatagtaagtgtagcccatttggcttgtgtaacttatttttcacatacttcaaggccaggaaacttcagaagtgtcacagcaagttctttggccacctcctcactagctggctcccactgaaagtgttagccacatgccagctaccgttgtagggaaatcacacttaggatattttacttgcacgcagcagagaggttgctgttatcctccccattttacagagaaggacatggaggcccagagaggctacataattttctctgggtcccaaaacctgtaaatagtagagaaggggatcaaacttgtttatcttactctaagctaccccactctttctactatacctaatgcctcttagaatgaccctggacttgttgatttgtcagctgcttgcccttggcgggagggcgtttggctttctttttcagataggagagaaaacatgagaggagaaatcagcttctgcagagattaccttagagattgagcaaggcagtgtaatgtaatgaaaacatgcaccagagcaggggcctctagccccaggggcaggcttgcaattagaactgggctaaaagaaagaaaattgtgggagggtccaaatgagtaatatgggaaacatgctttttgtttaactgtgatacctttggtatcacagttttgtgattgatgtgacttaggctgtttgcctctttcattccaagatgacacacctctgtggggttactttgtgttcattctggacctggatcattttcagggggtccatgctagaatgtactgcaatgtgggaacattggcctacagatctagttaggtcctctcccaccgccatgcgcttagtcacttcacctgctgccttccaaaacaaatgggctgtgtgtgtctccttcccttaacaaagtattctataatcatattttctagcttaaaacaaaattagtcttttagatgtaaaacacatctaaagcacttttattaatggatcgctttccttcagggattacagtgcttagtatgaggtgctgactcatctattttcatgccatatagggaaggaaagtgttaactattttcgaatgtagagaatacttttgttgggagtctctaaaccttaaacccaggacctgtttgacaaaactgtcatcctcccaaccccttgaaaagataatgccctaaatctatcagttttttccccccagtatgcgaaagtggctgttttctggtgttagttgttcctatgtgtggcttggagccatggccacttggcttcctagattgtgtcccatgaattcaagcataaggagctcccagtctgctgcacctggcctcccttgtccttcacatccctgcagcatactgtagcaaactttcaagttagctttttattgcattccaccccctgccagggagcaaacttaaactcatgcaactcaaaatgaccatgctgggtctgttctaagtttgaatttggaccttgatccagccttcacatactttctcttatgaattcctcttaatgctagttaataaaaatataatggctttcatgtcccttctcataataacattgccagctttgggggttctttgaaaactttgcttgagaagtccatggccaaaaaaaaacaaagatatttggctttaaaatatggtctttgcttaccaaactcctctctctgaggaagggagagaaagagttgaaggtttctgggaaaggggcatagaagcaactcttaactctggccatgtggatctgcagacaaaattagggcaaatgtagtgctacagatcccatccccgggcctcacattgtggccagccatatggagtcagatttggagactttttggagatggggaagccactggactcttaggcatctggtgtaaagagagactttttctttgctactttttttttttttttttgagatggagtcttgctcttttgcccaggctgcagggcactggcgtgatcttggcttactgcagcctccgcctcccaggttcaatagattctcctgcctcagcctcctgagtagctgggattacaggcacctgctaccatgcctgactagtttttgtatttttagtagagacagggtttgaccatattggccaggttggtcttggactcctgacaagtgatccgcccgcctcagactcccgaagtgctagggttacaggtgtgaaccaccatgcctaactatcgttgctactttctattggaagagaaggcagccctgatttagtctgtttacagtctgcattatgtggagaatagagagccatcatagtccctaaaactttccttgccagttaacccagcaggacaacctgtctttgtctcttgacaactgttaactgagaacagggcccttgctcctctaggtgtgcacattaaggactttgcacagtgtggatgtagctcatgctgctctgccgtctagtacatgctgcttgaattttcatcatcatcctccactccttccacctccaagaaaaaaaaaagcgtgcaggaagtagcatttcagatccttctccaccacctctgcttcccttctcccttcttttcctccttgcagcattccctttagtaccagggagggatggtggttgaaaatggggggaatgatgttgctcagaaaaaaaaaaaatcagcctagaccttaagaggtgaggggaaaggaaagaacacttcaagcatagcccagcccaggcatgtcagctcccaccccagcctccttgtacctcccatctctgaaggagggtgatgaattcggtttccaccaacattaaactgataaatgaaatttgtatgttaaaacaatgataatttaattgtattttatttccttctttcccatccacacttggatctcacccccctccccattacccacccttcagctttggggagggggtggtggaggctgtgcaggggagggggtggtggaggctgtgcagaggcgggggcattgcaagctgtcggtttgcattgtgcggacggggaaaggtctctacctggctcattttgtcccctttgcttaggctgtcactgctgacagtcctcatgtttatttcatctcgcgtggtggctgtctcgtttccctaccctccgatgtcattaacgcacagagagcgggccctgcagtgttgagcctaatgaattccgctgtggctgctctgctccccacctcgttaccaaagctcaaggtgtcaaattaaacccagcctagagagaaagagaaagtgcaggagagaagcaagagcaggggaagagggaggtgcagagaacacataaacaaccctccaaaaagaagaacagttgaaggtggggggagaagaaaggaggggaatgagacagagaggagcccacaaatgggtgactttcctcctgcgaccaaatccactttaagcatggtgacatccatgactcacagcaggacctaatgacctattcttccccgggtggggtttgtaccttggccttggctgcggtttgttgctttttcctcgttgtctggttgatttattttcatggtttatgcagattgggcacctcgcaaagcagacagagcaagtaagaggagtcagagcttatggagggagggtgtgtgtgtgtgtgtgtgtgtgtgtgtgtgtgtgtgtgtaaggaaaagtagaagccaaatgtgagctcttggtttggtggctctgatcagctgtggaaatctatgtttcaaaatggtagaaagaggaaatcatcacttttttttttttggagagggagtctctgtcaccaggctggagtgcagtggcacaatctcagctcactgcaatctccgtctcccaggttcaagccagtcttctgcctcagcctcccaagtagctgagattacaagcatgtaccaccacacccagctaatttttgtatttttagtagagacgggatttcaccatgttggccaggacggtctctatctcctgacctcgtataaatttaaataacccctgtgggggtactctagcagattttcctcccctcactccaccccaatttggaaaatagtgattcatttcatctcttttctatataaccttgtgtcatttacaaagcattttcctttatattattggcattttatatttggggcattttgttggagatgaccattaatagattcttcccattctacagatgggaaaaatgagggatagagatgttaacttacttgctcaaggtaatagaactagaaggtgagagaagagggttacatttcagatcctccctttccagaattcagtgtttttcccttataccactaaacttcctagatttttgtcaagaggtgggaggaagttaaaagataaataagcttgtgaattttaaaacttgaaaatttatatacagcaaaatagttagacctaaaatatacagtttgaagtgttttgacaagtaaatatactcatgtaaccaacacccctttatcaccctggaaagtttctttcagccccttttacttctcttaccacccgcacccccaccgccatagtttatttttgcctgtttaaacttttttttttttttcggacagagtctcactctgtcgctcaggctggagggcagtggtgcgaccttggcttgcttcaatctctacctcccgggttcaagtagttctgcctcagcctcctgagtagctgagattacaggtgtgcgccaccacacccggctaatttttgcattttttgtagagatggagttttgccatgttggccagggtggtcttgaactcctgacctcaagtgatctgcccgcctcagcctcccaaagtgctggcattagaggcgtgacccaccacacccagccttgtttaaactttgttagtagaattacacaacatgtgtacttttgtacccggcttttacttatcacactgtttcttgagatttatctgtgttattgcttgcatcagtacttcacccctccttattatcgagtggtattctattatgtgaatacaccacaatttttttatccagtctcacttgttttttttttttaaatctttttacaataatttagtatgtaagatacaatttttttataagcgttttagagcacatgggtgatggcctggctccctgaattcagtggcagggccgtggtgctgggcaagagggatgagtgaggggctgagcatggtgccttacacatgtaatactagcacttttggaggctggggtgggtggatcacttgaggtcaggagttcgagaccagcctggccaacgtggtgaaaccccgtctactaaaaaacaaaaattagccaggcgtggtggtaggcacctataatcccagctacttgggagactaaggcaggagcatcgcttgaaccggggaagcggaggttgcggtgagccaagatggtgccactgcactccagcctgggtaacagagtgaggagtgagctgaggcacagggcagacaaaagcctgtcatggccgcacctctcaaacctgggcccacaaacccatactttaaatggcttggaacttacttgtttctttgcttggggctcattgtctgcttcattgtccttggctatttataacaataggtgtgacaatagaacagcctgttccttctttggagttttctgtgttagttatttgattttaaaattctgctcctttttcccaagattaaaatggaattttgtttctgataaatttttaccattcttttccaaacagtagagtcaactcaaggatatcacaaatcgggactagaaattgctggcagatattccgtaaacacagtgcattgggggtagggtgtctagctctaatatttgcattttgtagatggggacaatatgaaaaactttgtcactccactaagatttttggcacttagaatggcaagaaaatccaggttcccttacttataatgtagtgcttttaccttgaaccaaaaaggtaggatgtgcgtgtgtatttccagggtctctatgatttgccatttgtattaacagaaaagaggcccagtctttggaactctggttagaggtgacatcatggcaaaacatcaggcctcaggtttcattgattttaaacttactatgtcgtgtgattatctcatcgctgatggcctttgtcattaaatccactgcttcagctgggttgaacacatttgaggaggaacaggatcaagaaggtttttgaaagatatggacaagtgatgtgagaaatactggaatttaaattctttccttctttttaaaactatccctggtgatatctgtactttctaaagagtcaaaatgggaagagaatggtctgagagtggagatttggtggcatcacatcagtagttctactttcttctccattcccacacacataaacttcatgaaaataaactcagttatgtagcatttaaggcctattcagaaaggattcagttgtagtcagtcaatggaagaaccaagatagttaaccaagtcttaagcatttctctattcattcagcagcatttatcgaactgggtataagaaatagataaagccagcctctgccatcaggagcttgtgattggggagtaatgtgtgatgtgatctgtattatcacagaggggagcacagcatgtgatgggaatggaagatgggctcctagcgtggccttcttgggtcaaggatggcacgctggattggataactcaggggaagaactgattttatggaaattatccaaaggagttattcattaatttagcatctctcttccccagtctctgatgtgtgttttttttttttttttatttttatttttttaagacggaatttcacttttgttgcccaggctggagtgcaatggtgcgatctcagctcactgcaacctccacctcctgggttcaagtgattctcctgcctcagcctcccaagtagctgggattacaggcatgcgccaccacgcctgtctaatgttgtacttttagtagagacggggtttctccatggtggtcagactggtctggaactctcgacctcaggtgatttgcccacctcagcctcccaaagtgctgggattataggagtgagccactgtgcccggcctctgaagtcttttttaaactgcctgtcttctacagagcaccatgctatgggagtgtggtctggctttgggagtagaaaagtccaatgttgagtacaacattgagatacatggctgttgggaccactcttaatcttccaaggatgaccaccatttcttgtagtggtttactgagacagtcaagacagtgtgaatatttctggtaatgttcagtgaaattttttcttgtgattgacttactgtttgtgtttgctgatctggaacttcagttgacctccttgactgcaatcatttgttttggttttgtgtgtgtgtttgcactgggctttagatttgtaaaacattgtatatagttaatgtgatgtagcctccctaaatctcagtgaataggattttacatggcatcaatatgcagtgaaactactatgattgtcatagtctaacatggtgtaaggacctgatgaagattttgtatgacaaatgaggctatggctgcctttgggattagtagatatatggaacaggaacaagaacaagaaggcatgtaggataggtattcaccataacatgaatagatggagattatatagacagttagccttcaattgcaggtggagaatggaattaatatggaacatttaaaaatattttagaaatgatatttttaaaagagagtcaaaataaaatgctttcatctgattatttgaccagaaattgggctgcttaatataatgaataattgttaggatctatcgatatggctactcagtggtaagaagtgccacataaatattggtctaatacatatataattatgtaactctagccaggtagctggattaaatatgggtaacagcaaaagcacttctgtcctgataaaagtctcagttacatttaaatacttaatataatcagctctttttcaagtaaacaataattcaggaggcaaatgttcagtacatctcatagaaattttttgtcttaatttgtttgcctgtacaatctgcattcttcttattaatttaatccatattttgaagtcagaaaagaattcatctcatttgagttagtttagatcaacatactgatattgctgaatagtttcacttccctgaaactaaacatatctattcctttcgtcttagacaaattatgaggggaaacctgtctgaaatttggctaacacatggtgtgcatttgatgccactggaggatttgctttgtcaatttaagattgagtgatggctatagaggaaagtgacggaaaaaaaaaaccttcttaatgtgaaatagaaagtataaaggacaataaaatgctaaaatgtacaggaaattcttgtaatatgactaataatgtatgagacttgtagagatcagttctgctacaggtattcttatgttatataaatgatattataatatcctattacatatattatattatcatactataccaagaatagataatatttttcatcaactggtgattcaagtgtgagtttatacatgggttgactgtggattgtatatatgataccaagcctgtgtaaaataaaacaaaaacccccttcaaactcccatatggagtatttgactaaagcaataatattaagataacatactctattccaaataaggatataatttgctgtttgataaagcaaaacaaaacaatggagtgtattggtactgttttccacagagtgggaagataagaacacatgtagagatgataaaatgtcattggctccaagagacaagcttccgaaatccatggtggttgaagaacatcaaagaggagcaattatttcagtcattagggcagttccacctgttctaattgaacatttttaggatgtagaagatgcatcatacattggtatctattcagaaggtggggacatctgctgtctgtcatgtatctgggagatgtttatctcaacaggaggcaataataatatggtaaaccaaacctaatattatcatgatgcattaaaactgggttaattgaagcaataaaatcaaagtaacagtaaatgcttatacaacatgttaagtaatatttacttcaatcttagaaatgaaatgataattttacattctagcagatgtatttcttgatacctgttctgagaggacagaaacaaggctcaaaattcatgcaagaggctaataacaacttagttgatagtaaaatatggagcattggatgtagagtgcattaaccttcttgtttaatctgagttgacctataagtgggcatattgttttttggggaatcgggagttttctcaagtagaaagaagccccacttttcctttgatagggtaccagtcaaggaaataaatgctcttttttctacctgagttagatttgcctttcatttgctcaccctgatctgtgtggctttattgaccactacagtttaagcccatgcaacctgcatgctgtgcaagaaagaaaggtgatggacagatagtcccagagttaaacttctggtgcctttgccactccatgtcttgccatcttatcatcatagtagctttgggtatggcctcctagcagcttcattgttatgcctgtgggcattcgtgtcccactgtcaggcagattctgggggactggggagccagaatgatgggtagcaggcaggtggtagatggggagacctaaagtccaaaagctagaccccttctctcttaactcataatggcattcagaagttgtaattatttcacaaataataaatgaggtacaaaaaaaaaaaaaaagaaagactggaatttaaaataaaagccaaatcaaccttacagcccatgcgaattctgcagccactgtttagctcaattgtaaaagtgaccctataccccaacaccagtaaagcaagtgctgccatttccaaaggttctcatcagcctgttgtggagctcaactgattgaaaactgctttttatctgctgtggtcgtagggatttctggcaatttcagttcttgcctttccaagaatgaccaaaataagtacagataattactagagataaaatattagagatctattaatacagataatggctgtgacatttcctcagcatcaaaagctgtggcactacagctttttctctggattgcagcttgatatccccgagtgtgtttgacactatataagtgtatacacagcatggtgtcacatggttcttagagtcaaaactgtttggcattccagcctgctacatatctacatatgaggttggtctttatgaccttggatgggctatttcacctctccaaccctcagattattaatctgtaaaattgggattttaatagttaccttataataataacagccaatatttattgagcatgtgcatgccagatactgttattaccactttacatatgttatctgttaccctgtgcactacaaccttttgaggtagaggctcttattatccccattttatagctgaggaaagaaaagacagagaggttgagtaacttgccctggtggatacagttattaaatgacagagccaggatttgatctcagactccatgatttccagtcgttgtccattcccattgtctcactaagactcaggaggaccagtggcaatcccacatattaacctcatagcacagtgtctgatgggtaggaggcactaagaaagggctgattcattcatcatctctttttccctacaatgaacaatgtcacatggacacagagagggaatatttctttccctgaattgttgggaattaggttcgttgttttaagctctagaaatcacatcctgagaatgtgcccagatttgcagatatacatcgattcacatctcagctggagagggtgaaataccatttggaattctgcatccagatcttctgagggaaaagggggtaaatcaaaggcatccacagatcttttcctttttagttacagacctggaaaaggcatttttctgccacttcctcattgggaatgtaactctcctccctctatattaacaaagctgtagcatatgtttcccttgtgttcttaaatcaccttacatagcaccaaacatgtgctgtacatccaaaaaatggttgttgaatcaagtggagttctttgagtgagcaagggaaagttgggatttgtaccgaggaagcagcaggtgagtttgggaaggacatctttttgctatgtgagtggacacctccattggcttgggtggctgcagaacctgcctcccccttcacacatcctcccttgttccctctccctggcagcttaagcaagagcactaagcttggccagttggaacgccagccatgcccagtcttgtgttttgagggagctaagcagagagacaggattactacagatgcctcagaggtagcagcagaatcgagggtggtggcagtggtggggataagtccccaaagccagcagtaccagagtctgtctcctaacaggcttcctctggcagcaccttggttgtattctcagctgtctgtgcttatttttctgagcttgattctccaggtttcctgttgactctgagaggcactgcctatctgtccaataaattcctttcctgggtaggtgagccagagtccacttctgtagtttgcaaccaaaaaccttgacaggtagaagttagggaaaaatcacatgctgtttctaaaactactcaccaaaggaaaatgaggaggggttgggggcaatattctacagggtagatgatgataaggacaaggttttctgagtgagccaagtatttctggtagaaaacaaggtttaagcaaactggagaaggattgcacctggctttgaaatataagggaatgttgtctaaacctgaaatacgggtttgggctttgaatggagccctttggggaccttgcctatgtgggacatgctggggcctggagctttggggaacttacactgggtttgaaaagcacctgccagggagctgaggcgtctcagctgcagctgacatggcagtgctgagacccaaaacacctgtgtggtaagactggcgaaagatcaaggacactttacagacctcctcttgggataaagtgtaggacctgtgccattgcataaattccttttatgttaacttgctccttgtcaccctatcagctagattaaaaccacagtcagttgtagtaacatcagcagagggagaaggaagtggttttgtctagaggtcacacttagtggttatactgacgcctgctgccattgcttgcttttcttggttgacagaacagagcagcttttatgtacatcatccttgactacagctcttcagtgcctttgctagtcattgaggttagaaaaccaaacataggatgattttttttaaagtatattatttcttcttcattttaacaataatatagattgtggtctgtgcctacaaataacatatcagttgttcagactactaattctctttctaggattcatatcctctcccctcacaaattctgctcagcactaagttacctaccttactggtggagccaagcaccttgatgtatacctgtactattctggtacaggaggaaacccagagaattgccagctgatcacagctgaagccaacagctgatcacatctgaaggcaagcatactgcttgttggtgtgcctgttcaccttatttaagtaaacacagactggaagcagctgagaggagaagacttttactatgtttttctctgtctaccaactcttctttatttgactgtgaattcttcagagattgaacccttgcatttcttatcctttagttcttcagcatctatagtaatggtggggaaggaatactgatgttttgaacacctgtgaatgaatccagccgagggcctctctcccatgggtgtgtctgaaggacatgccatctggcatgagggataacattaccaatggttcatgtcaaagaagcctctacatcctcagggaaagccctgatattgtggtctagggatcaccagcaatttcactgtaagccagttttttttttttttttttttgagatggagtctgactctgtcgcccaggctggagtgcaatggtatgatcttggctcactgcaacctccacctcccgggttcaaacaattctcctgcctcagcctcccgagtagctgggattacaggcctccaccaccatgcctggcaaatttttgtatttttagtagagacggggtttcaccatgttggccaggctgatctcgaaaccctgacctcaggtgatccacccaccttggcttcccaaagtgctgggattacaggcgtgagccactgtgcccagccataagccagtttcttatattgacctttgtaattttatttttggtattagttaatgtgtacataggcgttatcacctcattggaagttaaaagaaaagtagtgctagctttttaattttttaaaaatttatttcatgttttcaagcagggataggttgtagagtaaaaacaggaaaaaaaggactaaagacctaaaaatacactttcatggagggcatcaattgcctaaatgttttcttcttgagtactttccaaatcctaacaaatcaattcttcccagacttgaagagccctcctttaaatacctctttagaccagatgcaggtgcagtggctcaagtctgtaatcccaacactttgggaggcctaggtgggcaggtcacctgaggtcaggggtttgagaccagcctggccaacatggcaaatccctgtctctactaaaaatacaaaaattagccgggtgtggtggtgcacacctgtaaccccagttactcgggaggctgaggcaggagaattgccagaatctggggagtggaggttgcagtgggccaagatctcgccactgcacttcagcctgggcaacagatcaagactctgtctcaaacaaacaaacaaaaacttctttagtctgtttttggaaatttccatctgaccagactctgggccttctaggagacagggtgtaggcagagttaataggatttttgcagaataccttgaagctgtgggaagccccagtgcatcctttgcattgcaaccagtaccaagccgactatgcatttcctcagtcagttgtgatggtctgatgtcaattcctgttggttcagggtccgaggagccttcttcagcttgttccagataagcctgaagcctccctgaatctgtgatcccctgtaggattcaggagtgtgagctttgagcattctgtggatcaaggcctcttgcacagcctggtggcagtgagatgcctttgttcatgctcaagcacttgtctttcccgtaattgcctagagtttggtagcttcgttgttacagtcaccgtcaccttgtactgtgaaggtttatcattctatgtcattatgtgcatgcatgtgaacatgtgtgaacatttattttttttcttgtagtgatggttaatatgcagaactttgatcagatattgtttttcttactcctgaactagaactaccttcttcatttattattttattattgtgagggttattataaagaactacaactctaaaatacaaatgttttgatgatatcatagaaatacattggtgctaacatcagcacaactagtgaaaatatgtcttgcccagctgtgtaactttcaaatagtttcccagaagccatagccttaagcatgtcagtcaaaggaatgacttaagcaaatggaagcgtgcctacctttctgcctgccttcttgcctgcctgccttccttcctgccttccttcctgtcttccttcctgccttccttcctgccttcctgccttcctgccttccttccttcctgccttcctgcctgcctgcctgcctgcctgcctgcctgccttcctacctgcctgccttcctgccttcctctctctctctctctcttcttccctttcctccttccttttttccttccatcctttatttagagatttggtcagagtagaaagtatcttagtaggattgcttctccctatggtacaacatgatgtagtgtgataatacattactgttcatgatacgtagaacctgttcaacattacgtgctttgggctctggcccatagcttgcctgatctgggacctgaacgtaaagatacttatcatcgacatgctgtgtgttctttaaaagtaaagctatatcaaagatacttatatttaatgagatgattgcacctgtctgtcattgcaattaaaacatttatgagatcatcaaacacctttttgagtgctcctcaatgtattgctcttggtatgatatcctatccatcatagtcctatgcaaataattatattagcaaagtatgttgaagtgtgttggcgccttaaataaaatatcaattgccaggtacgttaggggtgaaccccaggccaactttcatagtagagctatgactaatcagatggtgtttaagttaataactcttcccagaagccaagtattaaagaaagtgaaagatggtggtcctttgtgtgggaatccaagcacctgctgaatggtgcctgattattttgtcagggggtttcaaacagtctccccatttgtgacaggtaaatcctgaaagagcaaaaaggctggattgtcagtcagagactgagcagccactttgcatttggtgagtttgttgaattacctaatattaatctacataaccaagggaagtgtctgtctgttcaagagaaggacatagatgtctcaactgaaacaggttaactgaggtcatggagttgagaaagtctgctttttcctcatcttcatataatgaagtctttccttctcattatgatctgacattaaccagcaggcggaccatgtctaggtgtcttgaccttttgaggttatgtggcttcctctgtaagatgagggagttttttagttggtgtccctctagtcatatgtctgtgctgcctttgacaactggtgttggccgtaccaaaactgtcaccacaattgggaagctgtgggaagccccggtacatcctttgtgttgccgccagtaccaagccaactctggattcccacagtcaggtgtgaccaaaccaaaactgaccataccaaaactagtcacaatatcaactggcacaatgtattagagtttttggcttgagttgaactcctatcatatgagacaagtcctggcatcattctgcattattctggtcgtgatggtatgtattagtctgttttcacactgctgataaagacatacccaagaccggacaaattccaaaggaaagaggcttaatgacttacagttccacatggctggggaggcctcacaatcatggcggaaggcaaggaggagcaagtcatatcttatgtggatggcagcaggcaaaaaaagagattgggcaggggaactccccgttgtaatactgtcagatctcgtgagacttatttgctatcaagagaacaacgtgggaaagacctgccccatgattcaattacctcccactgagtccctcccacaatacatgggaattcaagatgagatttggatggggacacagccaaaccatatcatagtacaagcttggaatctgtgttgcagggtcttagaaaagagaccattttgtaaaagagggaaaaggaggactgtgaaccttcttcagtggagtttgaattctgtaataaattctgtgaatagtttagctacaatattcctgtctaaatgggaaagactagatgatctcttgtacattggcaacatagctgtatcggtcagaaattttagttgtgctaaaaataattcagtctggctacttaacataaaataaaaaagtattaaacattttaagaaacttatttaaaaatttattaaaattttcagattttattttattttattgatttactttttgagtcagagtctcattctgtcatccaggctggagtgcagtgttgcgatctcagctcactgtaacctctacctcccaggtttaagtgatcctcccacctcagaccccagagtagctggaattacaggcatgcgccactatgcctggctaatttttttgtatttttaatagagacagcgtttcaccatgttggccaggctggtctcaaactcctgacctcgagtgatccacccgccttggccttccaaagtgctgggattacaggtgtgagccactgaacccagcctaatttttcagattaaaaaaacaaagggacactggttagttcatagaatgtctggagggcctggcagcctgtgtttgtagcacccagctaccctatggggctgtctccactggaaacacctctacctctgcttctagcagccaggacactcaggacctaacatcaggaatgtggccgcttccacccctaaacaactacatagcttgtcatcgtggatggcaaaagattgagtcccctaaattaaactgctgctttttagaatccaagtgctggtgaggcttcatcagattcatgggacccattttatctgcttgtacctagttgcaagggagtctagggttttaagttttctggcttggccttgagaagatgggacttgtaaagtagggaattatcaaaattgtcgtgccttaaagatattaggcagccataaaattttcggtatgggattctcagtgttgggcaactccaggagggaatggtatgcacgacaagatggagttgaagagatacgggatgtgactcctgggtaccgttcactattcccacgaatccctcacctcccagaggatgtccccatttgcaatactcttggggtgactgtctaacatagtggtctctcctgggggtttctcaactgccacttggcgtctcagcccttcttccccaaagcctcaaaagctagatggaaaggaaagaggctctgttcatatctgcattcagtggacatattacaaatgctaacaaaaggcttaagtccattattattattattcttatttgttgtttttgtatataaatatgcctaaggtttcaaagatccagtgatgtatttagctaatgcttatgttgttataatgtactagggtgttcattctcagattggtctgagtaagaaaaatgaaataatgatagctgctctaagaagcctgataacagattctggctgatggagcaaatattctgctgcttgataaactcatagaactgtggggcctctgttattgctattttagtaatggaaatgtccctatactagtttccaagaatatcagtaaataacacctatgggcctaggagaggtgctgaagcaaatgtggaggatgagggacgggaaggagaggattcctgggagttactgaatttttaaattggaaagggttttagagactaagccatttgcctaaaggaaaaaaagtagtaaaaataaataataatttactacttgctaccttctactgagtcctaattatgtgctgaggtttttattagatcgtctcattgaatcttcacagaaccctttaaggcaggcaatgattctccgtttctcagatacctagactgaggcttagagatgttatggaaccctctttgtcacagagtgtgttctgtatagagctgagatttgaacccgaatttgctgtgaagcaccaagatacaccctaagaatagagcctgacatcgtgtctgtcttaggatggttctgcccattctagttaattgctttgaaaacttcattgctcaccctacccagactgacactgcttctgaaggttttttcaggccaactgctccatcttcatgaaccttggccttgtgaccttccctttttcttactgatttcatctaatcttgcactgggcgtgtatttagttcctgtctttgcatggcaatgagctaagtaaaaaacaatgcaaggacctttttagctaagggacttgccttgtagaagtttataatcagaaatatatatacacacaaatatataatataatctatataatataatgtatataacatgtattttatataacatatgtataatatgtgtgtgtgtgtgtgtgtgtatatatgtatagctctgtctatatatatacaggcagagcaataacttcgaccctggcagaactacagagaagcagtggacatttgggtcaagaccagaagccttagattatagtccctgggtagctgcttcagcttcaagacatcacatggacccctgtcataatttaaatagtttcacagtagatcattggcattcaaagatttaatattcttggtttcacctattaagaaatggccacaaatctacaggatgtaatcagctgtaattttgccgagacaacgcatttcaaatacttgtgcaggagtgagccgtttagctagtgagagagcccagccagctaccagcagccccatcttgatgagtgagactctcagatgtggggattcccagaggtctcaggacaacaaggctcgaggtagatgcagttcacacttcctgtattgttgtttcctagcctttcctagtctcaggtgttgcaggcagtgagctacgggaggtcagcaggctgtcctggctgtacacaaatggctgcccccttctcccacttctccctccagagtgggtggagtgctatttgcagatctctccctgattgatagggcttgtctttagaaatggagtgattgatgtccatttctacatgcctttcctaggtgaattcctcctttacgtttggtcaggaactatgtcataccaccctcctgtcatctgttcccaacagtcaggccttggctacatggtcctgaacttgtcttttcagcactctgtggaatgagcataaagtcacacccaagcgaccggtctttcctaggaagacctttgtttacctaagcaatttgtaagggatgggtatattatgcttaatgtttccccaccagacccgattgtgtcttgatttggggcggtggttcgactttgagggtcagactttactcctgtagcaaaagttggacaaatgtatacaaattctctcacctctcacacgccaacatcttcctccacccaccccacctccaccatgacttaggatcacctgagagagaaatacaaggtctcccagccagggccctgctgggctgtctcctgaggtgatctttagataggtgtcgataacagggagcctccgagccctgccaaaatcacttggccacagccccaagataatatttgaagttcttgtgctcaagagtgtcaaagtgtaacatactcttcccctttcgccttaccttccccaggcgcagccaacacttgacatctttttatcagatgagcttggcactgccaggaccggctcctcgcgccaatgtggcagcagccacagcccctcagcttgttagactgaaagaatgtgccgttttaattaatgatatgtaaatatccttgaatgggccgcatttgcatattaagagagatttgcggaatctgcggagtaatatattttaattaaggattaattaaaaataatgggaatttcatttcgcctggcagaatccgtttagattttagcacacgtctgcttgggagtctggtaggaagactgtgtgttacgattcccgcagatgagagaggcactcctgtgtttatcatcttggagccccactctggggagcaaagggaatataaagggggtaacattttcctcttacctcccccatcacccacccctcttcttccctcctctttgtgattttagggctgttttggtattctttatggtaaagtaagtaaatggctctgagacacggaacactagttgtgttggcaattatgttaatgggatgctattaggctatgattctatatgagcaattggggagaagaaatgccttactgagagagaatgatacaacagacgtctgtcttattgatatagctccagtggtgctttctgcataattacactcgtccactttcttgaggttggggagaaaccgctgcactgggaattaagagcaagggattgggataaggggcgccctctcccaaatccacagaggacatggggtgggggcacattcttctagcagatgtgggtgttgcaggtgagcaaaacttgtttcacagaaattttattctcttcttttccttctacttccaggaagtagtcttaagtatgggctgggttctagctccaatagtcctctccagaagtagaattttttagaatgtacacactgcctctctgaccttctgtctctgggcacaccctacttccctttcctgggttcatgcaacaaatcctcatactcctagggagttcactattctgttcttagccctaaacacatgttcacagccttctaatatttcctgctacccaattggcctttcctttgtgtatatccatgttgggcattgtcacagaccgtcatgaagtgtctattattgctttactttctgtttctcccttcaagtcagttggttcttgttttgtgtatttaggtgctctgatgttgggtgcatatatatttctgattgctatattgtcttgatgaattatcattgaccctcatggtctgggcttctgtaagccctttccacccttccaattccaaagctgccagcagtatcaagatttgactaccagctcacaatatttcctcctgcacatctggctgctatgagagtgtgagagtactaagccataggcagagtccatgaggagtgggactctgccctcaagtgaccagaggcgcctcctgagggcttccaccatggaaaaggaatatttggtttcttccctttacaccctcagggaggtccaggggaaactgcctaggacctctctaagagctgatggcctgaggcttgcatcttttgttttgatgactgataggctgaagaagtgctggggaggaacctggaggccagggattttgcaattatgcttccccactcaatccctttccaggagaataccctggtgggaaatttcagcacttccactggaagccttaactcagttttccccttactctcattaaaaaatatgtatgtcagctatccctccttcctttccaccccgtgtgactcctgtatttatggatttaggggaaatccacctataggcactgctgctacggcctttccttgcagacattctgacatctcaatagccagctgactgaaggcctgtggggtcaggtttgagaggtagatggggagcaggcaagagagcatttgaagctgaatgtatcaagactgccaagactaagagagagaaaggggcttttagaggcataaagcaactctggggcagaaaaatggagtactgagaatagcagagagaggaaaatagcagagagaggaaaaagaaagtgatagggcaaggcttcttgtaaaccaaggcctggatgccgttaagattgaggggacagtgaacaaagcattggggggaggatcagaaggggtgttttctttctgcctgtgtccctgcgcccgtgtgcactttgcaaaggcagcagtgccttatctaatgcaaatggagaaaatgcagtttctggtaagtgttccctaataaataacatcaagtcttcttccctatcagccagtgacatcccgcatttctcttccccatgcaccagcccaagacatttaatgatgtggtgctccttatgggatgtgaggtccatgctaatgtctccactcacaaaatggtgggaacagatttcagctcgattcagttattctgcaccgacagaaatcacaaaacaaatatatatgtgtttttcaagtgctaagatagccctttttttttttttaaagtcagagaagttactcttggtttttgttttgtttttccttttcattatatagaaatttgtccagggctagttcttggttgctggaggatttcattaatgaaatgaagtaaaaataatcaatttcagatgtttccagtgttggtggtaatggtctctctaacaattctgattagccgtgtgaggtggaatttttcttttaaatgactgcacgttgacattaaagatgggcaaactttgtgtgtgagtgcatgcatgtgcatacactcgcctgccagtgcatgtgcctgcctggagctgggtgtgaggcttgtgttcattcttgccctttcccttgctgttttaccgcctgcttcatctttagtttcccctgtcgttaccctttccctccatcagtatgatttctgaaaggctgttctctgtcctttgctctctcctcctcataagtctaggccatttctgggaacatgtgtgtaaggctgattttttctggggggcagggagtggtaagtggtgggggaggttaagagtaagcaggttaaatctgcattcaaatcaatagaaagcctctgcgcctttggaatgagggttttgtgtgagtgtgggtgtctgagtcagtggtatatattatcctggtatctgccagcccaactgggagctcatcagacagagcctgcttgcccatatgccttaccttccctttcttctccagaccctcttgtactttcaaagaatgaataaattaaattgaagagagtccaccgtggattcttcattattaatttgtttctttttatttatttttcatgcatttttcttactctggttgtttttctttctgtttttttttttttccccttttattcccctgttgacacaccacatatacagccctcccttctctctctgtgaacagctctcttccctgtatacgaacagtcatggagagtgatttctctgcagcgtgtctgtctctacatagatactcatgggtgtaaacacaccagagagggccactgcatgtgtttattgttgtactttttccctttgataagctgtcatcggtgggcactgctcaggggacttgatcccagtaatctctcgaccccatggaagacatttaacacccttccagaccctgtgctctgcctctgtctctgaacctttcactctcctttaatgagaatttctcctaattatttcagtggctgcagcagagggaccgcagtgtacttagatctcgatactgagacgtgactgttatgctgataaaggcaagagatcaataatttaggccccagctttaatggcaaagctgagagcttaagtgtctgcattcaggttgagtcttagaggttcttggagtattaataatttccataagattttttccccctttcttcttgagctgcagctgatcagcattcttgtacttgctaaattgtatttataaaaagatattcacctcctctatttgaacatatgtctgaatatcacataaatgtgtagcggcgtgcctttgcatcatgtgtgtacatctgattattcgcaactgtgtgtaacacatagcacatacagatttctgtttttgttcttatctggggagtgtccttcctcacattgcctttggcttttggactacccataatttgttctttcaaaattcatctggtaaatatgtaaccacttcaaaggcaggagtgagatgtcatccttttcctcctttcttttttttgttttcttttttcttttattctctgtctaatttctcctgctatcttaaagccacaattgtacttgactgaaaagggcaacaccaaagcattgagctcactcagatgtgggtgtccatgtgtatgtaatatagttctgagtttttatatagggtccttctttgagggattccagcaaacctgtttgaacccaagcaaatccatacaatacatacatgctaacagatatataaatgccatgaaaatgatcatagtatatgatatgttttatattaaggttgaaaaaaaaccccagcataacacagttaaggggctttcttggaagattagtcaccggggtgtttgtcacctatactaagaggtaaccagtgctccccagaaagggttggagtggggctgggagcgcccagaacctggatttctcccaaaggagacaacttgttctctagtgagtccaagcttcaggggccaccacgtctctccgctttcatcagcccaacctctctggcatttttttcttctggaaaattactaactttttttttttttttttttttttgagacggaatctcgcactgttgcctgggctggagtgcagtggcgggatctctgctcactgcaacctccgcctcccggcttcaagcgattctcctgcctcagcctcctgagtagctgggattacaggtgtgagccaccgcgcctggcgaaagttactaacatttttaagttgccctaagaaacttaactcctaggaatctgcttaaattttgactttgtaaattcagcaaagaaaacatttctttcaaccctaaacttctcaactagatgaaacttttatgggaatgccgtgattccacgcggatctctcggcacatgctacccccagccactagggggcagagcgacagacttgtggtttgctggtctctggagcttctggagtccccttgtcctctgctacaaaagcacaatgatagctgctactttattcgttactcccttgtagggaaagtaaagggatggggctatgaatatcgctgcttacacattgggaaactggggcacagagatgaaatgactatgagctgaaaacaagacgccagtacatacagaacatagagtttctaacatgagccagttccccgtccagctggccgttcaccaggtgtcagtgtttgtttgccttttagccatcagtccctggtaaacctccatgtctgtggtcctcaagtcgattatggttgagtcttcctactcttttttgtgtccccaagtagcttatttctagaaacaggttcccgtttgcaacatcaagtctggttatgctggggtcatgacttacacatggacaaagaggaaggatgagttgactctaaaccaaagagccatagtgtctttgtgttttcagtacaaatctagttgattctctggctttggtatacacatggttttcttcccttgctctttacttttcttggcttggccaaagtcaccattgctttgctgagttgggatgcaacatctgctttttgataattgccaccaaaacccattttccagttacagagacagttgacggctttggagtgaaagctaggagccaaggagtcctgagaaaactataaatgggcatggaatgtcctggataattctgtggtggggaaattaattctgaaccactaagtactattaagaagctgatgccaactaaataggcagaaatttttacaaaagctgccagagtttagaaaccacccagtgtgccatagcttcaggggagcaaaactacccactctaccaagttggaaaaaatgaagaatgcttcaaactgaatccagctgatcctggaggccactgaccctgtcctaatggagacaaaaagtgacagtgagtatttagttagaggaagaaatcacagcccccccccccccccacccaccaccaagaggatctttaaacttgatggaatgatgttatgattttatggtagccgtgaaaataaccctttctttagcatggtgcttatagtttgccaaatactttcattgatactgctatttgattctcagaacaactcaaagagattggcaagggaaatatgattaaccccattttaagataaggaaactgagctttagatgtctagaatggtttgcctgatgtcacacagctggtagatagcagaaccaggacaataattgaggtctttaattattggtcctgggttgacagatgatgccaccagatcttttccctaggaatttggtgaaaaagtataaaaccatttcattcaaggaaatggaatagaaatataaatttccttctagatctttattctacctctgtcacctgacccttgacatggaagagaataggacatgtctttcccttaccattcacttaagaagtattataggttggtgcaaaagtaattgcggtttttgccttactttcaatggcaaaaacctcaattacttttgtatcaaactaataataatcatgtttgtctgtcttcctagctcctctctgggggaggcagcagtctgcttcatcctgctaccacctccctgcctagcaccgcccaggcctagccagccagagtcagtgcaggctgtgtgggtgggaacttttttcatcagtaaggggcatcaggaattattctgatttatctcacctcttacctgcccaccattatgagggatcatgcactttactgcctttatggctacaagatccttttaccaggtattactcataccattatgaataagctccaggactgaaacccagaccccgcccccagacactgaggactgcctgctgtcttcttagtgctatatcccaccacactggcttagatgaaaactttcaagcagatcttggtggggatcagactagagatttctatgtttcatcagactaggttttagactttttgtgcatgcccgtgttctgtgtggactgtgtgccaggtctctctctactcttgcagtttgagtctggtaacctctcaccctcttttctcactaggacctctcccatcatgccttgctgttagggctatgccctttatatttggtatgaacgcgtgcagtttgcagacccagtctccttaccccagttcctgagcccaccttaatagaggagagctggattgaagtagcttactgcacagaggggtgcaagaaggaaatggaggcattttgcgttctttgtgctttaacaaattagtcttggaattgcctgggatgacctggggactccatggacctatgagtgctatatttgcccagaccaagtgcctgggcttctacatttaattccttctgttttcagatcctttcctgaacaagcagacaccttaagatactagatttatgtagtaggcatagagtaggtctgtctagctctcctactcctcaagatagtaggagaatggaactgagggtgaaccaaggtgtgaaagtaaaaccaaatccaggagggccaaagcgtcaaaccaagaaggcaaggccgagaggcaggattgtgtgaacaggtggaaactagaacaccatgcccaagcaagatggttgctaaggataggatacaaaatctcaagccacagagcctggctgccacaagtgtggagtttatggtcaacagctttttgggcacagacaccagatctggaaatggattataattgaagcgtttaagaggagagcctctggagtgccattgcctgggttcaaagcctgcagccccctaacttgctagctaagtgacattgaaactatttaactgtcctgcttcatacgcattaatgtccttgttgctgttttctcagtgtcattcactccctagctgccaagtgttcctttgcccaaaccttgagccctgagggggctcaggtctgcttttaaatgaatgtgctacccaactacctaaaaggaatgactgttggaatgtttttacttttaaataagactaatgtgtcaggctcatctcaacactgtcatacccagtgggacattctaggtaggattcttggcctagtttctacctttttttttcccaactggaaggtaattctaaggtttcaacatgattccaggcaagtccccatggtttatgacaaataagagcatcttctttgcatatactgcttgacattttttttttttttttttttaagacggagtctcgctctgtcgcccaggccggactgcggactgcagtggcacaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttactgcttgacattttacaaaacgccatcatttgcaccatttacaattttgaaggtgctgtgggatccttaagaaaagtataagaactgatctctgccttaggggaacttctagtgttcagaagaaaagactaaaatatgtaaaccacagatgataatgttcaatgaagttgataattatgtggcatgggttaaaagtataatgatatttcagagacaaaagcagtggtttggggttcatgaaaattaaggttggcttcattgagaggaggtagggatggggtgaagaaatggggcaggaacagatacatagaaatcttagtgtgtgcagggtggggacacatggtgtagtaagaggggatagtagccagcactaaggaagcacggaagtactttggcaagggaagagggtgacaatgaggggattggcttggccgtgatgcagatttgaggttacagtagtgatggaataggatggcattagtagggtcagattatggagaggaggcaaagggaattttaagtaggtaattcacatatattttgttaaaaaccctatccatttagtattattggctccattttaaagaaaatgtatgggtagtatgcacacccaggtctgtctaaaaccaacctcttttcaattcaacatggtaccttaactcaagaaaggatggtaggcttgatgtgattggtagtggggaatcattgtgggttcttgaacagaggagatatagtgaaagggggtgatccaatggaattgtttactgcgcatgtatccatatgtttatataggatgaggatgtcctttggtggaacagatagaggaacaaaagacgcaaagctgaaggccatatgatggactcagctcctgagctctgcattccttttctgtgtacccaggagccgccagccctgtttgtatccacacaaggctctctgtgtatcacagccagcatagaaggcataatcctcctcgggtctgtgtctctataatttatgatgctttcagattaccaaacacaattcatttggcaatgaaagagaatagttttgtgctattgtcctccatgtgtgggaaattgcatttttgatgagcagagccattggccttcttcacgtgactggctgagaacatgagctggtaaccaaggcctgagtgaaaagtcttgggaaccagtcatccagctgccacagcccatttaggggaaggctaaccccacatccctgcaacaatttaacctatgtcttgtaatctgttagttttcatcagccaatatgtacacttatataattatctcagcaaaacccctctttattaaagaagaaggtgatagattgttactatcaacacagtgctaaggaaaccacagctaagggtatcttcttcacacgccactctctcatcctcagtcggcatggtagttttatgaacaactttttttttttctcttagggcatctgttagatgcattccaagctccaggggagacctgtgtggaggtgcaagaaggaggagctctaaggttattttaatttagatttatctgagactccagaaaaatcacgtacgtggtgtggaaattatcctcacataggcagagggagaaaacactaaattcatattctacatgtatcttcttgtatcaagaccagtgttttcagaaatgagtttgccaataaatataaaaaccatccatcggttttcttcccaatactcattcttcccctaaacgttacataggtttttatactcttaattaaccacatccaataatttgtttcctaggctgggctagctggatgatgcctttttatctggttaaagaagagtcaccaggcaggaaatgatggtagagagatggaagactacaaaacccttgccaaattctgcactttttgttagtttgtttgcactgcggaaggatgaagacagtgagacagttactgagaccatcggctgctgtggacatcacagtgggagcagtctactgggtgggaggggtgctgtcaggtcttggggaccttagtaggagacaagtaaaattatgatgcagtggaaaggctcctttgaaaacaggtgatgggacacagtgtatgcaatcctgtgggcttttgctgcaagtaggcagacccctttcgtttgacctttttatttataaagtcacaatctgagatcatcagattgtcaacaactacaacaataaatccaaggtcattggatctgaaacccaacacctgtattgaatcttaagaaaaagaagacaggttgtattcatttaagcattgtctaagtaattaggagacaaaatttgctattatcgtatgtttcacagttatgttctaaatttatgcacctgtgagtagcactataggttttcattaatgtttgtgttctcatttgatctttataactaccctgtgaaataggtacttaggacaaacattgatcacccctcattttaaagatggaaaacctgaggctcagaaaaatgaagctcacaaattatgtcttatgactccaaactcctgctggtttttttttatttgtctgaaaactgactgatgtgatcttatttggacaaaggagtgttgttggaaatatcagtcacgtgaattaattaacaatttcttccttcctagcgagagtaagaccatggagtagagcagatatattagtccattccatgtggaaatccggcctgtagttgtatattcgtatagctatatgttggtaggatggacctacatggtttaatgaaagtggaaggaaaatctattttcagtcagatcctatagatatttcataaggaattagaacttagttacttaaaaattatattctagaggtttataaagcaaacatttattatattcatttacctttttaaaaaattttaagcaaagcccatactcctgttttggggatatctgaaagagagagcatttacaactttagaattacagattcatgagggatctgattttattttctttttcaactttaatttttgattcagtgggtacacatacaggttttattacctgagtatattgtgtgatgctgaggtttggtgtacagataaagcgatctgattttatactcttatgcagtggatctaccactactacaatgactgctacagggctgctaatgtttctgaatattgtctaagtacttctagaaataggaaagaagatcacagaatcataaattcttctatcttaaaggagccttcaggataattattattttacaaaaaaatgcagctaggctattgtatacatcaaacaggctgttttttctcatggtgaactgaatctgcttcagtggaactttccccattctgtctgaggtctccctttggacacaatgtagaataaatctattgctctcctgcattcaaatagttgaagacttattttttacctcttcatcttctcttccctaggctgaacgaaacgaaaactctcagttccttaggtttctgtgcattatttctaatttattcttaattcataactctatagacacttacagaacacctactatgtgtgagcctggcatttttaatttaaaaccctttcctggccaggaatggtggctcatgcctgtaatcccagcactttgggaggccatgggaagagtattgcttgagcccaggagttcgagaccagcctgactctactaagaatttaaaaattaacctgtcatgatgggagcgtgcctgtagtcccagctacccaggaggctgaggtggaaggattgcttgggcccaggagttcgaggctatagtgtgagatcctatctcaaataaatacattaataaatcattttctttgtaatacaaactcaacctaagaactagataaaagaaagccgattttacttttttcctttgtgctcaggtaatagaaaatgaaatttgtatgtatgtttataacatgtacatttatacctgtatatacatattcatatgtatttttaatcatagggaatgaacactagaaagtaaatgaaaaatgagttgaaaaactaagcatttaaaataaatcaattgacttttgatatattaagatattaatttcaaggttaattatagcctcctcttagagatacaactgttcaaagatacatcatcacagctgattgtcaggcctagatgcctgtgaggagagagactcagcttcagtaacctgttgaagccagaacatagaaagtaaatgaaaactcaattgtaaaaacattcattagtttaaaccctagacactggggcctactttagagtggagcgtggaagaggagtgaggactgaaaaactacctatgaggtactatgcttattacctggttgacaaaataattcatacacccatcccccatgacatgtaatttacctgtataacaaacctacacatgcacccctgaacctaaaacaaaagttaaaaaaaaattaaacccttttgtcctcaatgttttgatatttggtcccgggaactcaaatttgcctttgtcttaactggtaaaaatatttacccggaaatgaagaaacattaaatacactaatatgtaaagacttcagagggaacgtttaagaatccaagcaatcaaaatagcacctttaagtatttctgtagtgtatgctgtaagtactctataaaaatgtattaatatgtcttgttaaaatgccatttacatacaatggtaacataattataattacacgtctttcttacagatttattaaaacagatgtgatctaccaataatgttttacatctgatggaaagaattggaatataataatcctacttttctttaatgcattactaattcagacaggcccttctggttgttctgaattggagagagagcagacacttcagttggatttggaatcatccacttttttttgcaggtatttcgaaaaaagcctggttttggtacagctcttccagaacccacgggaagaacctgttcatcagctcatccatccgtctgctgagtaaatgcttattgagcatctactgaatgccagcactgttctttgttcttggaatacatcagtaaacaaaataaggaaaacaaaaccaaacctcctgacctcaaggagcttttattttaggaatgatgtcttttagtcatttaatagttgctgtttttattaactcttaactgtacccataaactggatactttcaacttaaaaaaaaaaaagagaaactaattatgtgccctaaggatcaccaggccttaggttctacctttatttttcttctactgttaaatagcaacctcattcctcaggctgctgatggaattggtaactgagtaatcaggccactgtgctcggggacataaaacctgtggctgctgccattgcagagtcccgtcatggatcagagttcgtccctgggaaacaacttgtgccgacggaaggagttcttcctttgctcccctcatacctcccttccttgcagatgggatccttgcaagggcagagcagctcttagagttgtcaggcccttttctttcattctgcttattttcccataggcgagtactgctcagaacccaggctgtgagttttttgatgtggaaagctatttactaagcatgtcttgacgcagaggatggagggaaagaaagcctccaagagagtggtgattctacaaccatcatcaaattttggttgaaaactcaaagctgctgatatgtattagtaagcagataacagtaacatcctgtatttgcatggccctgtatcagtcaatagcattcagatttgtgtggtggtgtatagctttccttatttcatatcaggtgttttcatttgatcccaagtggtatgtcctgagacagaagaaatagccccattttacagaagaagaaacccaaaattgcaaggaatttgcctaaggtcattagaaagtgtctaaaataagactttgacccggactctctgatttcaagcccagcgattcttctaacaggccatattctttcacttttattatcttgacttacgcaacaaaggagataagccaggtacatgtcattaatcttcctatgtatgacaactgaggctccaggaggttaagtgccttgcctaagattacttgggtggtggtagaactggttttcaaaaccagatcatctgaatggaatctaagtctttcttctgtatcaccttgttaatgtgtcaggaactaccaccccaccttccaaaacacatacacactctcacttttaatgcggacccatcttagaataaactagttaaggactgactgctgaacatggtccagaaacttactgtcaaattttgcttttgagatgtgcttgtgttgtgtgaagtctttttttttttttttcagtattgatgagggatcactttaagatttattggattttgtttgttttgttttgttttgttttgtttttgagacaggatttcactcttatcacccaggctggagtggagtggcgtgatcatagttcacttcagcctctaactcctgggcaccagcaatcctcctgagtagctgggaatataggcatgtgccaacacaccaggctaattttatgtattttttagattttcatagagatgaaggggtctcagtatgttgctcaggctggtcttgaactcctagcctcaaatgatcctcctgcattggccttcccaaatactgggattacaagcatgagccactgcgcccagcctgtaattattctaaagatttctttcctgtttatgtacagaatatctaacagctatgcttacctttaaagcagccttatgaatatccttgtgaattccttaagctcaagggtcttgtttgcattttgtaggtatatctgtagatagatcttacctatctctggcaggtaacattatcatcatgttttccctgtttctggacactttgtgaaagcattgtagaaataaaagaagtctttattctttgacctctcttatgcattatgaattctgaaaaactgagggagataaaaggcaatctatgctttactgctttccctaagttttgagaagcaggcttaaaaaaatgctttaaaaattttagatgccataatacactgaaaatagggatctcaggtatttgaggcagaccaggattcttctttgaccagtcctttcactgaaaagactgtatttagatatttctctgagtgttctagattcatagacccaaatgacctctctgagcatcaagatacatgaagaagttacttcctgaggataataaatatgaaaagagaattatcaccctctgctttcagaaatcacttaaaaaggaagggagtgcttttcccatgaggttcctgagacagagtccttatgtcaccttgtattggcaaaaagatctggggcactgtgtttgacgatagcacttctttgttcccctcccgatatatttacagaatataatcctattttgcttgcactcatttccataatactgaaagtaaataaaccttatataacgttttatggttaagaactacttagtcttgtgtgtggaacttcagcaagaagcaaaagaaaattcacttatagatatgttacctcacgtaatcctcaccacaaccttaggaattagacataaattacaagaaccaattactgattgggaaagtaagtctcagagaggttaatgacttcctcaaggacacaggatgtttcttgatctgaccaagacgcgggcctcgttttctgaatccagggttctagtcctgtcttttaggagatgtctaagtcatacaaaagcatcactggcagattccaccagtgttttattcacaccttgcaacagcctgctttttgaaggtttcttgctgtcatggctattcattcctatgaggtggaaatggcttttttggtatctctttgcattattacagttgttgttatttttagttctatttatatgaaaaatgtactttttagcccacaaaaatagcatagcagcagcttatcaaaatgtcccagacaagtttacttcaacaaattagtaacaccttcatgcttcctgtggtggaagaaatgcagagtccacttcctcccagtgaacatctgagccagatttctgctccactcggtcccccttcccacctcttacagccatgaaataatgtgagagtatttgtttcccctgcaaagggaagagggtccagagacaaaagggaagttagtattcactggaagcctccctgtacaagcaacagtgttaggacttttatacacatttttacaattattacagcagttctcaattattgaaacagagggtaggcatttcccctttttcagaagggaaaagtgagaattaagttaattccaaagtcacacagctagtgagagaaaaagcctggacaggaactcagactgtatgactccaaaggctaagtgcattctatacacacaggccgccctcctggcagtgagagttcaggatctgttggagaaaacctcagaccatggttttcttgcagcttctgctggagaacattaggtgcctgttcccccgtggtgagtgttacaaagtgcagcaccacccaggggaagagtctgggccttggagttagacctgagtttgaatcctccttcagatatttactattgatgacattggcaatcaatgctgctgaatttctccagccctccatttattcatctattaaggggagagctacctacagggcggggaacttacaaggattagatgaggggatatgtgtaaaggcctaacacccagtaggtgctcactaaatgatgttccttattattatggtgattaccactgtactcttttcagatgaaagtgttcggtcacctggaacctgtgagtatgtggtttttgatctgtgactaaactgttcacccatttcccagtttctctgctgtgtcaaatatcaacattttaccaggtttctctgttgttgccaaacctgtcatttttatttggtgtggcttcttgggaaacttccatggcccatttgatgggaatcaaacagagtgaaaacaaggacagatgcagcagaggtggcatcaggaacaaatgggtcataagaacttaccttggcagcagccccagaatggtcaggaggaaaggcactttaaggtatcagaaggtagaaaggagaggttggatgatagaatggggaagggattcctccttgtgttcacagaagtgaatcaatgggagacacaaggttaccacttaatattcctgctctcctaggcatgggtcaggtacatcttcagccatgggtaagtttgttcaacaaatgagtgatctttgggaggctgaggcgggcggatcacgaggtcaggagattgagaccatcctggctaacacgatgaaaccccgtctctactaaaaatacaaaaattagccgggtgtggtggcgggcgcctgtagtcccagctactcgggaggctggggtaggagaatgtcgtgaacctgggaggcagagcttgctgtaagcagagatcgtgccactgcactccagcctgggcgacagagcgagactgcatcccaaaaaaaaaaccaaaaaaacgaaaacaaaaacaaaaccaaatgagtgatgcattgacctttcgtaattcttggatgcaaaagtagaactcaagctacttaataacaatcatggtggcatgggcaccagcaagtcagggtggacaacagccatagttctggagcatggtcctcaagactaccttttgtatgcagagtattaacactttaactcttagatccttggaacataaggaagagaggctggaacaaaaaggggttggcatttggaggtggagaggtagtgtaaggcacaactgtttatcaactggtatctaagtatttcaggccagacacgtggctcacacctctaatcccagcactttgggaggctgagccaggaggattgcttgagtctaggagttcaagaccggtctgggcaacatggtgaaaccctgtctctacaaaaaatacaaaaattagccaggtgtggtggggcacgcctatggtcccagctactggggaggctgagatgggaggatccacctgagcccttgggggtcgaggctgtagcaagtcatgattgcaccactgcactccagctgggtgataaagtgagaccttgtctaaaaaaaaaaaaaaaaaaaaaaggaaatagtttagtgtctagcttctggtccacttgtactggtgttgactatgtatcagcccagcttatgtggctacagggattctcgttgcacatctgaatgaagccaaaaacatacgcaaggttttaagagtatttgatgtcttattggcaatatgaggtggaccagccatacagttagtaacataaccagcattggcttctggcacttagttctgagttctttccgaagaacttatatatgcagaaactggacttagcactcacttaaagaagaaataactttgataagaaccaggtgggttgttctttctctttattggtttcatgttttcagatcttgctaactctccccagctgtgccctgcagtggagacctatttgagactctgttatgatatgcccaagataccacacatgccctaggctcttcccctagcgacaaccatggtgctctctaggaactaatctttgtggcaaagacctttgcccgggggacacctgcctctcccagctcttttcccctcatgtcaaggaccatgcatctcatgctatcttttcatcgtcattttctcaaccttagggctttatctttgaaacgtgtgcatccgcctttagacactttatcattaactggaaattactgttcagatagacttgaggataattattcacgttattaaaaaacattcctcagttcggtaaagtatttggtagcaagctcctataagtagagagagtttctgatgtatttgagtacagatcaattacaacttgaaggagaggttggtgcattgctgaagaacttttaataaagttgcaggtgctgtcagaaatggaaccatacctgaaaaataataactgaaatttcttcagttccatagcattgcaaaacttacttccgcatttgctcatgtgatatatgggatttccatctctaatcctttgcaagatggaaagtctgccacatacatttctagcgagccatgaggtagctggaaactgccaccatgccatacctaaccccactcacaccagggccatgacctcttacacctcttttttaaggtcttcatcaatgacacatgaccctaacaacacatgactctgtcgccactttccattcttcccccaatatctccccttctaggagatttcagagctttgctcttctctattaaatgattgtcatcctcagatgtgggctaagaaaaaaataggatctgatttcctgaactcttctttgcacacagcctttcatggaaactgctgtaatgcaagtctgggtattccctgaagtggcccttcatgtcactatttgactaaggaataggagggaacaaccccgtcttgcctcatccctgctctctcagccaaagaagacctgtgtctggctggagggtggcgtcgcgcctccccttggtgccgcaggccacgcagagaggcaacgaccttcctccagggctcctatcgagctggggaatgagtaattgggactcgccaaagtgtttaaacaccagaattgaaattaatgtcccctcattgctgggtacgctgacaatacattacggcaaacaccttcccaaagtgaaatgaatgtttgtttatcctcatgaaatatacatcaaaacatgttggtggaagaagccctaatgagggaaggggccaggtttctgttaattcttggcaaatagttaactgaagtggaaggtttttttttctttttctttttcattcttcttttttcttttcttttttttttcctccagaataacctgtccacagctgtgtatctaggacattaatatgggtttaatgaaaactccagttgatctgtccaaagatattgatgagcattgcccaggcgtattaatcatctccttgagggaggaaatgaagggaatgggcgagcaggtttctgtcagatgccaatccagatgaagagatgtgaaaagaaatttttttaatcctccatagctatatccatttcctgggacatgggttggcccaagagggaatgagaaggacctgcgattgcacaggaaattctggggcacatttaacgttaaatcattaagcttctgccaataaatccattactgttaattacactgagatggccaacgatctgctgacaatattccttcattgattttcattctcagtgaatcgatgttctggcttggctctctttggtgttttcattctttcatttctttctccctgtcctcatctctctctccccgtgccctgctccctacacctatccctccccctccccttgagctttttcagtaatgcagttcccctctcactggtgatacagttctctccctaagtgccaaatgtttcttgataggaacaagctacatttctttatggcttatggcaaactgccttgattacttctactgctgtacccattatgtgaattaaatatgtattcagttgcatgctgcttgcgatgttattgcagggtgacatatggtactgactcaattagaatgaaactagcattagataacccttctgattacatgcatcctgaccggctcctcctcggcctcccctctgtgctctcgctctccagtgtctggaggccgcagattttcattatctctgccacatcggatgcaggatgggggtgggagagggaggggcctgtggatctctgggaaagaaagcggatcagacagacagactgctgtgaaagggttggtggggaagaatagagaggcctctgtgcttgcatttggaattaacatttacaattatattttttggaagtggttgtcaggcctactctgaaaaggggctggaaaggtctctctagagttgtgaagcaacggctgcatgtgattagtcagtccttaccttgaaatgatttatttaaaaagaatacattgttcgggcgcagtggctcatgtctgtaatcctagcatgggaggccgaagcagaagggttgcttgagcttagaagtttgagaccagcctgggcaacatagcaagactctgtctctaaaagaagaaaaaatttaagcttttcttaaaaaaaaaaaaaaatcttttttctgttgttgctgtttcttttttaatgcagagctaatactctactaccagtaatatattttgttttcatatcacaccaatattcagtatatgttaacctgttggattttcatcatatcacaccaatattcaatatatgttaacctgtttgattttcatcagcatctgacaacacaggtagactaggaatcatccccctgttttacggatgatgcggtggagattcggagaggcttggctgcattacagtttgaagtcacaaagtccctgagtgcccaaatgagggggaatccttaaaatgcagggggttctgaagggcaactcaaggatgcattgtaaagtgatcaagagttgttaaatctttttttttttttttttttttgtgacagagtctccctttgtcacccaggctggagtgcagtggtgcaatctcggctcactgcaacctctgcttcccgggttcaagtgattctcctgcctcagcctcttgaatagctgggattacaggcatgcaccaccatgcccggctaatttttgtattttttgtagagatggggtttcgccatgttggccaactggtctcgaactcccggcctcaagtgatcctcccaccttggcctcccaaagtgctggggttacaggcatgagccactgtgcccggcgagagttgtttaatcttgaaaagttgtctagcatagttggtgctggaatatctggaatatcacatcctgacataatacaaatcacactagagtactgtgggcatatgacatttccttatgaggagtaattttctctctgtgataattttaactgtgttttagagtgttctaagcttccttcctccagctctatcacttccagttgccaagcaagaacttatagacagacccattctctttcagtcccatctagacacacctgaggctgaagcgtcttctaggctaggggctaccacagggcactgatagagagcagagagcttgcaggcaaccttggcttttctcaagcgctggtagaaaggctgctgggtctgagatcacccaactgatgttgcgtcaccataaaataagacttcttgcctgtgagcagctcaagttagcaggcatatttgagtgtcttccacagatccccaatctggaaatctgaaaaccagaatgctcccaaatctgagaatttttgagcaccaccatgatgccacaagtggaaaattctgcacctgacctcaggtgactacacagtcaaagcatagtcagaactttgttttatgcacaaaatcattaaagtgttatataaaattacctttagggtctgtgtgtaaactatatgagatacaaatgaatcttgtgtatagacatgggtctcatccccaagacactattacgtatatgcaaaaattccaaaatctgaagacagtaatcccaaattcgaaacacttctgacccaagcattttggataagagatactaaacctgtatacgtgcttgtgtgtaccacattatatgctgtgggaaatacaaagtgtacgtagacagctggctataggcagctcatacgcaggcagaagtggccataggcagctcatacccaggcagaagtgaatatcatgagggtaagtgtaagtgaggatggtgtgaactcagaagtgccatagatgcacttaaatgattttagtgttttttatgctgtcactcagcccattgccttgagtatagcaggcttttaacaaacataggttgaatggatgtggggatgaatgaaagggagggtgtgaactatgatataatgaggcaggttttcgtggaggaaatgggaccccttatagataacacaaccatccattcccaccccaccactccctcccctcctgcttttcaattataataatgataactaagttatgcagcactttatatttaaagtaaccctttcaagaaatgctggaaagataagcaagaaatgaagaaaaatggttatcagtagaggccaggtgtgagcgtggggaatagggttaacagggccaaacaagggtgggagcaagacttggcaatgtatggtgatcataatgtatattgtagatgtattttttatattgtaaatgcattaactactcaaaaataatattaaaatcaaagaaattttctggagcattagcttacccagtcttcacagtcgccctttaaatgggctgcacagttttactaggttctaatttcatgaaagggaatcgaagaatgtaaataacttacctaagatcatagagttagtaagttgtagaggcaagactagcccagattgggttctttctaccacagcatatggcttctgtgaacattgtcccaactgtgctaatccccagagaggtttatggctatgtggttgggaccttccctgagaccactgttcgccaaggtcactgtgtgtgccccacaggcctctgcaggaagaaagagttggaagctcagggttcttctccccactgccactgtaacacagcagatttaaactacaagcaacagcagagcagagcagagtttggatgtacaagatgagctgtctctgaactggccctgtggttcatgctcgctgttgcagaagggaggaagtgtgaagcagatggcctttgcctggttttcagggtggccctgagatacacagggtgcctgctgaggaatgagggagctattacaattattataatacctggaagggccgaagaacaaatcaggcactgaaagcaccaaaagttgttgatcttgtaaatttaggacagtgcgacttacgttcttgagagcaaagtatgacatttttatggcatgctttaggtagggtccccactattctataggtgtttatactgcttcagttgcttcacagctcccccttctttcctaccacacctgacactccccaccattttccatcggcaggggagctacctagagctgccttacttggcagagcagaggtagcacctgtgtcattggctgttctagtgtgctgtcatctagcatatctgttattccatctgcagccttcacacacttttgctctccaggtccagtgagttcatacatagcaagggcttttcctgagtatcatgtagccaatgaagaacagatctgtccatagactcctggaaggtaatttgctgctctgaacaccatgacgtctgccttttcacaacgtgcagctaatcataggcaccttatgcccaagattgcctttcacaagagttgtgaaagtgctctcccagtctggttccttctatgggccatattctgttttgatgttgtctaaaagtgtcctctgtatcttctgtacctcctaacccaggtcccacctccatgaaacctttaggattatctcagatgtcacagaactagagagactagtgattctaagatttctagctttttttttcaattaacttctagagtgctttgttttctttgctgaagtcagatttctgcccctgcagattatgaaatcacccagtggacaaattcagtccttattctacactcttgctgtatttgatcctgacaacctttctattataaaattctcatttcttcatctctgtattctcttggtttgcttcatatctctttggttgggcctccttagttaacttcaatgttgcctcctcagcccatcactaagtattcgtatgcctgcatttatcaactaaatacctatggctcacaaatatatccatctgtgatctcactgaggacagaggacttatcttctttgtcaaccgctgcatccccagtgaggagtacaatgtctggactaaaacaagtatccagtaagtatttattgaacaaatggtaaagtaaaacctatatgtttagcccagattgcttttgtgagtttcagatctacacatataactgcccggcaagcatctctatatccatgttcagcagatttataaatccagagcagacctcatcaatccccatccacaacaagtcttcctcctgtattccgtcttttatctgcccaatctagaaacctaatatttgtatcagactttaacctttttctatgtcacctcccactaccttcatctaatcattagccaatttgtgttgatactaccagcaagcatttaatgaacactttatgccaagacttataaaactaaacacattctaactatttctcatttctccttcttcccatctgctgtcatcctaagtcaggcactcactatctttcacccattcagcagtattgacctcttgactggtgtctctgcctgtaatatccttaagcagcccatcgcatctgaggcctgccaggagactcttaacatgctaacctgcttgctatacccttattcaaaattctttgatggaggtcccattgtcaaaagctgcagtcctgaatctcaaaactgttgtgccatgatcagttgtgaagtatgtcacaagtaattttgatattaataatggttcaagacctaaggtttgcaaattatttaaaattttaagctaagtcaaattatcaccatataaatgtcactttcgctcacttgaattcccatatgctttctttagtggaagagaaagagtggcattacagtctgctgagaattattcattttggtctgtaggatgaaatctaaactcctttgcataacctacatgaaccttgtgatctagtccttgcctacttcaccagggctatttctcaccatttttttctatctcatcatatgctacaaatatactgagttacctgtaatacctaaaacctgccacttctttcttatacctttgaagattgtctcctactagcgatttcttgtacctgttatcccctaaaacactcttactgatcattcagatcctggctgaggccttgcctgagtatcctgacccagttctagatattcctcttcctttgtatccactttgccttgtatattccttcattgtagcttataataattacatggtgtttttagcatgttcgtttccccgttggactgtaagttaatgccttttcatgttcttctcccaatttttagtacatggctgaacatatggtaggtgctctgtaatcttatccactggtcccaacattcttcagaatcaggcaactttagtaccacatcataacttaatagataaaagcgagagagccctggacagggagtttgagcagctagtcctagctcgtctataatgattctgtggcccttgacatgttacacaaaacttatatctatctcagtttctatgtgtatggtctgtttgtaggacttccctatgaaatggtggtttagaccaagttggaaggtgtgcattgattggaaaatacaggaagtaggatagagtaggcaaagtgaggcccatgtgcttgccattgatagtctgtcattgaatgtctagctgggagtaataaatggagacccagtcgttatttgagcatagatgacatgttctgaaattagattgaaggacttctcatctggtaaaaatgtgccggatgtactagagtgtagagagagtgaagaaacagatttcagccaggagacaaaaggatctgggatctgctatcttgggaatgaaaaagatcacacttttttcaaaaagtttttgaaaaaaagaatgacagagcctggtaaccacctagatatggaagttgaaggaaaggtatgaattgaagatgatggaatcatttaattcatttatttatttggattccacagaaagtttgaggtgggatatgactcagtacaatgaaaactgttaggcatatggctggagggtgtggtcacagatgctggctttgtcatgtaactcggaaataaggctttgccaggattgtcgtagagtttgctgcatcgtatgcaagtttggactagactctaagatatctcccatgtctgtctatgtgtttatctttgtaagttctctgatttgttacctgagagaatgggtttggcattaattaataggaataaggaaatcagggaagggaggggatttggatgccaggtagagttttcttcatttcagattgtggtagatcttttgagtttcactgaatgttgtgataacttctgtataattgttgactttccttttggctttgtctctgactttcataggatagcgctgtatctgttagaatcatactctgttttcaggctgtccctaggctgagctcactagttccagtgacctctttctggtaggaggtcagagtttattgagtgacagtggaccagaataaaattatagtggaaaagaatttgggttttggagtcagactgacccaaatttgtgttctatatcctttgtctattttgtgacattagcaggttacctaattttcatatgtccgtcttctcaatactgcaagtggggataatatcacctacttcatggggtttggtgaaagattaaaataataatagctaatattaatttagggattagttactaagcactgctattttacattcattatctcgtttaatcctccctgcaaaatctataaagtatgtattttcattgtccctgttacactgaccagtagagggattaaataatttgccctgttacctgactaggaattggcagagcagggattagaacctaggttgaatgactgcagaatctgagcctttaataactgaaagcacggcagcttcccaaatgtcaccctttctatgaaaatgtgaaatctctagtaagaccctctttcagattaatcacctcttctaccatgctcctataacaaaattcctgaaactttaattagcccttttctattctatgtcaaccctttattcaacccttaattttaatcatttttatacgtccccttctcttcactaaattataaacttttaaaaacaaaaactgtgtttacctatgtatttttgcattcaattcctttatacacaggaagtctcaatgttaatttgttgcaaagaaattatttgaaaggctcatgccttccctagggggacatctttagccacttggtgccttgaggtcacctttacttttccatcatcaaaataggaaaattaaactgtcacagagtactacgaatagcagtaatgaaatattatcatttaaaataaggatataatatcacttagcctgattgtggtcttcacatcacctcccccgaccaaagaaaagtcataaaagcagaagtgttctttgcctcagtggtttagattgtttgtgatatttggaattgaactagacaagaagagacgtatcaggaaccagttcctccttgcctccaggtatcagacatgctagatcccagttggtcttaactttttgtctcacttacccctttggttggaatgcaggcattattctgaagctttgtggtaagcgacttggattttctagtgtcgggctcttctcttttttaggaagggagaagcgggtctgggaaattaaagtgcctgtatctcccagggcaccgattgttaagagggttgggacctcagtatgttttttttccattctgccacacctgagatagaaaaaagaaataccacggtccctcgggtagcagtagagggtgagagcaagactcctacctctgaatgccgttagatttagaagttcattttgactgctttacgatacaaagttgagtaataataatggtcttactggtataaataataagcacagagtgtttcatacatatcaaagcaatttcgtacattgtagttctcattctttgagaaacagccttgtggggttgaacagaaggaattacagaattgtgtttgacggtgttgagtgagaaatttttagctgtttttcttattttgttccctgttccctcatttttttcttatcctgagttagtctcttgatttacatctcggcattcaggactcaatgttgccagcctcccgcatctgaagtagctgagagccaggatgctagcagaggatatctgtgtagccaaactaagggcccatgtacttaagtttgtgcagttgactcatcagagcgcccaaaagccaccactcaagacctctgatttcaaatatgattctaattgtatgtttatctggcttcctagcctgtgccagactatatacatgataatctctaacatttactaagtacttactaactgagacactctcctaaatactctcaagcattcactcaggtaatcctcacaaccacactagaacacgaggtaccacaactgcctccattttacatgtgaggacagagcacaggggggttttgaaacaaggtcccaagccagtagtcaggtctggcttccatgatctggaaccacagcccatgctatcagctatagcactacaacctcagaagagggggaaacttaaagaagcagtaaaatcataaaaaggagactcaagaatttaaaaagaccagcagactgagtctatacagaataggcatgcgtgctctcacatagcagcgggcctgggtgatcatcagcattcctaatgataaatgacgtgggtcacaaagaggaggccaaataatgtccaagatccctctctatctatctacctagatattttttaaaagaagctagatggaaatataacatgttttagaagattactatcgaaaatgatgaaaatacaaatagttttggtaaagctccagtaacagggagccaagctttcaaaagtgatttatttttcagtagttaacgtttttgtgcctttctacctgctcgtgggttccagagtctctgttgcctggtgtctccccgagaacaaagattgtggatccccaaagtacctccacctcctcactggactcctgctccagaaaagatgaccataatctaataatcactctaccgcatgaacagggtgtcacacatgtgcttgactgtgcctctacagtggcaggtagagcgagtgcagtgcaggaaatatcagcccttttctaaagcactatgaagatgaaagggggaggtggtcaggggatggagaggacggaggggaaatcacttctttgtctaaaagggaaatgccaggactgtcccttcaggtctgttaagtgtctataggatgtggaggaaaattcttcttctcgttgctcccacctctccccatcccctttattctttctcactttgtagaataatataaaaaagcccagcagaaagggagctgtgatgctgtcgtccctggcgttgatgttatttattttcctcagttgctgctctggaagcccggagttgacagagcggttttgtagaatagaaacattatagactgttactgtcagagtgttaaatgtgatggatagagaaatagaggcgaaggaggggacttaatactgagagccagggtgctcatgggaaaataaaccatccgcatataagaaatgaatgaggtaatgtggcgggaggtaatgggctttcgcaacatgccggaacagagatgcttattacagggtgtgcttaacccttggcatgctgatttccctttgtgggttccagggcttttcgctgggtccctctgtgggagcatgtgtgtggcttttcttcaggcagggaagccagcgtgtgtagaggagtggaggcaaacgcattcttaataacactgtattagcagcctgtacatcagagagcttggcagctcctgagggacacgggactcccgtggctgtgtgagacagaatgtgccaggattgctgggttatggagaagccaaggaaggcacatcaagggagcgtgaggttctgttatttctccattggagacttaagagaagtgctttggttacgtaggggaggagattcatgttacttgattctcttagtggcacccgaaggtttcttgctactcttcgtagcaaatactagctgtttaccactgaccagaatgtggtggctttgctctaggttgggggacacgggagcagacagtgatcatctttattacctcatggtctagttacagtgcatggtacagaggtaataataaaggtgatcgtgtcaggtggagaccctgcagcagataggatgatggaaggggacccaactctcctggatgaggtaggtgaattaaactgaaggtttgccagtttcagtgaacaaggtgcttttcccttgtgttgggtttctatgacttttttcacccatctttgtgttttggtggtggccagccctgtatattgccacttagctgatatggactcccatctgcctctgacagttgcctgctgtgtggccttgagcatgtcattgaacctctctgggtgttagtttcttcatctgtaacatgagaataataacacttcataaattcattagcaagactaaacataatcatgcctatgaaagtgtggtagcctctaaaacattacgcaaatagccaagtattatcattatttctgttagtaatgaaacaatatatgcgtgtcagataataaggtaaagctccaactcctaatcttttcaggagactctttgcctttttgcatttttttttcccctgctaggatacatagagtggtaagatatgtagaaagcagagttcaggggaaagttagaatgaggcagagcttccaggatagtactttcttgttgatctgttatttttctaaacctttttcttttctgtgttgaaacacaatgccattttttgaacttcaccaattgttatctcagatatggatatgcctgaggcctgggcaagtcagggcagtgccactccagtttcagaaaagaaagtgtgatggggttcagcaggggaattgctgttgtacttcattagccaagctcagtaattccaagaatacccctgcgggtgtgggtgtttatgaaatgcagattcacaggccttgccccagcaaatttgataggagtctaggaatctgtatttcacaaacactgtcaatgaatcccatgcctgtggtacttacgtcacttattagaaactacctcttccttcacactctctcccactcccctgtggtgatggtctagttactggtcttaaaggtgataactcactactattcaagagtaattaaaatgccaccaatgccctcacttcatcagcacatgggtcctgcacaagactgattgtgcacatttttaaagcattttgtattttttgaccgagctctgtacttatgatttgtgtcattttctatctctgtattatgtgttcagaaagttttttataatagcaccgatattgcttttattagtggtactgtgacatatgactgagacccacaaccttttggtctatattaaaaacctactgaaaagtaaataatttgtaaactttaaccacatagacaaagtgcatgaaggggacatggagagaataaaaatctcttacagacatatgtttttccagtgggcagctgctatttaagaacttttaaggtgcacatgagtacacctttgttaaaaggtatagcttgtatagtaattccgttctgggggttgcggagaagagcaggagggagcacagtgtgccttgccctggctggcagtatgagacaattaccacgatgaggttttttttttaatgttctccatatatagattaaaatgtttgttgcctgaactgggcatggagaaggcatcataatgtgcacctgaacattcatgtagggtttagtgaggagaaaataagaggataccctgagctcacattcatgggcatgggctcaagctttttccaaagtcactgagatgtcattgtattgactcagccttatttgcattacctcattctggtagaactgctatgtttatagacatcatttggcatttacccttccacatcagagctttcatattggagttgactcttcattttgagttgaccaaggtgggcttcagtgtgagtgagtgtgtgcacttgtacagatacaccataatctaagaatcaccctacccccatgaacagggtgtcacgcatgtgcttgactgtgtgcttctacagtggcaggtagagtgaatgcagtgcaggaaatatcagcccttttctaaagcactatgaaaatgaaagggggaggtggttgggggatggagaggacagagggggaaatcacttctttgtctaaaagggaaatgccaggaccgtcccttcaggtctgttaagtgtctataggatgaggaggaaaattcttcttctcgttgacattgtgtaggtctgtgtgtatctgcatatgcctatattcattatgactcatcatcttactctcatggtcttttggagatactttgtctattctggagtgcagaggtaattaacttatggtgccagctccactgatatccaaccatatatatctttggatttttgaaaacctgatgtttgcaaatgtctattattaaaaaaaaagagagagacaaggtctcactatgttgtcaggcaagagtgctgtagctattcacaggctcgatcccaccattggtcaacacagactgctctgtgtctgacctgggctggttcacccctccttaggcaacctagtggttctctgctcccaagaggtgatcatattgacatcaaactgagtgtggacacccaattggcatagcgcactacagcccagaattcttgggctggagtgatcctgctgcctcagcatcccaagtagatgggaccataggtgtatacctccatgctgggctacaaaaatctgttcttatcttctgtgcctttttcttgttattctaaaaggtggaaagccgagcaacttcaggatggtgctgtagcattgtgagtgagaggagaatatatttagttcatatggctgccttatgtgtaatggattactgggtataggtccatgtattgttgatctgtggcatgacaggcctggcagagggacacaaacacatatgtacaaaatggctccctgctcattaccacgagcctgaactcatttcagctgagacgaccagttagccaacagcccaggcgtacatgtgacagcttgggtgtctgcccctgctggtcatagctaccgcttccgtcactggctgttaatcagaatatgagaaactctggccatttctactggctggactccgtgtgctgcctgaatccaggtgcatgcagagatgttctcagatctaagagaggtcaggaagggaaagggatgattcctcctcctaccttttcctaagtcccttctccacacatccaattgcacccatgagaaccgaaccaccatgttgaatggggtctggcattcagagcaacttccctacaaatctctttttattggcatttcctccaatttaaccagccctgaattgcatttgaatcagatgagagaaagagagggaaggagaagggaggaggtccctccctctcttggaaaagcagctcacaaccagctttatttggtaaaatgctgcaatagatgcttgtcagaaataatttattcctgttagctgtaatctgaaggaaaacagatacaagtcctatagttaaaaaaaaagtaaagtagtcttgctttcgctgacagtacaaaggtgtcatatacaagaaggattgacacagaccaaggggtcttgtgggaaatatgataataactataaagaagacagattattccccagttgccaacattcaaacctttttacagtcagttcaaacatataaaactttattgctctagcagaaaggggaacaatttctggttgcacagctttcccagggctgggtttatactgtctgtgttattgctctatagtggcattttaaagtttattgaacaagacttttacaattgaaggaagtatataaaactgtaaatttattagatttttcaggataagtgccctttgtagttgtgctcaagaattcggagctatgagaaactgctagttacaagacttattaatattaaagactgagagtacgcacattttataccttaactgatctcaaaaataatattattatattactgaatgtcagagctctgatactatagaattggatggatacacacacataggactctatgtaccagatgtgtttatttttcactggctaaaaagttagctttcgttatatcttactttatttgcttttaacacagttggtcagggtattcctctgttcattgaaggatgtctcaggtagatgttttttcctaaaatccttgctgattttccagcatttctcagtgtgtgggtataatgcaagtacaagtgttaggttttaagagcatattttatggtgaagtaatatattgttgcattcacaaaagcaactataactttgataatcaaaatactaccaaaaggagttcttgttttccccaacttctcatttttcatttcttaaaggttttgagggaaatcatttgagaaattttgtaacatttgtgataatctataaaaaggtttctcaacctcagcactattgactttttgaggccagatgatccttcattatgggggctgccctgtgtaccgtaagctgtttagctgcattcctggcttccacccatagatgccagcagcatccccactcccccattgtgagaaccaaaaatgtctccagacattgccagatgtctcctgggaggcaaaattatacccagttgagaaccattcatctatacagtattataatatgtctggggaaaatacattttactgtaaataaataatataggttgtgtttggtaattaaaaaatatattgttactaaacaagatgaattacaggattatttacttgcagaaatatctgactgttgactgcttttaaataaggtgtttcccccaaagaatgtaacatagctcaatctttaaaatttttcatataaattttggggatcatatcactatgtggaaggagatgccttgcttgcttacttaagcctcaggacatgtgtttatggatataatcacttatgaaaccagacctcatattctttttatattatgttatgattagccactgatatgtgtttgcctttttgatttttcacatgcatatgcagaaacatgtatatgtatatattatgtgactaacacagtgaaggatatgaaaagtatgaagacaattttgattataattttctcatttgacaagttcaattttgaggtaccatcaacttgcctttaattttcaatttgtattctagaattccttaacctcttcagaaggttttcatggtagatacatttaaaacattcaaataagttgtttatagcacctgttcaccttcatgctgcctgatgttattcaagtacctatgtgtgaatggcactttgatctggaattctgtgttaatttgtctagtggccatagcatttacagaaataagctaaaatgttttcaaaaggacttaaattgtaattggccttttggtttttgattgctgagttttggaattctatggttgatataaaaaaaatctagacacttgtgacttactaaggagtatcttgaaaatgtctcaattctgttattcagtggaactaccattctcttttgcccctatgacctctgatggctgagcggtgttagccatatactgtgtgtcttttcacctcttcttgccatctctgtgggtcactgggctcctctggaaacttctgtaggcagggcagaggtttccttttgtgtttccttttagaccatgccttaagaagtatggtgtgacttcctttattcactaaatgtctttctgataagctgtgcatgaattatatgattggaaagcaaatcatattagaatccactagtggagtctggctaggatatccattgtaatcctcctagtaagtcataagatctattcacaatcacccctttagttatgcacggtttccttaaatcataatatatcttgttagagtttttaaactactaatgtccattctagtatggtgatatgtatgatagctgtgtcctgcctggattcatgcagtcacatatatatgatatacctttttttgaacatatgacaatatgcatagcccctatttggtgaactgtcttctctacaaattatagccttggtgctttacaaggttaaataacacagtctctaatttaagtaacagtgagaaccaggaagatttaaacagtctgagtcaggcacacataaccctaccctcaaaagcactcatagctaagtgggggaatcttgctgaagtcttgttaacttcctgggtttcaaagtcccacttccaggtaccatggatgaggcagcaggcatgcaattacagaaaaataaacctttagtcaaacaaaagaagccactgaaagaactgaaaaccccttcctagtcccagctaaattcccagggaagatttaggacctgtgtttgtcctgagttagtggatggtcttggccagtttgccatctgtagtggtgagttgaaagggactgtgggctctggaggctgaaagggagtgagcaggaacaacatgaaacagcaaatgtcagggaagtcagtaagccctgaatcttttatgagaccttggatattctgatcacagctccgctggcatcgagattggaatacagattatgggagggagcgtctgtgacatgaagccctggcttaaatcttcccaaggttttaacgtgccttaccatatgaatattttgttattttatttggcagtatttccacaggaggccaggaaggagagcactgagtaagccaggggtagggcaaatctagagatgggagagattagaacagtattgtggctaatgagactaacaccactgaggtgtgtgtgtgtgtgtgtgtgtgtgagagagagagagagagagagagagagagagagagagaaagtgctgaatcccctgtaatcctgtctcatacaaggccctggtgctaaaaccactgtaactgtttatgaattcactccagctacatagtgagaggaaggaaagagaataagaagaacccaatgctggaatgaatttatgcttaagagcttgtctcgggaatgcagctgggtttaagagtcgccaagccaagacaccctttttgggaaaagggaaaagaaaaggaaaggaagataaaaacccaggagactggagggacagtgggaggaagaggaaagaaaacgtgctgctcccagatggggaagccttgtctgagtgaaatggcattataggttgtctgggtgttagccccttaaagtggtttaatttcccactaaatagagatcactgtgaggactaagaaccaagcaaatgctttcgattgcgctatcttgattagaagccctgcattaaggcaagagcattggcagagcccgagagagctgaggcaccctgaggcatgcagcaaggtccatggcaggctagacttcaagtggctttgccggagcatgacttacagcagatttgatggcctggattttgcttttccacacctgtccccatctggtaggccatgctgtctcgtagccaacctgcaagtcagttaggtgaggccgagtgacctcagcctgatgcaggccacagaagcagagcgaggcagagtgactaagtgactgctggaatcctagtaaagcagggataggaaccagagttcctggactgcacgcagccttttctttggtaagagaggttgactactgtagtagctgtgtaaggggcagatagagatgagtgagagatggtcattcctaagtaagaaatatttatcagatgactgttatgtgtcaggagctgggctaagtgctttacacatatatagtctttttttaaaaaaaatattttcttttcttttaatttagtttcaggggggtacatatgcaggtttgttaacataggcatattatataatgctggggtttgggcttctattgaatccctcacccaaataatgaacacagcactcaagagagtgtttttcagcccttgccctttccctccctcctcctttttggaaaccccagtatctattgttgccatctttacgttcatgtatacccattgtttagctcccacttgtaagtgtgaatgtgcagtatttgattttttgtttctgcgttaaatcacttaggataatggcctccggctgcatccatcaacatatacaatctttacaacaaatatatggcacaggtactgtgattatattatacccattttagggataaggaaactgaggctaaagaagtaaccaagacaaagttagaaaatgccaagtttgaatctaggctatctccaaaatacttggccttgaacacccatttgagcaggtttgcactgaatctgtttcttcattttaagcactacttattgagtgctgactgtatgccaggtaccatggtaggtgctggggatactgactagaggaagacagtgtcctagtccttgaggtgtacacacagccgcggagacaccccagcaaatcagcgatggcagtggtgccatagatactctgagaagtagtcacggtactcatggggcctgctacttcataatgtcagtgacgtggcagacacaggaaggctgcagcacacctaactttgttggtcacttttgtctatctgctactctcaaggctccatttgtctctgttgtgtaactctgagcaagctagtcttctttctaagaaagtggaagctgatcagcagaaggtggccatggacaaaatgggaagcaggaccgctggagaaataggcccagttgcttatttcaggaaatcctctagtcttgttcactcgaaattgtgcaaggacaaagctgggtccattgaaacagaaagcataagaaaacaaaaatagaaaaagggggaaaaacactttaagttgaataaacaactgctgagccaactcatgagttcagcgggggattctcatgtttccaggatattttcagattctgatggcaactcgggaaagaccactgtaaccttgaactttgtcagaggaccgagtttaagaccaccaagacatttcacgcagaccacccactgcaatttcttgcataggtctgctggccagtctcttattaatactgcaaggcaacctaaactatattttgttgggaaagtggaagagcgaaggcaggtgttgaaaagccatgaaaaaaagaattaaaacaaaaatgtgcctcaggctcctttcagctggcagcagaatttccgtcatctttcccttttgaatttgatattattgcaggaacattaccacggactcaattttcacttgacagtgaaataccagaagtcgtctcgggtccggagtgctgtctgcatccagtccctgttaatctgcagaaggaaagcatggagatggggtgggtggccaagctgacacaggcctcttcaggctgctgggaaagggtgctccctgggtgtgaggcccaggagtccctagaattgcatagatgcagcagtgagcagcccacctgggtgtgaatcatagacttgttttgagaattaaatgagcaaatttatgtagaatgcttaggtcagtgtctgacacatacaccagtgttcagtgagtattacctattgtgactgtttcttcgtgggcaaagcaacatcatcctttctctgcagaatttgaaactgatgtcaaaagaagagggaggcagcagcatcacacatcagagggaatttcttttagattcatataccgtttttccattttctcttttcagtttttttctttcttataagaaagactccagatgttgaatttaaactgggggatgtcttcaatgccattgaatatattgagcgtgtaggcaggcagtggaaggtgctggtttttttcttttttttcctttttgttttttgagatggagttttgttcttgttgcccaggctggagtgcaatggcgtcatctcggctcactgcaacctccacctcctgggttcaagcgattctcctgccttagcctcccaagcagctgggaatactggcatgcaccaccacacctggctaattttgtatttttagtagagacggggtttctccatgttggtcaggctggtctcaaactcccgaactcaggtgatctgcccgccttggccccccaaagtgctgggattataggtgtgaaccaccacgcctggcggtgctggctttctttggtaaaacggagaaaagccttgagggtttaaggaggagagaggggagtaaaatagagaagaggatcaggaaaagaagaacaagttgaggatatttaattatttgaaatattgtgaaacatgaatattgatgagaaggatgaacagggatgactaagtgcaaggcagggcgtgatggcttaccttcctccaagtcccacctgctgttgttgaccccatctggccagccaggcgtgaaccttagtctagcaacaataggggcaacacagagtgcatctgctgctcaatgcagggagagatgcactcttcatcttgtaccttcttgctgtcaaccctttctctttttttcttctgctcatttcttaccactctgtttatggtaacatttgaggggggaaaatacatcaccctatgaaagaacagggtggctgctgactttgtaccaacagcagtgaaccagggcctagttgtcagcaaccaagacctctgctgacccagaagcagacaggtgaccctttcaccaaaacttcaatcatcagtcttctcttttctttttttgaaacagagtcttgctctgtcgcccatgctggagtgcagtggcgcgatctcggctcactgcaagctctgccttccaagttcacgccattctcctgcctcagcctcccgagtagctgggactacaggcgcccgccaccatgcccggctaattttttgtatttttcatagagacatggtttcaccatgttagccatgatggtctcgatctcctgacctcgtgatccacatgccttggcctcccaaagtgctgggattacaggcgtgagccactgcgcccggctagttttctctttttgtcgtgtctaccttcctacttgcctcacaccagtcagttggctttctgtgtcaagcctgaggaatgaatctcatgaaagagcattgggagagcggagattttggaaattgctttcagaacacaaaatcccacatgcgtgggcttgttccctgcaagcttaatcttgcctgatgtatatgtgtacatgtggaaggctgaaggaagtgctataaatgccccattcgtaagtattcagccatcgtgtgctgaaagcctgccgtctgccggacactgaaatgtggccttcacaggccgagggtctttaagaagcatggccgtgggggctgagagcagggtggggtgacaggacaggttactgagactgaattttgtctgaagagtagggagagctgtagtggttcccctttgctggttgttggtttttgtgtgcccccccacctcaaacccccccaccgtaagagaatcagaagggtcccatctgccttgcagggaagggtcatggttggtgactggtaacatctgggggaggggccacttcattatgccacccagaatatcaaagcagcttaggcgttggaacccagggaaggaagaagagattaaaaaaaaaaaaaaaaagccccactgccagtcgggcagctctctgtctgctgtctgcaggctgctgctacccactcgttacaattaaaatgaagtgtccgtcagcggctatcttctctgtgtggcccatatgtttctgagctgatactgtccggattattctgttcgggaaaacgataacggctgtttataaccttggcaaagactgaggcctaatcaggctggagcacattttcaccgactggctgataacaggctgttagcagccttatcgctcgggagagataggccaaaataagcagatctgtgagcacaggagcccaatcgagtggtacacactctggccctggctttatttttagattttcctttcccggttgatatcggaaggcacagaggcaggaggtggggtggatagtaatgtgtgcccccttgggggtcagagtgaggtggagggggatgttaatcaccatgagaggcagagggtcagcccagcttccagtgctccgggctcccttcaaatgagggaaaacacgtgcaggtcttaggagacaaaggaagggaagtgactgtttcctggcctggtgtgtgggcccgttgcctgttccgttcagcgtctccgtgcagttggactttccacctaggcaggcaggcataggtgtgcggttctgaaagactggtctctttccacattctctcctgctctagggactgacttttgctttctgtctaaatccattttgcctggacgacgacttcatggcatccctccagaatgacttgccctgcccaactcatcatccttacacatgcctagaggccagatgatgggttaggctacggggaaaggagcacaggcaagtcttgagtgtggagatccttacagtctccttacattgattgaggctcaaggaggatgtcagcagaggtcccaccaagtcattcgttaatgactgacactaaacccctggggaggagttgtaagttttcagagaagtttctgcctcttggtaaaaccttcaaggaaaggccctttgaacttttctctatgtagtgatagagaaaagccaaacctgtaactagcctttgcttctagatgtaattctctaaaatcttgacctccaacatggctctccaacagctatgataaaaggtatgtgtaggaggtcaggaacatgtgattaaaataaaaacaggtaagtttccaatggtgatagatagacagcaagtgtcataaaaagaaggggaagattgaagatattgtttgcattaaaaagtggagtcttgtattttctccacattctgcataaaccttcctatcttaaagtacattagggtttttactctctattctgtctctctccacccctcttctcccccttccttccatcctctccttgctttctgtacagctgcctgattcgtgggtcactttgtcttcctaagactgaaagaatcaggtggtgggaaagaggggaaaggaacccgtgcatgggggaggggaggcattttcaggggcacacagattgaagtaggcacagaaggcagcagaaagcattattaccattatcatgctaatctatttacaaggcccttttattcattaatctttgaatagcagaactgttcatacagcctgaaataagaaccacctgtgcctctaggaccaaaaaataaaagtattaaggacaaatgatatgtcgaagcaggaagggaaaaattaaatataaacaaaaggattcaaagccatttcttctgtcatttagatcgtcacatatatgatttcacagctcacgtgttgcaaaatggccagctgactggcaatttaggagacatcatccaagttcagagaacagctctggggagggttccaaatgttgtgaaattattaaacagtttgtttttaaagatccaaactaaggtttttctacactaattcctattattcttttttggaagtaagcactgataagccaaatataaatgattttggttaatgctctagattccctgattaactcaataaagaaatcttttatattgtcttcacagaattcatagtaatatagaaagccaaagccggtagggatcttacatgtatgatctagttcaagcctctcattgtctattaaacctttaattaagagttctttacatgtaggctaagcccccgtttgtcacatcacacataggtgagttacattatcgttggaacagttattcttacagggagcaatgtagttcttgcaaacacttattaccctgtgttatagatacttagcaggggctgaagggagatgtagggaaaggctgcagccttccttatatcattattttaagataggagagataccaattagaaagtccactgaagaagatatttaggcctgagcatcttctaagaacaaatgcaataatagccagtggaatggaatagcttccatattcctttaggtgggactttaaattctctcaataacaattcatattaaacgtcattccctttgtcaagagactgagttctttagttctgaccaccaaaccttactgttcacaagtgttagaattatgtcgtcctagagctggaagaacccactctgaagactacccactcattttgtaaagggtattagaacccaagaaaggggatggacttgaccagtgagtctgaaccaggactggagctaggatattctaccttctagctcagtgcttttgcatctttttgatgactattttgtgatttagttctatgatgaagcattcaaaataaatcccttaactgtccatgccactgtttattcatctgtaaaatgaagattgtaatttccccattgattttttttttttttaagttcctcaagagctgggactgtgccatccatctcagtatttcccaaggcacctaactcataaagtgctctacacacagagctgctcaataaatgttcactattgaatagttgaatgaatgaatgaatatgacttttaattgggctttgcaagtgatgactccttcagaattaaatgatttttcttctaagttgtgtgcacattctcagccattcatttgttaaatatctttcaggagaaacagtgaaaaatgatgatgatgtctttggtagtatatggaagacctttcggtactgcagaggtctgattataatcatggagttttgttattgtcatttgttttctttgtagttggttgttcatgaagacctgcgaaggcctagtgatcttgagggtcagttgattttgaggttctcagtagcaggagttggtgtattcttagctgcccaagaaccctccccagcatattgctatggcattcttgtcatttgtcctgaagaagggaagagacaggaccatgctgggggaccttatctatctaactcctgttgttgtctagtgcttagaataatacctggatcataataggtatttgataaatagttgttaaatggataagtaattgctgaaggtctacttttgcttgactagctcatgccttcaaagtctataactggactggatgactgttctcttctaaaataggattttgtgaattatttgagtctatttctctgactcagaagtctaagccgggataaactcttcctctcatagcataaattctaccagttccttaaaaatctgtatctttgggtctataactcgcactggccaggaccatttgtattccacgcctcctctcatgcctacactatgagatgatggcttacaaaggcctattgcccacttatacttctcaaagcagccattcagagaggtcagaatttaaagcagagattattttagtggggaggtggtgaggagggttaacaaaattgctgttttattggatctaacttgcttttcagaagcacgtgactggcatatttgggtcattaaatataaagacattctgcttatgaattatgccagcaagatgttttcagatcatacaaaaacaatgtgtgtggtgactgccaagtagtgtttttatgtgtatgtctgtacacaccacccactgatctatgcaaggcagtggtgctttgcactaaatgccacatcgttccttctgggatctcagaacctttcataaacagtcacttaagactctagtgagttaaataaataataagatccttacccccttgaaaagaatatgtagcctacatattgaaaaattaggcaatttagcccaaggcagaatgagcagagaaagcatgacctggtgagccagacctaagtgccagcagcaagaattttgatctgtaaacattctgatgatggcagatggcagtgcggccttgagaggggctttcagtcaatctgcaaccttttattctgtacctgataagtctctggtactgagttagaagctgtgaaaggccaagtgtggtggctcacgcctgtaatgccaacactttgggaggccaaagcaggaagttcgcttgagcctagtttgagaccagcctgggcaacatgggaaatgtcatctctacacacacacacacacacacacacacacacacacacacacacacagaaatacacgaagagaagaaaaaaaaagaatctattaacgaaaaaataaaagccaaaacatgcatagtatctttcttacaagacctaaaaatcatcctttcaatttgttgagcacatcctgggtgccagacagttcaacatggaacataattaaaacattaaatactggaatacagacaatatgcagtttcggagacagagagcagttaagtttcagggtgtttgtggtggggagttgatagttaagagaaaggagttgaggctatgaactgaaaaatgggcacggttgaagtcagcagcaggacattatatttgagaagaaccaaatacacgaacgcagaatggtcagaaagaggacagcatttttatagccattttctctgcatctcagtttttgtacgggtaaaataaaggaagtgatactggttagtagtgtgtcaccaccggaaggatagctgagggtgactaatatgttcatagctgccaggatgagaggctcagtgtttcacatggcattggcattaaggttcttgggttttatgaggtcctgtttaagaatatgacactggaggtatttctttggagacttttatttgcctgtggtgtgttgtgatcagaaccactctttgggaagagagaggctcttcttggccacagggtgggtacagattagcaaatgcaaccatattgggaaggaacgcttgggtgttctggtggcccttcccctcccagactgagctctgtctaggattatcaggcaggtgttcaaataaataatgcagctaaaaatacttccagcagcaactgggacttctgtagctctgagatggtcggagtatgcatttcagctactcgagcaggtgtgcagtggctccagaaacttagaacagacacacccctgacacatcctcaacatggaccaagacctcatttccaatggagaaatgaaacaaagcatttatttcatctagtcttacctggaaacaggtgtgccttggctgaaggcgtcagaggtagagctcaaaaacaagttaatagtcattgtctaggggaagatggtggtttcagagcagtaagtggtattaatattacctgctccctgtccaggacttgttcttcactaagaagtagtacctagcataacttcagtgagaagataatctataataacataataataacaactgttaatatactagcaatcttttattaagcatgtactgtgtcagacaccatatttgttgatttaattctcaaaaagaatatcagggcaaatgacattatccccatttgcgtagattcaaaactgaggttcaaagtaagtaagtatcttgcccaaggggacacatgctttaagtcacagagttggaagtcagatccaagtctgattcctaaactgtggataaagttgtgtttccatttggacttaccacgaatgtggcatgttttaccttcttttttgactctaaatttgccatatacattaatgtgtaataaaaacttgcattgttggcattgcagcatattcaaggtaattttggagaatctaggtgttttgggcaaaagaattcatcatacacaacctccacaaagatagccatgcctggggtgaaaatcttctgccaattaaagcttccagttgtatcacatttaggaactttgaggacataactctgagtggtcagggtggggtgaccttcactaatgggcgttgttcccataggactaactctggtacatataggctcatgaggaatacctgacaaccaggggtatttaagatttgggtgacaaatggagtgttcaaaatggttctgtggaatcactgtgcttcttgttatcacatgagttttcacctggcaatgacatagaagcacatgggcagccaaactctggattgcctaggctttgaggatgagcccagcccacctctaccgcttcgtaaaatcagagccaatgacagaggttgcctgactgatggttgccggagactcagaatgcttttgactctttgactttgtgtgaatatggtggagatattgaaagactcttatcattgtggcaggaattagttttgaaaaagaggtctgtttcagaattttagatttcaaaatgtaaaaatgttgtgacttgcaagtaaggcataattttggtctcttaaaactgaaattgttttcctatttttctagttttcatagtaagtccctctcctccaagttgaatcacactcagctttactgagtaaggaggggctcaccctcaggatctggccaaatgacaacttttggctgattaaaaaaaaaagtgtttcagaattctactcagccttgctcacaggcaatgaccccgtcagatctgataaactgaacaagctaggggctaccaggagctgcaaaagagacctacacagaaatgccagtctgtgagagagaacaaatggttaggatggtgtcccaggagcaagcaactcaatgatgagccatttttctatcactctccttcaggtttaaatctggggtagggttaggagaaattcttctgtctgtgtttcattctgttagaggtagggttagaaagctcatggtctgatgtgtagagtcaattgtggaatgtgaaccatgattctgagtataatgaagttctatgacaaatatacagccagaacctggacatcaggaagtggtagccatttttacttgtcctgagtaaaagctttaggctattaattggctttgtaaatattgtctctacaggaaatcagggagtaggtatatggcatattataattacctgggggcctttttaatatttgtgcatgctctgaatcagaatttctggatacggggaggcgcaggcatttgtagttttggaaagctctccaggtgatgctatgccatgtcccagtgaattgagacctgttgttttagattactgttagtaatgttgtttttgtcttatccaatgaatatacccacattggcacactctttctgtcatcgaatttggaggtgtctgggcactggaaagcacatggggggtatgtgtgtgtctaaagtgtgcgtgtgtatacatgcattcatttgttttctgaggcacacggtctgctgctggccctgtgacaggtgatcagagcaatgtggacatggcaagcctgggcaaactcactcttcccatttcaccctgcctgcaaacagagttaacatcctcaaggtaaagctctgaaatcccacgctgaccttttcgtgaagcattataatcaagttgaacatttccagttttaccacaaatgcttgccccgtgggaaaatacttccctacattttatgacaattgattctgattttgaggaactaatttgtatcgaatgcaaaatgtccagcctcacatggaaactggaaagtccccttgtccagacaggtccaaaactgtgtttttattgtaaagacaggggaaacaatgaaagattgtgttttttgttttagaaaatccttccttcattgttctgcatacttctgtattttattttttttaacagtcctgtgggtttaatgaccacaggcaattttgtggatatctggggctcatgggaaacttcaccatgtctggattctaagctcttagatgccagagcctactggatcttttactgtatgtgaagtcacccgtactgccaaggatcctgaagtgaacatgctgacccctttgagagattcttggaaatatgactgacattttctactgtgcaatgaaagtcagcatttccctccccacattatagttctggccacaaaggaagcaatgcccctagaactctctgatgtatctgagaaccctggaggcttctgacttcatttggaagaagtcatggaaacaaaagctgctacttctcaggctaacatctgctgacataaacagaagcccctcaaggataccttctgccagtgaccaaaccgggggctcaagtgaagaaatattatcattagacctgcctccaggtctagctaatgtcttattcagtatgaatagcagtggcgtttgggcagggaggtgatgagatgcctattaaggtaacagaggtgtccaatggaacattgcttgtttagccttatgacctctgtccaagggagggcttcctctgtactggaactgtggttgacttagggtttctgcggtttccttcctgaggtatatttacagtgactgtgccttcattgcaacaaattttaggttcatcctcttgagcagggggaaggagcctctctcttcagaagcatgtcaggatatctttggtaggcatcatgttctgtttacttgaaccagtgagaagatggccgagcaagcaaggataagtgtacgtgtctataaaggtttcttctaatcctgcgagtctgtaagcattctagggttcatcggaaactgtctactcccatttctggaatttgcctcttggcatcatcatgcagggggctttttctagtcatgctttgtggtggaaaggtcagctgagcacggaggaacaggggactcactgcttttctcccctttgggcccttgagcaggcatttgactgctgcatatgaacctgggagccatggggtcttaaggctttctacttgattctcagtgtggccagaattctgtttagggcactgctccaaatctcggtgacactccatctgtaaaattgggtggcagtgtagtgtgtgtgtgtgtgtgtgtgtattttcttatacaggactggaagagaatggaggaagaaggataatgacttaaaagcgaaaacaattgaattctttgagctacagtgctgtgtcctgagagtgcagttattttccactgcagtaatgctttcaaaaacatttatctagcttctctcactttctcatttgctgtcattggtgtgaaaaatcgagttaccagaaggttcacccatgttccacaggtatgaatactgaacgttttatttagtgtctcattaacagctggcctgtggctcctccttctcggcttgactctgccctgtccagggaaatggggaatcacgcttaaggattagcagggtgcctattttcacttacagtgcttcattcctgtgttcatgttacctattccctttacaaaatatgaatgagtatctttttgtgacaggctatattctaggcactgaggatccaacagtggacagaacacacaaagttcttaccttcatggagcttccattttagtgaaagaaatagaaaataaatatgacatgatataaaatgatacactatcctatatactactaacatcttttaaacccagttttatatcttaccccctgaccgactctttacaggtcctggctcctgggcaaatggtgccctgtctgtctatgcctggctgtcactgattatagatatcttcagggcctaagctcatgctctgcaaccattttctgttacagaatcttcttgctgctcattgaagccttaatctcttatgctgcgatcaatgggtgggcacctttcccatttggatcctcattttttaatccctgctgcctccctcaatgtcatctggttccatttttctttatagactttcaggtctactgtacctgctgattacttagtggagagtgctggacatctcccttaattaattccatcgatttgaaatcccacaaggtttggggtctttagatttctgaagcagctaaatggaatgtctaaattccaaccttttccttctacaaattgttttgccacaaagttactgggagaaagtgctgtggttttatttatttgaagaagtatattaatccacagaagactctgcatgcctaactgggctttttgtatacaaaatggaagaaaaaaagatgtttggatctctctccctctcctcctctctcttcccctcctcttccactgaccatcaagattctgttcctcattcttttctttgttttggtcatttttcttctttgtcacttactttcatgatgcttatccaactaagaccatgccttagcaaccagtgatttcttgaaccctttgaagaagggtatgaacttcacaaagggtgcagaagcactgctcaggactcctttttgaagagcaactgcccagggtgatttccaagaggattcttccaaaccttatagccgtgatcttgttgagttatacatgtatgattttttagtactccctgttaacagtaagcatggaatttctgggggagagtcatcagatgtatcttagggtcatatggtttgcagaaatggtgaactttctatacagaggttcagaaatcagcatggaaaggagctttagagattaggagctcaatgctctcattttataaatgcgaggatggtgtaagggaacttgtactgattgagcacctatcatgtaccagattgtacatgtacccagattgggcattatgcatctgtcacccccaaatagtgaagtaatatactggacatattggacactcctactaaaacccaatccctttcctggcaccagactactgcttcttaaaccaagaagccaaagagagggaagagaggcacagtgcagaggagtttcttgggctaactctttagaggcttatgctccactctacctgctaagctgtcagcagttgtgaacccttcccagaagctggcagtctcgcaaacactgggaggtggccagactggatgtgcttggagcattggcagtcatcaaagaattaatgttggacgagcaggggtggcgggcatatgaaaggggttgcagggagagatagatagatgaatatacaaaccctcagtcatgccatctgaccatctgaggttgtgtgcatggtggaaggccaagaaacacattcagagaaggggcgtggacttgtctaaaaggacgttttcctttctgcctgggccagccaggcggcagagccctgcactgcctgtgactgaggaagactctgttgctatgcgccggaagcttaattttattattgctctcccctatttaatgtctgtctctcaggcagctggtgatgttttaatgaagctggaattgtatagtctgtagcgctggataatcataagctgccgagtcagaatcaaattaataattcatgaaattaaagtgtataattaatttgaactgtgcagatgagaagaagggccagagcccacagcctggaaggagctgaagtgtggggagtgtttactgaactcagcttctatttccaaataatataatctgcatgcaggttaggggtagtctgtgggtctacctgaacacgtatgcttaccagaaacaaggttctttcaactaaaacctggaatgactttcttagaagttcaaaagcattttaattgattttgatttacccttccctggccccaaaagaatgttgtttgaacagaaaatgtgatactgggttacaagtctttgttgcatggaggtcctgcagaacgtgccatcagaaccgttgcttctgcagttcaaaaggtcgtaagtcaaatccaaacattcaggaactctactgagcttccaggcccatggatttctcacccgtaagtgctctttctctttctccctctctcatatatgtatgtcatacaaacagaaaatacaaatgacttctctagccaggcttcccttggccactcttttggcttccctgggccacaatggaagaagatgaattgtcttgtgccacatataaaaatacactaacactaacaatagctgatgaggtaaaagaaaatcacaaaaaaatcttataatggtttaagaaagtttgtaagtttgtgttgggccacattcaaagctggtctgggccgcatgtggctcatgggccacagttggacaagcttgcgtctagacagtgttaatgatatgtttcatgtctaatatcttatttttcttcacagatgcccattgcaatagctgcagatttttttttttttttttttttttttttttttttttttttagtgcccattctagtagcaacaaaatgaggggaaagcaactcaagtgcctcattaaaatggggaatggtctgcaatttctaaaccactcttcctttcttgtattcctctttcaggcaaatatgcagcattcatctttgttgcctctccaggtgtgagaggcagtgtaacatccaggctgtttacataacttgcggagtgttttacaatgtactctgcagacaattgctcggatccctttattgtctttttaaagatgcctatacaggtgggtcctttttcggtttttgaatgatggatgctgtggtatcataggaaaaagaggaatctctgggttagcttttcattagaaaatccttgtcatgtttaagctcctaagcaggcagcttgaaccccccacccccttcctgcatccagtagacttgcagggaatgagaaggcaaaaccagcatctgtgattgtccattcttctttgtcaggcctttcagagttcctgttctagagggacaaatgactggaggccatgatacagactaatggtgcataagcccccaaaggtttggattgaattgaggctcagctgacttcacatttttaggtcttcagtatgtttatttgtccctcacatagcggcttgatctgtctgcctgtgtgttcacatagttaaccagaaacgctaggaggaagttgtaccagtgggatacctccttaggattcaagggcctcccgtgtaaccatgttctgcacatcagctctctttgctcctctcttgatctgcgtgcttcccctaacttgcttctgcttgcatggccttatcttctctaacgcctttctgcttccgtacaagtttcagccactggtggtttgccaaactggctgattacccataaacacacaacatggttctgttttgctcctagcaatccttaaaccattgcatgtctaacattctcagactaattcacaaatcagaaacatctgatgcccaacccataccaaatgcatttcagggcaaaaattatgctcctataatgtctggcttcctgtcttcaaggcactttgcttacatgactgaatcctcactgtgaggtgtagctatccatcatttttgagcaagaaagccaagatggataaataagtgacttgcccaagacaactagagtggttggcaccatgatgggattggttgtcttatttttcagttggtacatggagtcttcgatgaccccaggatttggaaatgaaatttaaccaccttagagcttctggaattttcttctcttgtgttcaactgaaagtttctgactgccctgggtgaattagatgttatcttactggaaaagtgttatactgcctggtttcttctataaccattttaaccttaaaagcttaatctgtttttaacaaaattaaaaataatttgtagctatagtggaatgatcagagtttgtgcccagtgtttacctgtgagcattttctttttgcatacaaacgttttggtcaacccacggttgcctcctccaggaacagaatcttttgattcaaatacattgattaaaatttacagagactatggtctttccctgccatgggtttagtgtagagaaaatgggacaggatgaggatgatgattcctaagtctacttgtacattacttgaatagctagacaatgaccctgctggcccagttattttagccatgcaaacagtgattagcaaagattgccacgtgatctgtttactcaatcatgtggcattcagccataaatatggctggaaccaatgaattaaccaaaacatcctggtcacatctgggatataaatagattcatgctaaagccacatcagggaattttataaaattgtaagcatagccacttaccacattgaattagcactacgcttgacatctattgagtataaaatagaggtctatggagtataaaatggtctttagaaagtcttctgggaagataagtatttcctataacctataatgacaaaataatgttttactagtaaaagcagctctgtacctcacactgtgaaacaattttacagttcttcaaaaaagagttcttcaagcacatctaggggatctagaggcccgtctggaacatcgaggttccagaggcacttctaggcgaaatggcattgtcagaatcccttcatgtggaggcagaattggggctcagcttttgtcttagtgctgtttttacccccaagagattcacttatgcttccataatgcaggaagaaaccttcgctttggttttctgtgttccctcagctactatttttgatcacttcattttggtgagatgcttgagcagtgcaatatggtgttacggttttgctggagctcaacaccaagctttgtcttttattaagttacacacccctagggatgaagatgttgaccctttagcatctcctgagttattgcattcaccccttggcatgctcataatgaacatgtaatgaaattcagtaattaacttacttaatttatgtattcatttaatgtgtgcccttaatatctgccttatgatctaagaaaatctctacaattctgttgtttttgattgtaagattctagaagacagggattatgcctaagtagttctatttaccattcactgtgtcacattaataaaactaaatcaggttataattcagaggaatgtaattcttatacaggagattttaacagtttgtaagtactaacatagtttagaaagttctgtaatttggagcagagtgctatagttctttggggtatgtcttctcttttgcctcatccacttgccaggtagcagtggctttttattcttaagtcttagagatgcatttagagttacatacagacatatggtggaaaggggtcttgagttgatttggggcaaaaggcaaccgtccccatgcactagagatgaatcatgcctacctccctttgtcatgggaagtggcggccactgccacatctgctatgaggctcttcgccatcgttggctgctggaaatttggatacaggtaaatggtatataaggcttctttttgcttgtgcaccagaagtctttgtcccagcctccagatcagcagtcagtactcccctctcccaacctgtaggaagtacttgtgaaaagttatctatccctggtctgagtgggaggttcttaacctcattgatgttttagtgtgacttgtctacatttgtgtgctcccttcgtcatctgcagaggatatgagaaaagaaacaaatgaacaaaaagtggagatagcgccttcctattcattcttcatttggtatggttatagttaagagaggtgagccaggctgggcgtggtggctcatgcctgtaatcctatcactttgggaggccagagtgggagaattgcttgagtccaggagttcaagaccagcctgggccacatagtagaccctgtcttaattaaaaaattagccaggcttggtgatatgtgcctgtagttccagctagtctggaggctgaggtggaaggattgcttgagcctgggagaccgaggctgcaatgagccatgatcgcgccactacactccagcttgggtgacaaaggagatcttgtcttaacaaaaaaaaaaaaagagagagagagagagagaaatagattggtgaaccattttaggccttgcttcttggagaagtgagcaagaagcccacaagtgttgaaaaggttctgcacaaatgtgctcccatttcctgtgcaaaccaataatttgcttgttttccaaaaggatagaagtaattcataattttcagaaattatttattatcattataacatttccccacaggcagcagatagcccattattcagaattataatgtattttgatttagacaaggccagaataatgaaattggaagaaatgcagaaaatatgggcattaatgttaactaaacatacttcattcaacagaaggagggaagctttctcagccaaagaattattttcccaaaaatgcgtatataaaaatttttttattcagggcctctggtttttaactttataacaccggttgagtaatttttaactgcaggatgcatctctttcccgatattctccccacccaccgcaacatatttcagtttaaatggcctgttatttttcttcatagagctgtgtctctgcatgggtgagaactacaaaaccagtcaggaggaatttgatacgccaagtgggccagctcattataacttctaggaaaccacaagataattgtagggttactgctggtaggctcctcagcattgtgttaggcgtttatactcttctctgttcaacttgcaatagccacttctcttttcagtacattttgtaggacatctgaataaaggtggttgacaagcattttcaagcagaattttcaaggcagcatccaggaatacttggtaactaacctcagaggtttaaaaaagtaaaaaataaaaatatgtggttgaattcttacagtgagtaggaaattaatcttagactgcctgcatcaaattgagcctctttattgatatgaagtgagttttccctaaatgataacctattgagagatctgctcactatgaaatggacagattctgcttactgaattaccttctgctatttatccttgtgcttctttttttccttcctttttttccttatctttatcatccaaaaacattttgtaagaatttatttatgcaaattaacacaaacttttaatatggatatcaagatttcaaagatgttgtgtaaatatgtatatatacataatatagacatatacatacatgtaactaataggaagcacttatttggcatttactacaggtatatgctttgttctattctcaacatgtttcaggcagtttatttaaccttttgaaagaagtagatatggtaggtatattattatctctcttttacagttaagaagaacctgagtcctagagaggttaggcaacttgctgaaggtcacacagcttataagtggcatatttaatcaacctaggcaggcagtctgactcaaaagtctgtgcttttgatcagtacactgtactgcttctcagtataagtataataagcaaaagacagataataaaaatcattataacaataattaatataataagtaaatattactgaatatttcctctgcatcaggcactgtggcaagcattgtacattcgttgtctcatttaatcttcccaataatttgatgatgttgattccattttatcccacttcaaatatttagaaacagacttagtttctaaacctgccccagtgttatatagctggtaaacagcagagccatttattgttggggtaaaccctggagggcttcaggatatctgaaggccaccataaatcactgtgagagtagcagaaggcaatggaagttagggatggcaggtggatcagctggttagagcatggagttagtgaatccacttcttgtcaattagttctgccctattccaagaatacagccatcaacagttagtcccagagttggtggcattgttggggaaagagattgcaatagactggtgcagatcagttacctgaagctcctgccttatctgtggcctggtgatgctgctgtgtgcccagaagccagtcatatggatgtcttgacctgtccagcacacacctcagtagtaggagatatgggtctttggaatgctttatgtgtgatgaggatgaaacagttaagtgctactttctcatcctcggccttatgacattagttagttgtgtaagattttgcagggaggtattccctcctctaccctttcgtcacaagcccctctcattcctctgaaaaggttccatactccagtccctaccctcaaagaaagattttactaagcaaaagtatctatggctctctctgttctccttgctttagctagcacagctaaactgggatctcaccagtctgacagggcaacctccaagattcacaacccaggaaaagtactgctttgcgtaagtttaatcaagaccagagcagagacaggacacaaagtcaaaagaactcagtcagctctgtccccttggtgctaaagaagcaactagaataattattcttttacagtattttgccatattttttgtctttttaagatttgccatcacccatctgtagatggtggcattttgggtagtttttatttttatcactatattttactgcatgtttacattttctttcatgtgcatgtgttttgttgtttaatgtgcaaaaacataatgcatagaggggtagcattcatcagaataaggtcagaaaaatggaggactccagtgttttttgcgattgctttccgtgtttatgtgtgtgtgtgtgtatgggcgcacgcgcatgcatgcatgtgcacacttgtatctgtgtttctgacatatgggcaacaggtctactgcaggctggactccctctctgtaggctctagggacttctccataagaggatgacctacttgacctatttttgcaagtatcttttgccattttcctaccctctgcttccctactcccatcagacatgttaatggctcatatcatcttctcctttcatcagccaaaaaaaaaaaaaaaactctcttggcttctcttctgatttcagcctgtcacttgatgaggtccctgctatttatatttttgtttgttagaagggagcgggggaaacataaataaagcccgggcaaacccaaccaccctgctggatatgaagggactccctcatattgtggcagcagggctgcctaactggtatttaagcagggaccaagaggtccacactgtgaatgccgttgaaagggttactgggaaatgcaaacaaaaacaacatgcaaatgaggctgccagcaacaggtagacttaatcagatgctgtcagatgaattcagcatctccccgattgtcgcctctctttgcctcccattcgaaagccctcatctgctccagatgtggtttaatttactgcgacttggctaattactgtaattaaggattaattactgttaattactttcacataaactcaacgccagtcaaagagcagagccttatgaagtctgccacagaagtgagcatgagctcggcggcctgtgtgagctctgcaggtctctatgtatcgcctgggcccctgctgccacgaagcttcctgaccttccagcatcaccagtgggatgggagttcaaaggtgggagaggggtcagtgctcaggccctcatagtgcgtcaactaccaggcactttcctacacagtgggcagccagaagaacagggacaatgttggggagagggcccggacaacctggacagtgatgcacgaagcaccagcctttcccagcaagtgtggaagccagtcttttattctttctctggtgctacactgttggctttgtgagctagtgaagccaacattctgtgttggtgctgaggtatgggagatgttcaccacaggtaattggaacagaaataaacttctctttttaaaacatggtcttatttttgaagtaaggaattgataaaaggatggttactcatactgcgtgtacctaattctacaaatatgaggattagtgccaccccaaatacctgttccccaacttcacatggattctcagttttgccagttaatgttttcactttttctagagaaattagtgactgtaggactattaaaaatgttcccctttccttaattcttgaaatcaatctccttctagcagatgacattgccttctagttcatggaggaagtggaatcctttaatcttgaactttctcaatctccctgtacattttcttcaaatgtatctattaggttggtgcaaaagtaattgaggtctttccattacttttaatggcaaagaccgtaattactttcgcaccaacctaatacactttttttcttttctcctttctcagtaagaatctctctgttctgcataaagatgattcctctacctgtacacctcataccagcctcctgtcttatctgtcatgccctttgatgtttccttctctgtagccgacagacattctcttccaacctagagaacctacagaaattacagaaaccttcccttgactggatctttcttagctatatacagtctttctcttttttatgtcgtctgaattctcaaagacagaaatctacacttcctcaacccactttggtcttcctttgtctccatctttgactgatatttttttctagtcagtgtcaccaggactccacagttgcttaatgcaatgtatatttttcagtcttgatcttattgagcctctttcttagcagtatttgatacttcatgacttctcagaagctctactcccttgacctctgtaatcctcggtatttttattctccctattgggcatcttttctcaccaggttctgagatattgatgtttctgttgagttctgacttcagactggctctgcatggatctcattctacattcttgttgagggatcccatcactctcagggtgtttgtgactcacccactagactgagaacttcttgatgtcggaccttgtgactcattcattgttgtatcccacaaggacagaatgccattatcaacacaatgggtccctcctgcttgatggaccatggaaccttgggtcctgtgcatctctgtgaaccaccaagggtacatagggccttatttcctgtgtcgctttcacccttgcacaggaggatttatctgctgggtatgagacaggtctttgtgacattttaaaaaaatcataggactatactgtttcaaaggaggcccaaaggaggtttgaatagcaaaattcaaacagtacattgatggtacataaaaggaatactgggtatactatgtagtatgtttttgttctatatactaaaacctgtttacctgtttgcacataagtaaggctatcttcatattgactagatgataaagctcaagtgtaaaggaaaccttaatttgggactaaggaaacagggaaattaagtttttaatatatccaattaaaatttttaataaaaatgtttaacagtcttatatttgaattaattataagattttttctgttgcattaaatcattttatatcttatgctaaacttgaccgactaaaagaaaacaacttttatgcaattaaactatttgttttttaaacagacccttttgtgtttgctgaatcggcagaaatgttctactaatttttttctgtggttgactaattagcaaatggattgctgggctttggcgtatgcatgcacatatttacgtaccaaatattgctatgttgtgtaagtgtggattcattttgtatgtgtgctctgtatttttcactacatgtttgctgactgtgattttaatggacatttgaatgcatgtgatttcagtgggtgtgcactttacatacatttcaaatacgttggatcctaccactatgtactttggagttatctcctttctcattttctccaagaatttagttgtaagcagtatgttactgaacattcagattcccagtaatggcttgaaggaagcatttcttgtatacaatgaacccgaatcaacttctgtgaataactcatttgcatttttaaaatacagaaaatataaaaactacaatactaaattagtcagctacaacctattatttcttgtctgaataattaattcacaatttgaatttctccctgaaagtgatttttgttttgcaagccatcagatagtgtgcttgccattactcaccaagttctaactcataaagttatggattgagtactctttgccccatatatgaaatggatataaatggtttacttaacaaacatgtatggagtgcctgctgtatgtcacacatagtataggccctgaggataatatggtattaaattttctgtggtgatgaattatatacactatgataaaattaataatacagcattacaatgagtaaaaattattgtttgatatattgaacagttgtttctcttgtcgttatatttacttaagtgcctggacagcatgcaaggggggaggaatagaaagatgaaattttatatgatggtactgtgatctggagagggaatattcatacactaactttctgctattactttaggaatatctctgaagtaaagaagtatggaataaagagataatattatgacttattattttccaagctggatagataagatgaaaagggaaacaaagaatactccaaatgcttctataatgcactttcaaaaatatacatctccagctaaaatttaatgtaaatgcttaatttgcttgattataggtattatgcagttatttacactatactgcgtaagctatagtgctctatagttttagctcatctataatgcattgataatgtaaatgtattcatacttttatcaccacaattatttgaaaaaatcttgcttttgtaaaatgaactgtttagatagaagtatccattacacttggcattgtaagaatgtattgactgcttagaaagggccaaaataaatatccctagatatgcataatttatatatgagattaagttatatgtattatgcgtctataaaacatgtatgtttttgctgtcgcagatttaatgtaagtatagattggtattggtctgtgcctacatgtatgtgctccatgagtacagaatcagggagttgtatataaaggcctcattgatgatagtgggaacaaagctgaaaagagagcaattgagagagaaagagggagaaggaaagagaatagtagtgattaagctagcattgttctatacagatcgctagctgcctgctattgttttccagcatttgaagatgaaacatattcatttagctttcagaacgaatggctttaataagggcagagcgggagaggtggggtaacactgatgactagagagacccatcaaggctccccctaaggccattccgtcagtgctgaggaccacatgaccattaactctgcaatcaggacaagttttcaacattccggggtatccttcaatggcagaaagagtcatttggagtcaagagaagatgtatatcagcagtaattggattctggccaaggctcttaagacagtattatctatggtgagggaacagggaggggctggacaaagcatgaggcatgtgattcaagccatagctgagagagcagtagccactacaggccacaggctgccggcacaaagagcaagcagtttgtttgctcaggagtcattgtggcttgtctatggatgtgagcaatcctccatctccagcagaaactggcttctgaatatcctgcaagtcaaaacgttgggctcaaaagatgaggccatcctggttgcacttgactagacaaagctattgaaggcctgaaagtgccccatccagcctcttcccactgcagcccctctcccctcccttcaccctgactacttcattacaatctgccttcaggccggaattgccctgcttaagcctcaaatcattataattaccattattagaaatagctgcgggggaggcattggaacaccaagtaaaaatgtgtgagtgtgtccgctggccctggaatcactctttttgagctcgggggaaccacaaggcatgagggttccaccaaagccagctaatgcgacggctgtcagctccactcaccccacctgtcaagagggggatgcagtggggttcatttttttaattgacaccttcctctctcattccacgctctctcgtctcaacctaattcctcctttcatcttccttcttttctctgagaaaaattcattcctctgttatttgaataaagaaaagggaaaaagccacagaaggaacaatgacatatacattatcctccagaaaatacatagattttaacaaaggcagaagtcaggaaatgcaccaaaagtcagaagaataattgtgaagcaaatatgaggcagacaagatggacagatggaggagagagatgtaggaaagaaagccagcaaaacaggatggaaagaaagggggaaggagagagaacatgcataaaaatcagagggagaatcaagtagagaagagctagtgagagtactgtgtttcttattgtctagtttacttctagtccttctttaaatgaaggctagagtttcactctattaaaagaaaggagagtgggaatatggtggagccaaaaaatagataacatgtgaatatgcctttgattttcagctcacaagtagtcctttctataggtattcaagagggattatgagatgagataggattcagtgccgttgacagagacccaaggagacaagaaaggtgtgtgtctaagtggattccaccaaacagtggtgcctgagcatcttcttgccttgacttttagcagtcctgagaagtccgcccattttctcagcacctgatggcggaactccaccagaaaagctccaagtacaggccatggactgacaagctttttagttcttcgaatggtcatttattttcagttagattggcacacatcacgttagtagtgtctagagatgtactggataagtcgtctaaataaaaaactaaattaggatgaaattagaaaaatatataaatatatcagagtttttcagtattgatatccattgtttttatttttgatcaatgaggtataattcacataaataattcaccaattttaagtatacagtttgatgagttttgataaacatttttattttattttacttgtttttttctttcctttttttttgtttttttttgagacagagtctctgtcacccaggctggagtgcagtggcatgatctcagctcactgcagcctctgccttccgggttcaagagattcgcctgcctcagcctcctgaatagctgggactacaggtgcacaccaccatgcccaactgatttttgtatctttagtagagacagggtttcaccatgttggccaggctgatctcgaactcccggcctcaggtgatctgcccgccttggcctcccaaagtgctgggattacaggcgtgagccactgtacctggcctgagttttgacaaatatatgttttcctctctccagtcacaatcccaataaagacaagagcattcccatcacaccgaaaggtctcctcatgcccctttacagtcaaccttccccacctccccccaaccggtgcctggcacccactgatctgctttctgttgctatttataagctcttctagaatttcattctttaaatgaaattatatggaatatagttgtgtcatgcttcatatatatatatatggcttttcatgtgtaatctaaaaataatgctttgagatgtatctacattgttgcttggcttaatagtttgttgtttctgagtagtattttattgtgggaatagaccacaatgtgtttcttcgttcatccattgatgaacatttggatcatttacagtttggggttcttaagaataaagctactgtgaacatttgtgtgcaaatctgtgtgtggcatatattttcacttctcttagataaatatctaggacttgtattcccaagtcatacggtaactctctctctatttggagacagggtctctcaggctggagtgcagtgatacaatcctctagctcactgtagtctcaaaatcctgggctcaagctatactgctgcctcagcctcccaagtagataggattataggcatgtgccactatacctggctgatttttattttcaatttttttctagagatgggatctcaccatgttgcccaggctggtctcaaaccccagacctcatgcaattctcccaaagtgccacattataggcatgagccaccacatcctgcaatatatttaatttcataagaaacaaccacaccattttccacagtggttatgcctctaaccccttctggaaggagaccatatcatcttttccatacaggacaaattaaatgaggtattacagatagtgatagaagtaggcatggctgatatataggcttcctgtgcactataaagctgtccatgctcagatgcatagttcaaattaatcattagtcaacctagttaaattgtgcagttattttaaaacaacagaaaactactttgcgaggttacatgtcacagtttctctaacatcctacttgggccacaccttttccaagaaaccttccctaagtaactcatccttacttctcatttcttccactattatttatgtaaattatattgtagacagtatttttgtaactatttagttgtttctagttggtgtgatggcttatttcatgatatgttttggtataggttcaaaattggggaatagttactgggctccatgtaccctgtgtgttcagtacattcttgagtaagcgaacctagtttccagaagctgtagtccagaaaactaccactctctcatctaaaataaaatatcttaaataacacataaggattcccctggcgcaaaccaatcatagacgtacactcgcctgcgatccagtatatgtgtttctgttcatttgcctaaaatgggctccacattcagctccctacctttgagtaaataatcatgcgataaagctcaagaaatacgtggttgtgggttttatttttccacctcggctgctgatgtgttacctagcaggctgtgttctacacagggcttggttctctctcacagcttgtggtaagcgaaattattccaagattcaatgaatacctgctattgagcggcttccctaaccacccaaactggtcttttgttagtggttattgagaggattgtcacagccattgacctacgcaattttacttcaaaagaaatgagcatttttcttcccctttcatttctaaaagcagatatggcaatttgcttaaattgctgtctttaaaagtttagatgattatactttttcccccttgccttttttcttccttttcatttaagcagcacagtgccgtctctttttctgggattggacacggttcctgctgcagggttcatgaagtggttgtgcatgtgtgtgtgtgtgtgtgtgtgtgtgtgtgtgtgtgtatgtatattatctccttacacattagtgttcatttgtctgagaactcttttcagacaaagtaaggctacgttgaactcttcgattaacattttatattttaatgctagggttcattttctctaggccccaatactagaggtttgcgggtgaaaataaaatgaaaatacacctaatggaaaaatctctgtctctttatgtaggaagatatggtagcaactagcctcagagacttaggagtaggcaagataggttacaccttcaagattttatgtctgaagaagaaacagaatttgatctaaatgtaggaagaggaaataaaaggtgcctgtgaagaactaacgctaggaacacagggaagaaagagatgaagatgaaaggttacggctagttggcagaggccaagagagcatcctattcttagacccagcaccttggatctagtttccctgtgttgcagttatctctactatgatgtgcaacaaaccatactgagccatatacttgatgccatatactttatacgtgccaaagaatatgatgcaataaatacattttaaattatagtatggaaaaaataaaaaaaaaatgaaaagactcagttctgtcttcagggaactcacaatctagtagccagactttatccctaatagggataaaggagctgtattgcaaataggccaccatatcagagtggagaccagttgatgtaaaaagcaaacccataactatctttggtgatggtaggctgaacccctcaaagctcagaacccactgataagggtttgtgtaacatgtagttagtatatttactgaatacctgattatgtgccagatattgtgttaggtgtttgggatacaaagatgaattcattaattaattcacaaaatattgaatgtgcatctattatgtgccagacatgtatagacattatcttcgctctcaaggaacttgcagttggtgtagaagacagatatataacactgaactcttttcagtacttaataagaagtactttataatgtagatattttgcttaattctatgggaagatagaaaaggggatcttattctgcccatgggatattgatatttgatcaactgttactagatgtggaattaagatttggagattatcgaactttaaatactgttaaatatggcagcctgagtaaaaatgtaaatatgaaaatcttacaagagctaataatttatgtctgtgtgaatgctcatgtttgcattaataaaggttttatttagtaattgattttccctgtctgccttggcactatgtaggattaatcgttttgcctatcctcgatatggtatagattgtgaagcacattttctaaaacataagcaaagaagttgctcaaggatataactcgaggatataactcaaggatataacccatagtccttgtggctatttgagactcatgaagtgaaggcagcattcgtgggacatgaggaagagatctctggactcatagggccagaaggactttttggtaaaattcctttttcatatgattcacatgtatgccttcattattccaaagaatgtcagacagattttcaggaatataaattgctatttctgttaagcagcctcctcaaagcagccagaaaggtcttttaagtcaaatgtatttcagatccaagagagcaagaacaatggtatactaggtcatatggtcttttggccctgccatttaaatataatatctgtacaaggaagtaactgcaggagtagtctgtatattcctgttggttggctggtgggaaggtagctaaccttttgtttctttctttttcagtacactgctttaataaatggtaacagtgctttaataagtcccctggccatcatcttacttatgatctctagatgaagaccactgtgtgaaactggtatcctaggaggttggagtgagcatgtatgagtgagtgtgtgtgtgtgtgtgtgtgtgtgtgtgtgtgtgttgcttgatttataaaccactgaagcccgatgaagtactagggtgaaaatcacctacgtttccagaggaaaaaaatgtcaccatcaattccaagagggacttgtaaacctgaaactaacagccaatggtttaatttttttaaggtagattttttttttaacatttctaggcttactatattctatctggaaaaatataaatttatgggcaaaaagaaaagctgagagtcgtagttttcatgggagagccaaacaaaaaatacccattattgaaaggcagtctttcagggattcttgaaaagaaaggtaacctttcttattcatagtgcagttacctcttgagaaactgcagattagggaaacctgtagatattttattctatctcaggtagggaaagacaagccttcaaaggcttttaatgacagggtatctgtattacttacggattggaaggcccatcatgtattcaatatcaaggatcacaaagccaggagtggtggctcacgcctgtaatcccagcactttgtgaggccgaggccattggatcccttgaggccaggagttcaagaccagcctggccaacatggcaaaaccccatgtctactaaaaatacaaaaattagccaggcatggtgatgcacatctgtaatcccagctacttaggaggctgaggcaggagaattgcttgaacctgggaggcaaaggttgcagtgagccaaaatcatgccagtgcactccagcctggacaacagagtaagactctgtctcaaaaaaaaggatcacaaaacttggttttcagtacagtagtagatccattttaaaccaaaaagtaagtacataaataaaagacacattgaggccaatatctacgttagaactcaggtatctacttaaggaaattgctatataaaaacagtccatttttagataaccttgtcctaacctccctctgacttaaaaaatgaaattggagagcggctgcttgacccaaaaaagaccacatgaagatcaatttaaccaaatttgggcttttatttaaatatctacagaatgaggttaatagtcctggccagcttgctgcttgaaaatgctagaggcatggcttctgaaagtgactgtagagcggttgacagagatgaatgtgaaatagtaatgaataacttcataatagagcagagatgtcatggctttgcatacagctttgactccaataatacgatccactctgctgaaatggggtcagttcctgacaaacagcaatgtaagccagtgaagaagattcctacagggccagaaacagtgatggggctaagccagagaaacccagctagcctaaagggggtgcctgtagtggtattttagctattgtattccttccgtacaaacacccagtcgatggctacacaataagatggccatgataatagtaatatgtattgccatgataacagaattgctaatgactctattggcctgttttgttcatctccttttctcattgcaatcttagaattttggttgactctgacatgttgaattgtgtgttttttaaatttttttctttatatctttttaaataaggcatcctcaggactcaaggatataatactcctagcccttggatccactagtttgatcttattacttgaaatttacattctactgctgctgttggaagcgatgtgtttccagtgctcacttttgcatggcactatgctgcaccccttagaatttattaagtggtatttaagagaaggtgcatcatcttttatatatgtttccaaaattgatgctaagggaatccaaaattttgtcagacagcttactaacactgtatcagttaaagttaagtctctcagccaagcacattaaaataaaattaaaaaatggtggcttaaacaaagtcatggaatagaattccagaggtgggtcattagggagccaaaggcctttatgaaggggattttctacccatcacatcaatgttccaggcaaaaaggaaggaaggagaagactagaatgggaatacttctcaactgagttagttcttttaagaagccttcttaaaactccagtataacacttacatatatgtacagttatccagaacttagtcctatggctactcctagctgcgagggaggctaagaaatgtaataatttacctgggcatattacttgaataaactggagttctgtttccaaggaggaaaggtagaatggatattggctaggtaactagaagtctgatgggaacttatggacacgattgattagtcttgattacttcacttccacatttgtcccgcagcaccaggagatacaccaggagctagggtcacatgagagggtgatggcataatttcaggaatataagaagacacaggcaaactcttcccacatacttggtgatgggaagtgaaagtcagaaattcaaaatcatgtgtctgactcaagaggggattatatttcctaggtttatttctagcctaatcttgtaactttggaggaatttctcttctctgttccatagttccttactgccttactatgtttgaattgagatatcaaaaatttctcatacttactaccaaagaatttccaaccacaatgtcttagatacgtctaatgagcaaataattattgaacagagcccctcttaactgaaacaacaataatactcatggttataccaacatttttgtagcctccataggtacccagtgcaattcaaattcaaatgcctcattagatcctctcagaactctttaagacagaggtagggtctcatctatgggagaacatcctgatctggcgggatcccctctgcatccccagtagctagaagagtgcctggcacagagtcattgcccagtaaataatttctccccactttcccataggcactgtctactcagggacataagggtcaattcaaaaaagactgcagacgtggcctctgctcttagagagttgttgatcaggaggtagcagataggtaggtaatctgaggacatttttttcagcagcataggcaaaaattgtatatatgtcccaaaccttagttgagctattgggctctcatcttatctaagaagacagtggtgggggtggtggtgggtgggaagagaaaggagggattgcgtcttggttgattgcccgtcacctgccagactctaagccatgtaatacaccaaacttacaaggtaatgtttttattctctacaacagacttgcaaagtactgtttctattcccattttcaaagaccgggaaactgagtcagagagcagcagaacgttgctgaaggccacatatctaatgagtggcaaagccgatattaaaatccatatttttttccgctatgccacattgcctctccaaggaaaaatagcaaagcaggaagtttagactatatagtgaaaaatagatggaaagcatgggccacagattgagcaatggcctggaaattagaattactgaattctctcttttctcaacactgccctgggactttcctttatcatcgcagactgtgtattaaaagtcctttgtaaaggatggagccctatacaagtgatatttcatctatataactgttatagataataacagttttatctataactacatttctacccttataaaattgggttaatattattttttcaccaaagtgctctaatagcatgttggaaagtgctcagagaaccacaaatgatgaaccttttaaacatcaccacttgtcaacgcaggaactgtgtaaagtgatttgaggtcttctaattgagctgcatcatctaaatttaaagcacccaaagaaggtagtagtaatagcaacaatatcagttcaatagtaattagtaataaacctagtcaaccagctacaggctgggctaaagcttctaagcattttctgccagagagaatttactcctgctctgaagtgtctaataaggacattaacagagctgagagcccatctgcgataggacttttccaagagccttcagaaaagtctcttaattctgctgtgtgccttcatatatgcatacatgactgaacgtaactgacctgacattgctgagttccattctccaaatactcttcccagtgcagccagaattaaatcattgagtcatgtgcctctagaggatcgttcctattggccccctccatacatggtaaatatcatgatcaaacagtcactgacctgttgctcgcacatggcccatggcatcacctagagaggcatacgattattttataatagaacattagtacatgtatatttttaaatggctattctaagtatttcaaaatgaagtgttaaattaattttccttcagccaaagaaaagctagaaaagtcagcttttaagtttcaaagtatgtagaggtatgtttcctgtgtttggcatcttggtcatgcaagaggttcagtgcagactgtatagggtatagttataagaagtacctcactcgcaagtctcagttgcttagcatgaaattcataggtaaaagtggtaacaagtagtaaaattgtaaatgtaatttgagaaagctatggtaaatagttgtctttttttcctaaactattcttttttcttcttcttcttcttcaagatggagtcttgctctgttgcccaggctggagtgtagtggcacgatctcagctcactgcaacctccacctcccaggttcaagtgattctcctgcctcagcctctcgagtagctgggattacaggcatgtgccaccacgcccggctaagttttgtattcttagtagagacggggttttaccacattggccaggctgttctcgaacccttgacctcatgtggccaggctgttctcgaactcttgacctcgtgatccacccgcctcagcctcccaaagtgctgggattacagccatgagccaccacgcctggccctttcctaaactattcttatctcgatttttatcagccctcattttgataaagcagttttatattgcttttatgtgaattatctcctatgttttacagagaattccagtggattctcatggttccagtgagtgcatggggtagggctgatggggttgctggcagaagagctattacaagatcctactcttctgatgtagggccatttgggcctcttttgcatatcgggcttcttagtaatcttaagaaaggagttcatgtttcaggaaattcttttgaaaaatcactgcattttttcatttcattctctccagaaatctttgaggagatattgttgttcctattgtgcaggtgaggaattgaggcttaaacagattgagtttccagagagtacctaactcaaaatttgctgagtaccagctctaattctgatcttctgactctaccatttgtgttcttaccactaaatactgctagttcctttttccaaatttgaaataccagtaaatttgagaatgatcttttttaaaaaaataggcttaggctgtagagagtactatgtttgtaactctcctacttatgtaaatttagcatctgtatatgtatgaatcatgtatatatatatatatacacacacacacatatgtatgtatgtattttatatacatacatatttcaaagtacaaaaaggtagactgaagctattcacagaagataactttggtcatgcttatattcttggcctgttatggatgtaacataacagtatgtttctgtatattttgtgttctgctagatagactttaggttagaacagccattgactttgtgtgtccttaaggaagtaactgtgtctctctgaatcttgaatgaccacgggcacactggaaatgaaagtatttgccagtttccacatgaaaagtgagtaaagcaggattttgcttgctgtctcttcttaggctcagggttagagcaactgtaaaataattaataatcctctcatagaaaaatttgctggactttaatgatgcttaagtaatctaggactcaacctgagatactatgataccaaggtagtggctatctatgcattcacagaggaattgtgtctagccctagggtatcctggggctagacagctttagaattttgtttagattggaggttgagagctagaagataaaggtttacaaattagaacagcaacattttttaatccacctcccaattatacacaaatcatgagtatgcatcataagtaaatgatgcatgccaagcagttcatgaaaagaggtgtacccactattcttactccaaaatgatcaagtttagccattgtgataaacagtatgggcaccattcgtgtttttgcttttgagtttttgtttgtcaagccacagctaattatacaagcagactagcaggatttgagatgcaaagtgttaaaactaatagtgtatgtcaaatcctttattaaaaagtacatgataaagaaagatcatgtcacaccataaatagtaattgtacaatacaaaaggtgtgtgtgtctccagggtacgtggagagccagttcattgaggttcgactgactttcctcgcctcacgtttcctgctggcttctagaagcagtcatgtggatcagaggccaagagataattaagtggaaataagaactctatatccggcctctttggaaagaggtagcaaatcctcctaatcaattctgattcctgccggctttgttgcctaaggtcagcttaacagtcattagaagaggtcacggcaggctctgtgatctctatcatctaaggttaaataatacgtcattaaaagggtcaatcagaaaagagcagattctttccctgtgattcacatattttgcagaagcttctggcttggaatttctatcgcaagtttcaaatctcacagcagaaatgtttacacattgcagtttggctgaattcagaggaagctttcctggatctctgatgagaatgagaattgtggtcatgggaagcatatggccatgacattcatcccttactcaagataagctgaggagcaaggtcaacacattgcatcagacctcaaatgaagactggaacatatcaccctaaccgcatgggactaggatggggtgagcactggggcaggagcagtggtgtgtgatggaggggtggaggaatctttctccactccaagatgggatcagaaatgtaggaggaagccaaaaagagcaagctcaccactcttggcatattttttccaccttgacattgatagctagacctcactcctggttgggaaattttctaagctaccaagaataggaaaaaaatcaaccataactaaagccctttgagatattcttccttgtcttcatgaacaggacaatattaaaacattacagaaagtctggaaaacaaagggaaaaaaaagctgatagccctgcccttcaaatatacaactcattgcatttttagtaatgccccctttcagtttttaatctatttgcatatataatatattagctagctaaaattggaacataaacaatatatatcttgcttattcatcttacaacttaatacagaaattttctgttactttattactttttataattatttttaacaactgcttaatatttctcagatagagttttaagtattattaccctacaaataggtgaaagtaatgatgaatagcatttagtatagccagtcctggatagacacagaaagaaaatgatacatttttgtttttctcctccttcaaattctgccaaatgccactcatcagcaatataatagtgaaataaagtccatattcaggtatttgatttggagttgctggagatttttggtagatttaattcttcacatgattaacccactgttattagcaaggcttggaccctttgaccacaaaaaaactttttagaagtacagtagctgggggatgattggatgggtgagtggatggatggatgggaggcagagcaaaagggagagaatgaatttgtcattgatcaaagcactgtgcatggcttaggagaaccgtggaccaagcaggcccgtatagatgatccaccctgtctgatggtgattaccagcatctgacagatcaagaggatgtgggaatgagggtttgaatgaatgcagatattcatcgcttgagcccaggagttccagaccagcctgggcaacattagtaagactgtgtctctacaaaaataaagtaaattagctgggcaaggtggcacatgcctatagtcccagctacttgggaggctgaggcaaaaggatcacttgagcccatgagttcaaggctgtagtgagctatgattatactgcacattagcccgggtgacagagtgagatcctaactccaaaaatcggaagaaaaaaaaaaagagctttcaaactgggggctagttggtgtgtgtgtgtgtgtgtgtgtgtgtgtgtgtgtgtgtacatgcacatgtgcattccctgaatgctcattgctaactgtgtgttggcctttcttactaaaatgcatgtgtatatgtctttgtgtatgtatgaaatatctgagaatatagtatttagaccccattagtgagggtaaaaatatacagataaactatatcatttatgattctgatacggctactgtcaaaataacacagtattttgacagctgctttatctttactctcactgactacaataagaaactagtttcttagcaactaaaataaattctcaatcagagcttaaaaaaattttttttaagcccacaatagaaaaaatagacccatagttggtgtctaggcaagctattcctattgagtgggaatgaaatttatctgaaacattctgataccctttggctggtccagctgcccttggttagcaccagtgggggcagagacagtcagaagtagctttcaggaggcttgggaaaaatgttcattgttctttttctttgtttcagtgggttctttttaaaaaccatttcttatgttatatactaggctagaaagtactataagaactagtacataagatctggaacagaaagcctgcattcagatttgtcttcactgtgacttgtaggcagtggcttatatatcagttaattagccaaaatgatagcggtagaggctggggaagcaaaagagaaatttagctacttcaggcctgttgtgttatgtctttaaaacattttgaaaccccctaaggtaacaatttttaaatagggtctagggatccccaacatttccagggagactatgaggtcaaaagtatattgataatgattttaagatggtatttgcaggctgggtgcggtgactcatgcctgtaatcccagcactttgggaggctgaggcgggcggatcacttgaggtcaggagttcaagaccagcctggccaagatggtgaaaccccatctctactaaaaatacaaaattagccgggcatggtggtgcatgcctgtaatcccagctactcgggagtctgaggtgggagaatcgcttgagcccaggaggtggaggtggcagtgagctgagatcacgccactgcactccagcctgggtgacagagtgagactctgtctcaaaaaaaaaaaaaaaaaagatggtatttgctttatttactctcagtcttttatgaatgtgtacaatggagttttccacaggcttcatgtaatattgtcacagactgaatgcagaaacaagagaatctggccatcttcttttaagtcagaccttaaaaagatttgtaaaaatgtaaaactcactcttctcactaatatatttgtttcaaaaacattttttatagacatgggttatttatgttcaaatgtaatgggtttattgccccccttttttttttttttttttgagacaagagtcttgctctgtcgcccagcctagagtgcaatagggcaatcttggctcaatgcatcctctgcctctgggttcaggtgattctcctgcctccgcctcccgagtagctggggttacaggcgcctgccaccacgcctggctaatttttgtatttttagtagaggcagggtttcaccatgttggccaggctgatctcagactcctcacctcaggtgatttgcccacctcggcctcccaaagtgctgggattataggcatgagccaccacgcccggccagtttattgcttttaaatgaattaatattaaaaaattctttagtctcaaatttatgaatattgataaatatgacctatataaacagaagctatttggagtcctcaatagttgttaagaatgtaaaggggtctcaagcccaaaagatttgagaaacactgcttctaaaaactggctgtctgtacctgtgtgtgattcataggtttggcaaagtcaccaacactatttcctttcaaatgccaagggagattttaacgtggctaccaagaaacaaacaagcggagatgtcaaacagttaatgtgtccatttagacccctttaaggttttgtgtgtgtgtgtgtgtgtgtgtgtgtgtgtgtgtgtgtgccctcagtgcttagatatgcaggtagatagacacttagctcttaagaaaggaattcatctctactcataatttccttctgctggtgccatggcaagtgcatttctgagtaaagtagtctgtgtgcataggtgccaccctaccaaatactgtgagccagattgccattctggaccaagatctgagaaggaagacataggggagaatgcagaatgtggaaggaggagaggaggggattgttaattaagctctattaaatattaattgaaatataaatttaaaacctcaccaactcctgacagttatataatctaattaagtggtaggtcctgttgccccacagtgtcttttggtgtattaggggaataaagtgatcttcttctcataaacactatgagggctttattaatccaaggtatttgccaataaagtagatgggaaaagtggcaataataataattttatggaacatggaagaattgaaggggcaattttgatgtggataggagtgcagtgaatcagctgcagtgatccacatggaatctgcacgctttggcctgtcattggggtaaggaagatgaagtccttgtgtaccattccacatttacatgtatattttttgctcatggagaatgtatattgaatccctgagaccagttttaattttataagctgcctttggtggggaaaatggtaagtctgtgcatgtgtgtgttttataatgaaagtttcaaaagaataaaacctggaagggttgtggagatgaatttgatttcttactagcaaacatgagtaagcctgtattttgcaaattttccagcaacggggctgttggagaatagtgaaaacgatctgaatcttttatctgtgctgcaagagaaaagaacctctacattcatttcttttttggctctcaaaagttcttaatggaaagttaaaaagtgcacaagattgtctttattttttgtttctttgaattatttaataattttaaaaaagtgcacagcatgtagttctgagatgttttaggtggtgtaactaaatttaaaaaataattatcatgagttaagtcagcaactcttagtctttatttttgaccaggctctagactaatgcatcattaatttctctgcataaaagcagggctatttaattctccttgttatcttatttgtcttttgtttgggttttggtagttgttgtttctcattattttgtgtcaggatttcgttatatcccctcattttctattgctgttggtacattagtccccaagtttgtgagatgctatttcagttttagaaaaggagtcccttggaattaaaaatggagtttgcaagaccacacttgacttcgtgcaggtcggccagacccatttgtgagtaacacagcccttgcgtggttttgacctttgatttgtggaaatgagagtggcttctccttccccagggccactgtggctagctgggcttgggggacgagcataatataattgtgtcatggattgctctgttactcctcgtatgttagcaattttattgtggtctcttttatttccttttcaatttgggccccggcagtttcccaaaggaatgtggataaaggctctcagtgttggaaacgggaatgatgcagttgagcagttgcctcacctctgaaggtggcaggagtagccgtgaaaggcctctgagagaagagatttctgtttagtgtggtggagaaggggtcagtactctttgttgtcatttagtatgtatcgaggagcagcgtgttcccttggccactggaagggtgggcttgggaagatgtttatgtatctcggcaaaggtggactgagcaggtgggggacttagagcctgtcctaatctctgggtgatagtgtgtgcccactgccctgctgcctatgtgcccggctggtgtgtggacgggaactcagacccatgtgctcatgggaaaaagcagaggctgggcttcttttgagaacttggcaaaggcttccctgttcactttagagtgtttcttttcttgaagccagtgctggatcttgggtctgtgctgctgacgttttagaacatgagaaagagccgcagtaggagccaagtatctgccagactgtgtcgggagaacctttatcatttctgtcagatacatcacaactcgcttgtcttaccatacatcttcctaaatgtgacagaatattcagctgttattaattgaatactctctaatttaactgcttagcgggagaaagagtgactggtttgtttcaacacgtaaaactggcatcaacctgtctgtgggtttcaatgctgttgcattgcagggactgaaaaagtgactgtgtaaggagaaggggttaccctacttttttcaacagggtaactaaattcagtttattgttctaaaacagaggggtgtgtgtgtacgtgcgtgcacgtgcgtgcgtgtgtgtgtgtgtgagagagagagatgaggataatacagatcagtttatgggcatgatatgcttcgtgatttttttgtgttaagtatgttgtaggtggtactccagctcctctgaagtttaacttacctagaagttgacactgtgttgtgttcttttaatcaaaaagcttaaaataatgaacttgttttgtctttatctttgtaatcaataaaatgtaaaaaaagagccctacaaatttctgtataatattgaatgtggtgctaagaattaaaagccatattgatgaaataaattaaagattaaaatataaggagctaagaatgaattttgagagtctgcacacaactcctctctccttggacctttgatggaagaacaaaagtgagtcaactgtcagcttctccagctaccctagaaaagcaacagaagattccaattcattgatctaggaagaatctaggctgtgaactagacatcctgctacacttgtgggtattttcacccttcttgcccaggctggagtgcagtggcacaatcttgacctccgcctcccggtttcaagcgattctcctgcctctgcctcccaaggagtgggattagagccatgcaccaccatggccagctaattttgtatttttagtagagatgaggtttctccatgttgttcaggctggtcttgaactcctgacctcaggtgatccgcccaccctggcctcccaaagtgctgagattacaggcatgagccaccgcgcccagccttttacttgtggttattttttaaaatgtacttatgtatacataattctgttgttgttttaaaagaagatataaaaatgtgctcagtgccagaatgcctctaggttcatatgcagcattttttttttaaagaaatgaattcaaagcacgataataagtagaagcctgacttggcttgaacataacactctgtcggcagtgaggtaaagtgaaacaaaagacagtgtccccaactctgccatgaaggtcagcagagtgtgatgtggcactttgcagagatggatgagacttccaaggctgaggacaaggaagagcatacctgcagtcctttcaatcgcccatcatgggactattagcttgagcgttctggaaaatattattacccccagggcgccatgtaactccctggctcctgataagctgccaacatggctttctctgggctgcaaagttggagctcccctggcagggtgccagggttttaagaaggctctgggggcccaaggtagcctcctggtgcaagttaacattcattgtaaaacccgattcaggaaaaaaaaaaaaaaaaagaaagaaaaaaacccttcccttgctttcccctctgcacagagctagctggcatacaattaatatctgtgctggcacgttgccccttattttaggggctggcttttgctttgggatggcatggagaaggggattatttgcactgtagcttttgatgtaagccatcattgtcatattatatgaatagcaccgcgtaaggatggctggggacaaagaccagtcctccatcccttcctcacactgccctatgtaacccaagtccttgtcacaaaagggctgtctgattttttttcccctttaaaatcttatggaaaatagtggccttagttggaaaccttaatttttaaaaagcatcctttaatttgggcattgcgaaacgttaaaaattggaaaagttgtttttttcagagataatttacacgtttgtacacagaaatgctgcacacatatgcttataatcatatttataattactttttctttgttgcaatttaaaaaacgtacacttagttatgaggtcttaaggaatgctaacattgcatatgtagtcatagaagaaaaaggcatcacataaattttggtaattcagaatggaagcctatatcatgaaaataccaaaaccataaaatctacttacttgaggaaaactgatttgagaatatctggcatgtttcttagctcactaagtttagtgtttataaaacaaatagaagataatgtttttagtagactctgggtgtccgtatacatatgtgtaactatacatatttaggctttatcataatgtttgaatggagaatgcttaatgtagtaatatagcaacatagcaaaaattctaaacttcaaatatacaattcaaacagttgtcacagataaaggctagataaggagaaaaaaatgtatttatgaagcaactcattaaataactcagcattcttagctctgtgatgcattgggagttgtagggaagggagttgggagctgaggaagtagaagtggtatttagtcatatttctgaaactattctggatttttgttttgtcaggagaaagatgcaacaaatatttatagggcctcccattttttttttgcaagaggagagcagaggacatagcaatgaacaagagagaaggtatcattgccccccatggaaactgggtttttataagggagacatataaaaaatattttggggttcaaggatgtaacctgatggggaatagtgatatttttgaaaagctgatcatgacttgtaaagttcaatttcagagtactgatgagaagaaccatgaaatattgtaatttttctaattaacataacacctggaaatttctaagcaaatgccattggaaactaataatatttggtcctaatattgaagtcgtatctattcaactcactgacgattcacattttcagttactgtctgaagtttgaccagatagggaagatcaaggggttccttaaaagaatgttaagtaacaaccccaaagtaatgttttagctttcaaaatactgaaagaggtttaaggtgttatcttgtccaccttgttaatcatataaattctattatccctttaacatgtctagccaatgaagtcagtgttttccatctgcagtcaattgggtattgacaaggaataagaaaggatttctaaaatacatttttttcaagctaatttcagctattattattattattttttaatctctaaatcatgctgttactatttcgtcacccagcatgtttccattaaggcaatcacattaggttgggttgacccagtaaaactttttatcaaccaccaggccaattcagactgcagccaaagctatgttctcatctttggtgggctggtcaaagtgaacctttggatctgataagaccaagtacatactcccatgctatagtgttttcactaaaacacttttagttttataatttaaaattgtacctcatggcattggaggtgattagacttttcctacagatggaactgtgtgttggatctgatttttagttgggcagcaaacctacccagaaccatctacttgcccagttttatccttacccacagccgcctcatatttctacagcactttatgtttcacagtaattttccctccttgattctacaacttctacccctagaaacctgtgttattttcatcccttacagaatcacagatctgtgagcggaacgttgtgttcacaaaatactgttgattattttaccacttcaatggttgtttcagacaaccacccttttcttttcattattgcttaaatatatcagtgcatggtgtcatgggttacagctaataaaaatcccactcgagtgactgcagcctggcttggtgggaagtgacactgcgagctgcaggccgactctgaagaggcaggttttagatgtgccatgatgccagggattgatcttggctctgcagagtggaggacatagagatgatgcgagcatccctgcctaatggtccccagcagaggatgggtggaaggtgacttccgggttcatgctcaggtggaagctgcctgccctcactgccttcttaccctgtctccgtcacaacctttcctatccttcccagtgaccagccaagggcaagacaagactgcaaattaccatctaaaagtatacttggccccttcaaagtatgagagttagatcactttttttttttttcctcatgctcctttcatgctccttccagccaagaagctggaaactaaaatcccttttcttttcctctcaacttagtcaattccatagcatgagctgagtgcctgttgtgctcacctagcatcgtgtctggcacatagtaggtactcactaaatacttgctgaattactaaatgcatggaagttccaggatccagtgggagtgataaaggtaagggaaaattaaggcaagcaaaggcaggaaaaacaaatctctgcttaaaggaatcaagagactggctacccttggagatagtaactgtaaagggtttggctggggcttctgtgtgctgctcataatactctcttgatcccacttctggagactgggctgcatgcactatacaaaaattcactgtacagctgtaatgtatgtatttctacttaatatagtttatcctactatctaaaaaaatatgcctttaaaggatagtgtcggttctcaagtaccttaacaatctttttgcaggtgagggtggaaggtgggtgaagaaaccaatatacaggcaacgattaggatcattatttggctcaacccccattccagtaacatgctgtgactgcaggggaaagaatggctcattccaagctctgcccttatgtatgccattaacatagattcccagggggtgggtcaccttctgagtggaggcccctaaatctaatgcccaaggaagccaagactccttgcaccccgggtgacacagaatcctgggtggctggttcaggagcttcatgtgctagctcccatttatgatttcttttttctttttttaaagaaagaaacataaggaaaacatttgctttgacattgaatccacccctacatgtaacagtaattgcagggcctagagggggaaagaaagtatcattccaatttggggccaaccagccttgacaatattgtgttaaaccttctgaagtggtgaagccaagctgcagcgaggcaaccctggcacaggtggacaatcggggacatggagagctggaactgggagacacttctggagtcaggacacgtaaggagtacaaaattactctttggggcactctcagggaagacctgtgcctccaggcctggcccttggttatggcctgtgctcctgactccttaggaggttttggccatgagctaatcagatgcccagttcacacagtaagatatgactgcttgacctccacatggagcccgactagatccccctaaaaaccacagttgtaaagctctgtagaggtagtggcctcttcaaagtccccaagcacgcagccacacgtgctttctcctccagtctccgtgtgtctgtaaaagttcaaatactgagtcaagtttattgtttctatctcgtttattttaagtatagttttacactttattatgtgcaatgacatcttaaatggagcctgtcactccgtcttgactactgctcggggctggagccacttaccatgtcacacattcagcagccctgattaaccgaatcagaatgagcagctccatctccaccctctccaaaatagtgccccttatttatatgaagcaaaatatgagaacaacaggatcctgtatctaaagtgggaaggtttccaagttgaggaagtttgggatggcatttccctcccttcctccctcccacccttctttgctccctcctttcctccttccatccctcctccctccctccctcccttcccttccttcctccttctctccttctttccctccttccttccttcggattttttaaaacatattttgttatatattcactctctttaagaataacactttgtttggttaactcctgccccccaaaacaacaacaataaaaaacaaaacaaaattttacaactttcttttcttcttctctcgtctgtggttgcaagtcagtttttgtagccctgtcattatgtgaggtggcctagagtaatttgaatatttcattctcccggctgctaatgcagcatgcgttacagatggtacttgcttcatccttctggacctggttcaattataaatgaaagtagggagctgagatttgtctttttgtctctgcttagttggaataacacaataaagcttgatgggtaagaatttctcaaactgcctctttttcacctcggacatttcccaattagattgctccttagagtacttggtttgcactcacgtttggagccaaatgtataatcattgttgttatttttggatactttctttcctctcacttggaataaggctgtattctaaaagtataagcaacctctgtctgcctgcccccacccatctttttctttttggtgtctatttctcatcaattcttagcagtgactgcatgatttattcaagaatcttgagtaaaaccacttccctcctccatacccttaaaagtactgtcccctcacatcacactacttagggacacattggtggtcagggaaaaggatttttcctcacagtaagatgtgtctgctcagctcactaaatcaatatataaaaatagaacacacatgtagagcaaattatgcaaatttatgagtataatcttacatgcacatatttattagacactagtagtattttaaatgtgtttgtgtggaggagggtgtgtgtacacacatgccaaaaggctttgggtttggtatgtttttggacattctaaaaaataaacattaaacatcgtctttcattgggacattattcttttttttttttgagacggagtttcgctctgtcgcccaggctggagtgcagtggcgcgatctcgactcactgcaagctccgcctcccaggttcacgccattctcctgcctcagcctcccgtgtagctgggactacaggtgcgcgccaccatgcccggctaatttttgtatttttagtagagacggggtttcaccgtgttagccaggatggtctcgatctcctgacctcatgatccgcccgtctcggcctcccaaagtgctgggattacaggcgtgagccaccgcgcccggcccattgggacattattcttatggtcattttagcaaattgtaaagcttgctatttagttcaggctatacctttatttggatcagtgtgagggatttttttccttcaacctcaaatttatgatcactaagtgttgggcaaatacagtactatagatactcttagaagggtgactaattcaaatatctaccagtaatgtcaaagaaggggggatgaaccaactatattctctaagattaattgatattgtattagattacatgggcgctccaagaagatcaatatatatattttttaatttcactttgttcctcacgtactgttggaaaccagctttgcagtgtgacacctgtgggctcaacattgtttcacccttattttgatgacctgcccttgtaaagttaaatagaatataaattgatagtatctcctagcctcccatggttctataagtttaagtcattaagatgaagaataaagtgtcctacagagaaattgccagcttaaaagacaaagtgttggaatgttacagtaagagctctgatgccctaggtcaatacaggttggcagaagcagcatagtttagggaactctgttcttttccgatgcaatttgcaacagtcctcagcccagcatctcacttgtttttcctactatgttaaatgtgatcctacctacccttagagataacagtgaaaattaacctaaaacatagagccaagtctttcagcaatttgacatactttaaaaaatataaagtgtgcttcattttcatatcagcttatgataacccaccttctggaaccaacctggtaattagttatctgggtctgcagtgtgcagtaggtccattcctccatgtgtctctgtctatcttgatttctggctcagcttctgatatctaaatgatattcgttgagcaatttggaacctaaatggagttagaaatgctattattccatatttttcaagtagttaaaagaacatctttgtagcaaattttctaggaacacaacaattagaaatgtttaataacctgtggtcactttcttacaattaattatcttgaactcattttctgctaatatcaaatcttgccagaataatgaaattggagttcttattttcagctagttttcatttgtcaatcattgacctacttttctttggaaatttgtaataaactgaaaaataatagcagctgtactaatattggtataataatttccagtgtaccaagtacttttcatgtatattatctcgattttgatatcatgataattctaaagggatagcttttatttttcttagtttacaaatgtgaaaacaaacccagagaggttaaacagtcaaaatcacaattcaagtccaatgtgaatgtattaggattaggttcaaatgtgagtagctgaaaccacatccaccccctttcaaaacataggaagtaagatataagcagttcagggctggcagagtggctccatagaccacaaaaaacttaggctccttcctgagttttcactcagtcttccctaaaaggtgatcctgtgtcatcctcgtgatctaagttgactgctagagctccagccattccatctgcattccaggcatcagaatggaggaaggggcagagaataactgtagacttattccttttaaaaaagactttctagcataatacttgtactaccacttgtatcccatcagttaggacttagtattacgactacatttagttacaagggagtcttggacatgtagctgggtaaaaatgttccagctcttagaaacggggcaagtttctgaaatgtcactgcacttgggtttagctacagcctacagattttccctaaccaagaaagatagaccgaggagtcattttaattgtctagatctgatttggaacataggtgtcatgttatactagagaatctggctgagggcaaaggcaaatcttgatcgtattaataaatgtttgctgtattgggtgtaattgtacacatttgcagcaaggcacatccaaagaggaggtgatgtacttcccaagcaacagcaacactgaaaagggactgactccaatcatgccatggtgagcaatctgtggagacaagagtgaccacaaactctgaaataaattcataaagattaatctgtgtgctccaggctactaaattcacattcccccttggtgttacttcctacttaaactttaatagaatggtttataggattgtggagatttataggatcaattccttggttatttggtggccagtggtcagggaacctaaatgccgtatatgacctcagtagatagggcttcttactgtcaaaacattatttctggaggaaaaaagaatccaaattcccaagtacctgggcatatactttatgctctgtaactcttgtcaatgagctcagcaagtggggtgttttccctcagttctttgtcttctatatcagttgccctaaaggctttaggagttacaatacacacacacatcatacctcagaggtactgatggcaagtagctatctttgatttatttgtattttttaaagaataagatgaaaatagagcacttatatgttcacgacaggaaggattttgtgtgtatttgtgtatctgtataatatttcacattgtatatcactttagcctcttaatatgattttccttaggtcacaaatccatatagaatatttgacagtgtagcttgctctaatatttttgttgcagtaatgtggggatgaccacattactcataagtgagctctgctggtctcttcagaatgtcaggagaaacttatggtgctgcctgcaccatcacatattttatttagaccacagatgttcagtctcataatttagttgtcttattttgttacattttcagctgcattttttctttttcttatcttgcctttataattttattggaatttgtctagttatagcccacctacatggaaaaagactattatttgtggcaacttcggcccacaaatctatatatataacttgaaatgcgtaggtttcttatctaagaaacctttgcacaaccctataggaaatgtagaagtgtgcatatatctttaccattattgcagctactgtttcagtagtttctgttggaacatttgcaatgacttccaaagataatattcttctaatttaagactttggtttggtttttataagccaagttgtctttattataattctcctgtgaattggtcttctttgggaaggaattttctagcactggaggacaggtttccatatagttataggttaaaatacccttcctccaccctcacctttccagcttaattgcttctgtcagcggccacatatatggttgtcaacagtttacagacagtgatttaaccctcagttttagaaacatatagaggtgatgtcttgacaaaaaagagcaagcagtataaagatgtacatgtagccctacctacttccatgatttttgtctctgcccagcaagagtcagtgttatctttaaaaacaaattgcttctggtatatgtgcgataacatgtatgtgtgagattgtgcacatgtacatgtgcagtggagtgggcatcaatgtattttactgattgaagaacacagaataatttctattctcatttgttttggaaacttggaacaggaagagggaacttggcttcatcaatgaagatgattggctcccgataatggctcccttctggtgccagatttaaggcaggaaaaagcaaacagctgttcaaaatgactttcacctagtaaacacaggagagaaggcagctaacacttactggatgccttctgtgtgcccagctttagtctaattgctttacacatgttaactcatttaaacctgatggcaatcctgtgagataaatgtggttctccccagtttacagatgaagaaacaactgaggctttgagaagtgaactgactctcccagagtcagacagctaacaagaggcagaggagttggaatttaacttaggtctgtctcattataaaaccatccagtttccagggtaccatggaaacttgtgtcactgtgagtcagatactctcattctgtcagggtgtgaaatgccccttaaaatactgttatgtgaaatcatagctggtggctttatgcactatcctcactgactctgctaaccttgtttgaataaattaaaaaatatttatgaacatgtaccatgcccctagcaaagttctaaatgccgttgggggaaaaaagaagggtaaaatatggtccctgcccttggatgggtaactctcatttggcaatcagaaaagcagtacatgcagcagctgatggccatgatgatatttaataaatttgtgacttgggtgacaacagaaactgaataactgtatgacatcattcaagcacaaaatccagaagctgagaagggggagattagtatatgctagggtgaagggaatctagaaggacagtttaaatgtggctgcatggaaggctggaaggaagacttgagagaaacagctggactgagcagtgattgtagaaacataaagtgtcatcattacagatttaagaagagtaacatctgcctggcactttacagtttccagagcactttattttcttatttctattttctctcacttccattattattgttattaatcatcatcacccctgctttacctatgaggaacaccaatcaagtaccatcccttacacatattgtgccctaggaagggctcctgaggaaataaataaaagactctcatgctgagagagaagcagcaggacacttgctcatggtcacacagctagtgagaagcagagacttggccttatcccacgccctctgattccaagtttggataaaaaataaaggctttttctagagttttatattccttatcaatggcttccagtttacaaatgggttgtattccagaaattttcttttctttccttttcttttatttatttatttatttatttttttttttttgagacagagtctggctctgtcacccagcctggaatgcagtagtgtgatcactgcaacctttgcctcccgggttcaagcgattctcctgcctcagcctccttgagtagctgggattacaggcacgcaccaccatatccagctaatctttttgtatttttggtagagacggggtttcacgatgttggtcaggctggtctcgaactcccgacctcgtgatccgcccgcctcagcctcccaaagtgctgggattacaggtgtgagcttttatcctgttttttttttctttgcaacctataacacattttcaggaagtgtcataaagctagattccaaggtccatttggacctattgcaaaagagaatatgccttaactgtgacctgcttattctgttttaattatgtctgttcactctttacaaaatagttcttaatacaaacaatacattctgaggcagggcagactatataatttgtgggtcccagtacaaaaggaaaatgtcaactcttcattcaaaaattaagtatttcaagatggcgtcatcagagcatgaaaccaaacacggggtccttctgcatgaggggccctggggttccacacaggtctcatgctcacaaagccagtgctttggtttagaatacaaggaatacctttttatcctagaaattttatcagagagtgcgctggaggcatatacatgtgcggggcccggagaggaggagtggacaggatatggattggatatggctttctgcgtccaactgcactctactcctaagtaccaggaacgtgttaactctcagttgcacaaggaaaaatatctcttgataagtcatccccaaagaattctgatttggagcaaaggggaggatgtaaaagtgggaggtagtacaaacatcaaaaaaagaaaaaaaaaaaaggctttctgtactcactgccaactcagatttggttcattttcaagtttataagtttattattataagtgtagataaggctcattcttatgtagaggtcccagtaccttccacatatatttctggcacagaaaaacagatgggatagaaatttacacaaaaatcacatctgccactctggacaattaagcaaaacatgaaattgcaactaaaaaccacagggtatttaaatagaacaagatttcaaatgaaggactcatgttgttgaaccagaatgtggtttaactctacatcttctgaaaagggaggatattttttggtctttccatatatactttttttttttccacatcagtagatgtgcctacttaacgaaaacaacttttctcattcagagagaggctaagccaaaatatagtactctttcgaatcatattatctgaagggacatgaaaagggagtaaaaaaaacctaacattgatttcacaccagccatgtgctaggggctcagcaaaactgcagacagcaagtacagccggctttattttacagttgaggaaacaagctctgagatgtcatccaaggcctcccagacaataagtgctagcttgggacttaaggcttgaattctaagtccaagcttgtattcttcccacacaccagactacccatcctgttctgaattccaacacaagaagcccaggacacagaggggcacagggcctgcaaagcaatccagcccctcaaccttgcaggaacccaatcatcaagaggggagaccctactattaacattctctgggtcctcatggaggctgagcactgctttataactttgcttttgctcccttaaatgtttcggaaatgtgacttggatttatagattgcaacggctttccattgtgtgaaacccagtggttcccgatagaatggttccagccagcaagaacagttgccttgtgctgagtgtagcggaagaagacaataattgacagagaagcatatcatctctttctacccagtgtacccaatccactctgcctcatctccccaccatggacctggaatgttgtcaacctacttgtgtgagataagaaaactctcattaagaaatccattcatcacgcctgtaatcccagccctttgggaggctgaggcaggcagatcacttgaggccagtagttcaagcccagcctgggcgatatggtgaaatctgtttctactaaaaatacagaaattaactgggtgtggtggcacacgcctgtaatcccccagctactctagaggcttaggcatgagaattggttgaacccaggaggcggaggttgcagtgagctgagatcacaccactgcactccagcctgggcaacagggtgagactctgtctcaaaaagaaaaaaaaaaaagaggaaagaaggaaagaaggaaggcaggccagccattcaaattgattcgaacatcagattctttgaacttgcacatgtgatgtggtttgactcccttataaatacatcgaatttggtggcttaaagctttagagtggatcatgaagaatctcacaggggtcaaatgagactctggccccaaattatggatctgtacttggggtacattttctttcctggcccctacaaaggtgagcagaagacacatttcctttggtgtcagaagtggcttcatctttgtggtcctgcagggtaaagtgtgacacaagagaagacttaggtccagaagatgctatacataaagtggggaaagcaccttgcccctaatgaaggcccctgagacatgcactcttttctgcccttcacatgatgaagtctcactttgacatttattaaatgggcccggtagaaccagtcctctcctaaggctgttgtaaggaccagatgaggtcttgtgtgtgctgtacaaatgggaatgacaccatcataaccaggaagattgagttggagttggaaatctagggagcatggcaaatgtggaccttgagccaacttttattactgtggcaccaaatcatttatgaataacttatatataagtgatgaaactctatagtactaaaaggaacttggttccagtcacttgccctcatgcccttactccattttggtctataaaaaaagtcagtgctcatgttgattcccacactttctctctgcttgcctgcacctattccagttacctaccttttgactccctttttttagctttcagatggtaactgacttgagaccagtacatccctgcacataagcagacagtccatgcttatctgaattcctggtgtaagcccagggtagtgcaaagagcatggacattgaagaactgcacttgcgtaagctgtaactttgaacttattttcctaaaaaataggcatccaggatctacttctgaagcttgatgtgtgggtcagcatagacaatgtaggtgagataaaatgaaagctgttgggaaggtataaaatactatcaaaataaagaagtctaaattgatattcaaaggctatctgactatctctgcctttttagagaatgcttgttttccaggtccgtgtcttagccctcccagacccatctctgctctttatagataaagttgagtgactttcccaagattacaaagatcaagagtggcagaccaaggacatctctcacttgaaaactagggctcttttcactgtagccagctctttgttgggaaatcttcataatcagtgtcaccttctgtgctccaactcctcagcctcacgcttgggtgaacacttccttcccttcttgaccattgcaggctagtgccattctcttcttcagttttcattgctgggatgtcttgcagcatgatgccttagctgttctgtatctatgggggtccatcattttccccttaaggatcttctcctatagggtgcaattatgcagttatcttactggctcatctctattttctgctataacttttgaagtgcatcaccgtctctaactgtttgtactggcggctcagagaatttccttgagcaaagtgcatttctgaagccaagtcccagcactgccatgtcttttgatgcccttggtctcctttctcagatgtgagtaaaaatattggtgttaattacataggcttgagatacatgcaaagaagagggtgaagacagccgtgacctctgaaagagaggcataggtcagtaaaagatgcattcattccaaagactgctgcttgtcctgtgttgggccaatccttttcagcaaggtaatttaaatttaaagtcagcattctcctgattctgtttcctaaaggttccagctttcataggatgggtacacttcactcccaggcctcctgggaggcctcctctacccttcctctaccgttttcttgcttctccctaaaaaccttgaagatatggaatacttcctgcctacatcttcaactcagagaccgccaggggatttcagtgtttattgcttttttctctgggtttggaacagttccgaccaggtactatttgaaaaatgtagaagtatttttttgcttattatcaaaaggagaatgtagttttcttgcaacaaaatgagaacttgatatctttcttgcctcgagggtgtgtgttgggagacgggggtggtgttcagccttctcttcctccacctctgtatcctggtagccagaattgaagttccaagccacaccaaggagggtggctgcctttcatgaaaggcagacatgtagtaattacctttttgcctatctgccgccgtccccttgtgctgagggggttcccttgccgctctgtctgttgtctgcacactgcatttgtttgtctggaatgcagaactccttgcacttgacaatcactacagtctttctgctttttctcttaaacagcttttttaaagcacccagagacccttaaaaaaaaaaaaagaatgcaaatagaaattgcgctggaagctgaactgaacattgttgcgagtcatgagatcccagccacactgggacaaactattttttattttgggtaatattttttctttggcatttattacacctctgttaaacacagctcatgtgacacagtgttactcataggcaatcagaaaaaagctgaaagttgagccattagtagggcagggcaacttattgttaatagcagccattaaagctgaaaggaaaaattacccatctgcccccgccagacctgtctgtctgagatcgagattgggcctccaggccggaaggggggctgggcaaacatgagggaaggagaatggaatgtagaaaccgagatctttgtaagggaagatagagctgaattcaagtgtgggccctaccccaagaataggggggaaaaaaatcctgccccaagaattccagctgtcctttgtctgttcatcctttctcaggaaagcacctgatagcttttatccaaagatctgctgcaaaatccattttagctacagacaggaaatgcaaaagaaagattcctgtagcaacaacaccttgtaattatgaaatactttccatcacagtgcataacatatagcagatttactacaccaaaattctttgccgttagatcttggggtacagcagtgaaattttctctatctttaaaagaacatgtggtttaaacccctttcaggcattttaaatcctagccaaaggtgcaacaccgtttaccaactctgacaagccactctaaaagtgtgcttgtttgatggggccatatcagatatcacataggaaaataaatttgagagggctttgccacgagtatgtttataaaactcacaactggtctggaaaaagaaaggcaagtggcccattttacagatggtgctaacacactccagtgcagagagtgactgttgtcaccaggatcacatatcaatttggaaaattgtaatagaaaccagacttgtggcttggagtatagcccctgaaagggactaggacagcccactcccctgccctgtcctccttacaccttaaaagggacagtgattggggactattgctgccccgcgtgctttttcaggcagagatatcagaatgaggtctgaaaggatagttgggtggccccagagaagacctccacggctggctaagagtctgagcattgctggcagtacttagcatttaggctaccctgagtgcatgcctggctcatgataagtggttaggcctgtcagaggcgggaggtgcctgctgactcagacccagagaggtgactcctactcttgagtgtctgatttctcagatatgaccatatccagttctgggctccagccctgacctgttccttggctatcagaactatcataaggccagatcagcttaactcatctccaaggtaattcttggtagattttggttccttcttgcattttgtggctttgtcccactaagagcagttgttctcagccctctgtactggtggcacaattttgaatactgtaattattttggttgcattttggaatgaatttaaagttctcgcaaaggatcttcagctccatgtcactcatcagagctcttttctattttccagctcttgcatataggtaacacgcgcacacacacacacacacacacacacacacagagtttttcttgatatgctgtctcttgccttccactgtcagatcgtaacctgatagactgaattgagtgacccactcacactcagctcagcattcctatttcaaacactgctgacacacggtatatcttcatgtgtaccagcaatcagactgtagtcaattaaattgttttgaaaattaggtttatgcacttatcagttgtttgagagtctggcagttttggccttaagagttccctgtcaaagactatggcgtgaaagatcactgctttcaggcttctatgctgtgattaaatgtggagagtggttttggggacatgtgtcttaagggataagctagtgaggaataggttgggactggtaggacgagcggcctgtggcacatttcagagccctcaaccgtaccccacactgcatgggccatgactctctcttcacccatggatcatctctagaggggattcatgatgtcacctggagtctctgctctctccaagtgtactggaaaggattgggtgttgggaaggcattggaaagctggtattagaagagttagctggggagagatttgactgaagagaaggaagcgtgtttgcagtgttaacgcagtggatctgcctcaagaggcccagaacttaagaaagccaggaagctatttttctacgactccccatgttagtgaaggcaattttttaacgtgatatccactttgaattctttgatctttaagaaatatgagtaagagaaaaggatagatggcaagatagatgaggaacttcagagggggctaagattactttaagggaaagctaatgagttgttgaattgttttacatagtggggtgctatgaataggatgttaaggaaagttcttcacaaataaatgacagaataaaaaaaaaataaacctaacataagacaattttctttttcagcaaggcacagggttctttgggaagcttcaaaaaattcaaaagtcatagtgccttttttcatggaattcactaagtagagacttttttgtaggcatatcattaaatgctggactctcaagttttcgaaatgagaagtctccatctgggaggtataaaaggaaacccccatctggttggttttagcatcttcaaggtgaggatacaattcttaaaattgtctacctatttctgagtcctggttcaaattcctttgtgatgtctatgtcagctgggaccctgtaggccccactgagttgcacatcaccaagtgtgcccatcactgtggttagaggccgtgggctgtgtactacagacaatgctgtaattgcttctgtgaccaagtgagggcggagtttgccctttatgtgatgtaggcaatattctatttttaataagccagaaaaatctgttcaaatccagtaacttcaagattttccaaagactggaagatgtggaggacgtgggcatcagctggaatctgatttctctcccctccacacttgctcttccccatttctcaactgctgtctcccagtgtaattaccatctcaagcattttctgttcgtcccctgtaggtacaccacatcgtgccaacaacccatggcccagcaggaatatacagtagcctttgccagggtccaccagggcttgattacacttcacggctgtaattcaagcctgctaatcctcctctgcgttcggaaaagaggcctgttctgttagataagctgattactgtctggtgtgtgcttcatgcctagcaagagttgtttatatgtggaattattgctggctgggctctgtgcttcgctacaccgaggaagctcgcttaggggtcaggggtgtcaggcttcacctctgatctgggaggggtgagaagtggagtgttgattacagctgtttttctctcaacctctgtgctggtggctaaatatttacttttctctgttaacggaaggagccagataagattttaagagtctgagacttttgcccctaggacccactgtcaaagatcatagagtgaaagatcactgccccagacttgccacattctgattaggtttgcaaggcgatcttagtggtctttttgtctttagggctacgttagggaggactatggcgggacaagttgagtgtgtggtgaaatcaacagccacagattgaagagtgcccgaccacagggaaaggatgcccgcagagaccatgtgaatgctttctcacactcaaagatgttttcttcaaagccacagaagccttgaaaccacctttgcctctgcctaccagcccatctctggtctggtgtggagcttgtggcttgggtgcagtctacgaagcccttgctcttcatggaggaggaagtgcattttgttataaccgtctgcccagtgatgttggcgtgatttatgctggctgcactctcaggattcccatcccttttgcggggtattttgtccccagatgcagagctgaggttctgcttaatactggcttttaagtgtttaagccctacaaatggctattcggtttaatggtgtaaggatggggtgagtgctgaaacaagtacaggtaaacacaagcacctggcccttgtcacctgctgcatgggcatacattggggtctgtttgtatatttgaatatgtggcagtctacactggagtaaggaaataaggatgaatgtcaaaaggcttaattgtgatgatatcacaattgaggccatttgttgagtaaacttcctccacatctctgtatactaataatcggtttgtcagcttttctctatgacactatcatttcctttagggcaggcactttgtctttcatttctgtgaccgttacctgtctggcccatagtaaccaatcaaggaatgggtctttgatttagtgtatgaataattaatagatttcagtgaagaggcagcctatcctagattgaatgcgcggtataaattgttaggtatttatcatagctcattgtacgtgggttccttcccaggtacctttcttgcctttctttctaggaagcagagaatccgcatccccagaaacatgggtgttccttaggtgtaaagggcatggccagctaaaggcagaacagaaaagctgctctggaaggggtactgggcggctgtggcatgtgatttagaaggaaggggtgctgtgctatgtcctcactgctgagacatctgggccacataatacctcttgatccacaaatatcttgagtgttatctccctcttttcttttgccattcccacccctctttttcctttttgagtcctctttgtttttcatctaaagtgttctcttccctttgccttttctagggaaatacttgtcccttaaagatcagcatattctccaaatggatgaattgtgccccaagggggatttcttttcctagtgactttaatttctagtcttagaacatatccaaaaggaaacacagaagtgcaaagttttaagcctaacttgagcaataaaagatttcttttctgtgcaatgattaactttcccttctttaatttcaagaggttaatgaatctgtgagcttagtatacttgtcattgtacatatggcttgtcattgtatgtatggctgggctaaaatttaatattgaatctctgcagtaaatcttgtggttttacatttgtgtgtgtgtgtgtgtgtgtgtgtgtgtgtgtgtggtgggaggagagagagagagagagagagagagagagagagagaggaggtgtgggggggcggggggctgccatccagaagatggaggtacaagtaatggaagctttttttcttctccctacatatgaactgaataaatgcttggccgtcaacagaataatagtttcggaaaaccacaccttgaaattcaccttagcatctttgaaataatctcaggagggactgggcatggtggctcatgcctgtaatcccagcactttgggaggatcagttgaggccaggagttcaagaccagcctggccaatatggcaaaactccgtctgtactaaaaatacaaaaactagccaggcatggtggcacgcacctgtagtcacagccacctgggaggctgaggtgggagaatcgcttgaacccgggaggcggaggctgcagtgagccaagatctggccactgcactccaccctgggctacagagtgagaccctgcctcaaacaacaacaacaaaatctcaggaggttttaagggtcgagagatgaacagcaaggctgcattccagagactctgaccataaagctaaactctgagcattttctcacaggatgtaatcactgactatggtatttcaaaagtctagggtcctgccactgtcacaggactacagtagtagcaaacaaaggagggcggaattaagaaaatctctgctttttattctgttcataattatttacatccctgtcacttaaaggctggataactacctgtctgatctccaacctgttgttgccatcctgtcctcagttttgcaatcagcagcattgtttgaatgtttacctaaagcagaaatctcttagtctataccaacgtcagttccctgggattccctctagaagaggaaagagaactatgtgaacataattcacattggtttgcagaatcttaaaattagctagtttactttaggctgaaatgactccataaccttctggttttttgcaggaaaaagaagtatacattatatatacctttgacaaccttgatacaagtgttagatgcttctttcattggaaaccttcaaaatgcctttcctctcagtttttctgagcccacctgttattttggttacatatgaaggtagggaggtggccccataattctggttggcaaattgggaacagagcctggaactggaggatatctcctgctgggtgatgctgaacattaagaccaaggtcttacaacagcaactcagtgctattcattaccaaacagatcaaaaactgggtaacttttgtttcacttccatatctcctgtcccaaaaagtgaagtcaaattcagcattaaaaaaaagtgtttgcacaactgtaatttttgatggtgtggtgtagaaacaaataccatgtctgtttggtttgctttaagacataatagaccaggtgcagtggctcacacctgtaatcccaacactttgggaggccaagacaggaggatcacttgagctcaggatgtcaagaccagcctgggcaaaatagggaggccctatctctacagaaaaagtagccgggcgtggtagtgtgtgcctgtagtcccagctacttgggaggctgatgtgggaggattgcttggacgtgggaggtcgaggctgcaatgagctgtgattgcaccactgcactccagcctggacaacagagtgagaccctttctcaaaaaaaaaaaaaagaagaacaggttaagagtgtgaagctgagaaaactacatgtgtgtcgttagtagtttttcttggtttaggctagttcaggaaaacagaaatgaaattctgcaaaaggcagcatgaaagtccacattggccttcatcccgtgaaactctgccagctgctacttggggttcaaccctattctttcttcagggcaccgcctttgcttgctatcaaccttgctacaattggaggcagctgtgaggtagggagaacaccctgagtgaagtcaactgcagaactaagtatgtgcccttgggccactttgactcccagtacctcagtttcctcatctgactaaaaaagggttaataataccccataacgttcatgtgagaataaaagcaaaggagataatttttttttttttttttttgagacggagtctcactctgtcccccaggctggagtgcagtggcgctatctcggctcactgcaagtcaaaggaggtaatttttgacaatggatttgtaaggtttaatttccatgaaagaaaatatggcgtatttagttcttctctaccacattgtccacatacctgttctagcaatttcactttgtatattagctctttcccccatgattctgcacacttgtcttatttctggtcaagtttccccagctgaaatataggttctgtcaaagagtagatcctcagtatattatgttgaatgaacaactgaccgagagaccaactggggtccttgttggagtagcaatgttggcaaaattgtgcagcccagtcacactttgtgcgggttgagagatttttattttaactgagctgtaaggctgtcactgaacataagtggacatgaccagtctggcagagtcaaacagagtgctgctagaaagcaggcagcaccgaaagagaaaagcaaatttggcttctaagatgaccatatgtctgttaccccagaaagcatgagcccctgcaaagttctctgctgaagtggggagagttggagcctcctgtctgttctgcaaaggatttgcagggtgcttagcatgctggccccagtgtcctcatggaaatacggatggcttgctaggggctgtcccatacaaccagagtggggttcaatgaagtgccatcaacaaggtgcctacgaagggccatgctaatgtctggccagtgaaacaggggaacttccagagcagatatcacatgggttggagagatgttgctttacacagtgagcaggaaagccagacacctcttcagagaaatacagtaagaaccacagtaaataaggcccagcctcagggaggcagatatttaaaggaaaattaagacggctcctcatctatctctctgtcacccgttgatgcatttagccagcatcttgtggtgctaaatgctttttgatgatgatggttcatgatgaccactgtatctccccacaggggtgggcgcctccgatgtgagagttcttagtggggggctccatctccagtgcacagaaagaaggaatggtccagagaccccctgctctccccaaattcccgattttaccagcatgtaaaagcaagtggaggcaacaaccaccacaaaaaagcccgtctgaaaatcagagcctaatcactcccatctgctccagtgctgcttcctctcgctgcctgccaggatgtttgccgcagatgctaagtagcacattattttcgataagttgcaatcatttacttgaaatctacttctcctttaaaatgtccccctggaaacttgaatcggcagtcgagaagccttgttcaggatggaatttgaatgctcgcactcaagttcaagaaaagttaaacccatttgacctccaggtgttgatgaattgtaaatttcagccccttagactctgttgagaagagaggaagaggcaccagggaagacgtctgggagaacagagccattccttaggcctcatttccccaagggaaggcacagtgctgagatgagagacaggaaatgatggctccatggaatcgtccccaaagcagaaatgtcacacatccccgaagacattaagtcagtagctttcttggtccccatgagatgttatctcttttatccagagactggtctagtgaagattaaaggcataatttgcaatctggagctcataatctcagtcgcccttaccccattccactgtcacaactaggatttcttatttactgcctcttgtccaggacaccgttagtatcaccgttagtatcatgtcctgccatccgctcttccctgtcagttaaaggcttagtgcgttcaggggctacttggaaagttctgagaagcagcaaatgcctcctgcttttcatgcagcctgtttgcctgtgtgttccgtggctccttgtgtctaaggacagcacgagtgactcattagcagcacggcatgtgcttggggtggtttttgtaatgagtggtgatggatcatccacatactctccctgaaggaccctgactgaccttgtatgcatttgtgagatgactgtctggggtcacaggtgttgtttgtggtcatggaaaaagaaaagctaattggcgtgtgttttgaaatggacctggggcacccataaatagacccagtgtccttcagctggagaattctgcttccactaaagtgaacagaggtgatttctcctctaagtagggtgcattgggatctctcttccaatcctctgtacctgacaaattgagcaggctggttagagtaaaaacctgattttattagtatagtgtaaggaaacatcccactacaagatatagatcaatatatgcagaaaggcaaattacaggtactcagcctaaagtaatttgttagaacttggtctcacaggtttacagtttagtccaccttagaattcccttggtcaagatagagtcttctcttctactccctcatcacagaggctcttggctggtttccatatacagccactcctcaccacctaccactgtattctcagtctaaactcctcaagggcacccgataccctcactaggtgatgtctttccctgttccctcatcccggacttcctgggccttcttttgcctctgctgatagccgtggtagtacccaagagaggcccctctaatgaccaaggtctctttgatctgttctaaaacctcctctttttgccaggagttccccacagtgactactcaggtttttctgtgacttgcctctggttattaaatctgcctttttctaattttctctgtaatactctacatgagatcactgtgcaatactctacatgaaaacactctgccttctagatttttatcttatttttagaaataatttgtattagcttagattggttaagctgtctaaagcaaacaaaacaaaaccctctgaaaaaccccaaaataacatggcttaaacaaaatacaagtttattttttcccttctttcttatagcccaaagatgactggtgggctggtctccagggtgtgagaactcccatctggcttctttccctagagtggcttccagtgcccagcccagctcatgggccgggggatgggggagctgcagaagggatggagtgatttagagtactgcaccttgttgccctactctaggctactggtaaccctggctggaatttgctgtttggcatcagtgacatcatttcctctgtctgtccttggtctgcacacctctgtctatggctgtcacctggcagaggtttgcatttcaatcttattgggaaggaatcctggtctagcagggagaaggtgtatcatattatcagtggtaggtctcgtctcctgtgatctgtagaactggaagtaatcatggatcgcgttaagactaaatgatcgacgaattctgtaaggactgctcaaggtcaatagctcattgtattaggaaccctgcctttgaattattcagcaattttcaaaaactgggaaatattcctgtgggagcaaaatgttctttatttcaaacttagttctgatgaaattgtttggaaagttagagaaaaactagttctgttcctattcagtttgtagatatgggccggaaaatgccatttgccactaggagctggaagctaatttgtagcctcaagacagtagtgacaacggcagcggggtaagacaacatggaggtgtgcacagcccaggcaagtcgttgtaatatttcacccatggggtttctctacatcctggcggagaagggtgattgtgaatcacagatcccacccagaatcaaaacttaaacatgcttcctcaaacctttgagtacaaatagtgtctttaccctcttctggttataatttatttattttttaatggaaatttgaaagcagccattaaagatgacttccaggccagctcgtctgacacaaggtgagattacttcagaactaagtggttcccagaagggtcttccagcctcagaaagaccgaggcttccagtgtgagctctgccaggccaggaggatggtgtcgcctctggctcaggggagactagggttgaagactgtggcatctcctctgagtgaagacttaagaagctgcaggatccttaatgtacttgggcaaatagcaagaaaggactataaagaggagaaaagatgagagaaagaagaccttttgaaatgtattctattggctgaggatctatggattccttagcctttgacggtatcagtgtgagcttgcctggaagcataggtcagtaaggtgggggtggggggtgtctgtgtgcatttgtgtgcgtgcgtgtatgtgtgtatgtatattcttggcttatcctggtttcttctgtgttgttgattcctaacgcgcagaaaaaccaaactcttaactctaaatctatcctgcttttttattcttcccaaagggatctttatcagtgagattgattcagatttaaccaaaaatctaaaatctatcagtcaccaagcactactgtgtgcttttgtaaaaataaccttatttaatccttagtaagaattaaggcataggtgaagtcgtgtagtaggagtcttgggcctggctttgaacctagacacccaaggcctgttttagtgtacgtttttttttgtgccatgctgtggcactaacagaagaaagctcgtgcccatacttatacttttctaggtattaaaatgtggtaggacaaggaaatctatcatgtattagctcttgccagaaagcaggcaatgtgctaggtgcctcactgagactcggaactgcagaacatttttacctcaaggctaaagagtattgagaaacttctgttttctctatggttgcttcctttaggaaataccattgtagagagaagctttcatctccacggaatgcacagcaagttgccgaccaatggctccacatttttcatgctttttatgtgtaactaagaaggaaactgttccttgtatcatgggttaccacaggcaatccaggtctcacacacccttccctggccctggtcctggtcctggccttctgtctttccgatggctttccccctttcctcatacctctgggtatgtcagtctaaggccaaagcttgtgtaagtcatgccctcctaccaacttctgtagctcctgtttaggcaaaggggtttcccgagcagcagtccagacttgagctattaaggaccaaagcccctcgcccaggcagccggcacccatccagaaaggcaggggcctatcgcccagcacattagctttctccctgccagctggcccagggaggcgcagcgtgccaagtggggaacgtgtgaatgggatccatgcccatgcatcccctgagaagtagaaaatgcacgtgaccagaaccgccaaaacctaacccagggaaaaagatgacaagaaaaacttggtgtgtttctctaaagacaaccacaaaacataaacaaacaaacaaaaacctaaaactgtctcaagagtgtcatataattttgttttcatctcttgccctaaaacctcacacaaagttttacacattgtggctgttggctaaatgtgaaaaacgagtgaatctaagagctcctcgcaggaccacgtttatttggaaagtcagcacggtgcctggcaccatagtaaatgctcaataaatattcctgggctgaaacatttgagggccgcaaattcttgcctttgtttgactaaatccttcaaatccctgaacttggttcatttactaaatccttcaaatccctgaacttggcctacctgcttggcaaaccaagaaaaacagttggaatggcttaaaaacaataatatcttaccttcaatacaaatcccccactttaagaaaccctggacctagattaagtcccacctcggtgtctctgagattctagagggctgagagacaacccgggggaacaagggtggctttcaacatttggagatttcttaaactacagcttctcatctgaagaggccgctccaggcctactgcagcatccagggtctccacttggggctggaaggtgtcaactcgggtggtaactgctttccctgtataatcagaagcgctgactgacacctatcagtaatgctgacttgtaaaatttagaaaacagaatcatcagtcatttctatttgtttgatgaataactctttaaaaatcaccattaaaaaaggcatttcacatcaaacagagagattgagaataaggagtgaagaacacgaggacctgctgccctgagtttcaagacactaacagaagatttgggtcccacctttggttgagaagaatcaaattagagcatagttatttttcaacttgaggaggttccgggctgtggatatattgtgcttataggaagtaaacaaaatcagaggaagaagtgtatgtgcatcagttggatgcacacaaatcttcagattttcagttgttatccacccaccctggcaatctcatgtacccacaagcctcaaagcagttggtgtcctgtgtccgagggactggaggagcgtaaaccatgggcttcttgaagtcggagcccatatctgggtcatccaaggtcccaggatccagctcattcctgtcaccttggaggtacttgagcagtaatttgtttgattgcactgagcgttcctcagagggcctgtttgtggagacaacctctatgtggccccttggctgccaggccctgtcagccctcacagagtgcttcttccccaggtaccagtcaggaaccaggcctttcccagcacccagagcctttgtcaccggtaatgttggcttcctggggtcataccaggctgggtccaggaagctctggcttaatgccagtgtagttttgcttgtttagaattgtcagatttgataaggcagatttgacagttttttgaagtggatatggaagaggtggcagagagaacagccttctacccaacagcatgctggctctggtacaacttgtaactggaatgcagggggaaagagagcacatacagggaattggctgcctggctgagaacaggaagctgaggcacagatccttggatctcaccagcccgtatcttccctccttgattctttattatattgctcttaagaaatattggaacagacatttagtgtcaggggccctgtgaggttgtgtggggaaccgcctttcaggagttcacagtcttgctggcaagatggtaggtgtgccctggcatgtcctgagatgccccatggctgtggtctaggcagtacgtgccctggtgcctcagaggcttagagatcattttcggctcttctcgtcagggcagatttcatgaaggattttgagctgagatttaaaatgaaataggactgtagtaagtggatttctgtggctgagaaagaagagggcattctatcacccaatacagtggctctaaccatgatggtggaaagaggtaatgggaaaggaccagatttagagaaattaaaagaaattaggaaatcaatagaaaaaacttccttctttccattactatctgattgttttcttcttggccagagtatcggtgtgccttgggcatcagaagagactgtgtgtgtgtgtgtgtgtgtgtgtgtgtgtgtgtgtgtgcgcgcgcacacacacacacgcacagaatagatatcacatccatgtagctgcctgttgtgaaaaggattcagaactccaatattgtagaggactgaagtgtctgagagttaaagatctagagttcagtgtcggctgtgtctcatttgctttgattttggggaaatgtgctttgcctttataatcttcggttatctgctatgtaagtttggaacattacttcatgttttgtaaggtgatgtaattcagtgcgtgcaagtactttatgaacaaataaaaggtataactctgatgctctcaggaagcaagcattttgctcttttcctaaaactgcatagctgacttgggaatgaggcggggagagctggtctctcttttctaactcttctggtaggatgtggtaaagactgagctcctgggcaatagaacactctgcatggaggtttgtgcctacaaatcaaacaaagagatcagccagagagagcctgcctttttgcacacaccgttgggaggctaccttgtgcctttccccagaccacctgcctctgctttctgtcttgttctttatctgtttctctctctcagctcagctttgggcccctggactgttgtccaaatctgaagaccaccctccctgtagatctgccctcctcccctcccaacctgcccccacctgtggaagtttgaatctgagcagaggcattcccccagcatgaacctggacacttgactgtccgcccgcctggagaaccagtccttggtgaagaaagagtgccctctagtgggcattggctggagctgctccggacccacgtcactcagccaaggacaaaacaacccgccacacggccctcccgccaaggatgatcttgactatgcctttgggtttggtttgtttttctccttgtgtgaagaaaaagaaagaaagaacagcaggagacaagtggtgagagcagctcccacaatgctgtgacagtccctttatcttaggacttttaccaaagaattaaccccagggcaagcgatggcagcaaggtacatgtgacatcagaagctttttaaaggacttgtgacaattcctgtataaatcacctacctgtctcaactggtctcttccataattgggtggatttgtgggaaggaaactctttctgtaagaatgattaccaaatgggttaaatatcttcatgggcgcaacccctctgcagattgcatatccactgcaatcaatgacatttttcgggtagtggacgcgtccgggcctgcctggccattaaaaccctatatgcatgaggacaaacaagggatttggccctttaaaacctatttcagaaaaaagctgctggggtggggagggaagagatgagggggagggagagagcgcagggcacccatcagggaagcaggaacctgatcatatgtgatggttgctggattaggtaacagctccgctggttgaaattggatcttggaggatgagtgttaacatctctggtgtcctggcgaaaggttcatttgagtcttgcatggtgctgcagagataaaaaggagcttttaaataatcattttgtctcctactcaccagagtactggcttccagcaataaataggtagcatcagttctgcttagacatatcacccttttcatttatttatttaatgttggtgtttttttttttttttaaccgccgagctgaacagtttgtgtatcagtgaatcccaacacccattcttaatagtggtatatttggattctccttgcgctggctacaaatatgagcatgcaaggttgtttattggtccatccctgtcccctccaagcattacagacacagcccaaatccaccagaactgaattttctatgcaaaatagtgcaagatggttttcttttaaggttttcccttgttcatattgttccttaaaaaaattttttttgggtttttgcacaatcattttctattttcataatttgagtataatttaaagggtgtaatttggaaatgactgttgttggtttttctacccgccgccctcccccccccgcccttttcttttcattcttttgttttcttcagaactctgattggggacctatttatgtgtcttgaactctaagtgtaaatgcaagcaatatttatgccgtggtgcattgtatctatcttatcaatttctaattggccacatttagaaactaagtctattaactcatagtgaattcaaatttctttttagggagtatttatttgcaggattcacaaaatgatgtgaaagctaagcgaaatactaacactttcttgccccagccaacccaccaccactgcgcccaattaaatgtatccttcatacctgaaagaaaagaggcagtatgctttatgctttaagctttgcaaccctcctgaaacttccatggcgggtaggggcttgcagtttatcctttcagtgttctttgccagccttgacaatttcctttcttattttatttaaaaccagttagatttgaaggccaagaaatgtattaattaggaggtgtgtagagtttgtgtgaaattgtttgtgcttcccattgactattttaaaaagatggtgttttaaaaagatggagcagaggcatgaaactgagaggggttggaaagaggaaatattctcagaggttaatattaggtatatgggaaatattcatagtgatgtgtgcgtgatcacctgtgtagctcctggaggagcgaggatcagaactgtctctctgccttgcctctcccttctttcatacctcactgagtttggctggaggaataagctgatggaatgaatgaggccgcttggggtacccatgtgattggaggaggtaggatacttgatgtcagctcaagtaggcagtgcttaacactagccctggcaaggcaagtcctgaccattaataggacatcattcttttttgctttgctgttgttgttgagaccagaggttgtcctaaaatctctcagtgttgggccgcatgcaggaccagttgggtgtggagtagccaggtggacccacttgaaggcattaacacccagctgaagggttaccagcctcagcttcgtggggaatgttcctgccagccgtgggggcttacggcctcttctgaaggaagtatattggacatgagattcagtgagcgaatgagagagtagaattttgccccagcacaatgttttgaataatcgagctaaagtgaaacaactatatttattaatggctcagaggcgattcttttttttttctaatttgtaaatgacccataaatttctttgtggataaggctattaaaatttatcatataaagagaaacaaccacatagaggtgaaggagaggctgctgggcgctgctgccagatgtttggatgccccgagattcttttcggtgcctttagggcctggtattcagggcatggttacagcagccatctactttcttaaggaaacctttgttagtggcaatttgttcttcagagtgcttcggagatttaagtaaataaatttaagaaacaataacgtgactaaatccttattgtgcaaagatcagccaaaggagcagtttcccattcagtctcctgagcctacaaaggaaggattttattggaaaaaaaagtccacaaaataaacctcaatgacctcctaaccttttgccgtcaccactatggcaattttgtttttgtgtagcagaatattacatattcaggtttgaagagagaagatcatgacgtggtagtgttgtggtttgcgtctagggtgcaggcttccttcttttctccttcccagctacctgctctccctcctccctccctcctttccttcctctcatccttttttacttcaccacggagcccaagcttctgccctgcaccttttgtcctctttgctctttatggccaccactgatccacatggctcgccattccatttgatggtctcgtgttttgtgagagccatactgtagttttccttttggcctaggaattgggatttccttctgaacaacgttcagggttggttcttttgctgcctgttggcagccaggagcatgtgggcacagccagcagttatgctggtattatatgtgatgacgctcaaacatctagacataccctcattgagctcatcttcaccttccctgttacaacccgaagccctgctttgccagggctgggagacacctggaactggcactgtccccctggggctcaccagatgcactctgccatgaaaacagctcttgactgtgctctggtgtgtggatatccaccagggacttagaccctgccacctccatccccaaaatgtcaaccaacaccggacccctctcctctgcctttaatcacttccctctttcccaccctacccacacattcttttcaatttcttaaaaattgaaaacactttttatgttccctcttaacaaagacttggctgctgacaactgaactggatttagatgagtgatttattttatgggaggttgtctgaaggggtagtaaaaaagactgtctcgctcttctgctgatttactaaatcactggatctccttcagtccaaatcaccaccaagggtcctggtgttttcataaagatcagccatctcattgatctgagacgccatcctaccagagcactggcttccctgaaaccctggagacagcttgttaaaaggacctcacccttgtttccaacaggacagagtccttatcactcggaacacatagatctcaatgtttggagctaaacgaccctgctcaagggccaatttgtcttcttgctatgttagacctcactctctgctagtccacaggaaaggtctgaagatttcgttccacatgtactggatttgtgtacttcaggtgattttggaaatgaaaaatttagactgatcaagcattgcaaagaaaggcaatgagtgcacaaccacagacttatggaaatttaaaaggagaaataaagagggaaatgcttttccttaaattgaaattaggtagtatggggatgaaagtaaaaaatatattttgttatgattacatttttctagttgaaattttttattgtggtaaaatatatataagatagaatttacctttttggggggtgggggtgtggagtcttgctctgttgcccaggctggagtgcaatgagtggcgtgatctcagctcactgcagcctccgcctcctgggttcaagggattcccctgcctcagcctcccgagtagctgggactacaggcacgcaccaccacgcctggctaattttttgtattttagtagagacggggtttcaccatgtttgccaggatggtctcgatctcctgacctcgtgatcaaccccccactcagcctcccaaagtgccgaatttaccattttaaactatttttaagtgtacagttgagtattattttgcagccatctcaaaaactcagcttcccaaagtgaaattctgcgctcattaaacaatagctccccactcctccccacaactcatggtacccattattctactttctgcctcttataaatttgattattcgagattccacatacaagtggagtgtaattttggaacaaagcaagtccctccttcattttctcaccctctcagtttctctctttttccagcctttcttctattcctcaaatggcatcttgcaagtaacttggcagcttatgtagccaaagaacacaaatgtgttgtgttttttattttctttcttgggttactattaacgctcccttccctgtctttttctgtagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggtaaccagaaccacctggggctcggcacccaggccctttaggaaagggtggaggaagcacaaccccggggcttgcagagaggagcggctcacctttcccaggtgctggcatccctgtgcccggcatcccctgcccagccacagagccctggccaaacttgagtctgccaagtcctggtctcaactgttaaaaacctaggcattcaatggaggtaaaggcattaaaaaatgtgtgacgctgtaaatgatttcaaggaaacataaatcgtgcatagaaggaacactccatacctggactccagaacgtgtgtctgtgatgtgcaggcctggctctcatccgggcgctataggtgatcagcagagtcaccagctaacctgcaagaaggtgggaggttttctctggcccttgtttttccttatttatcaggaggcctatactttttctgggtgctcatagtatcctatgggaaaggacttaaaacttggccctagagtccctcactttacccagactcagttcaattgagagtcaaacgtattccctcttttacataatatatggtatggaatatgacacaaatcatcctctgtaaaaagggtaggaggttcaggagacccctggagccagacaaactgggattctaatccgggcactccacagatggtttgtgggactcagtgttctgcatactcaattctgaaagctgatgtatggcacagatctgtggatttggagtcacggatgtgaaggaccataaaacttatataaaggaaagggcaagaaaggctgttaactacaaagcagtacatgtagggtctcccgattataacagagcccctctctaatagagaacccccatcccatcctccccacaacacatacacacatcatatagcaatgctagttcctctggttagtgtaagcatgctactttatcaggagtcctttaacagcagcctttcatttagatagcagataagtttgttgttatctcttgggatgcaacattatattgaagttctccattaccctactctcattgaatcattagcttttcttttcttttcttttttttcgtttcttcttttctttcctttgctttccttacctttcttttcttttttttttcctttcttttttttttttttttttttgagatggggtctcactctgtcacccaggctagagtgcaccggcacgatctctgttcactgcaacctctgtgtcccaggttcaagcaattctcctgcctcagcctcctgagtagctgggattacaggcaggtgccagcatacccagctaatctttgtagttttagtagagacagggtttcactatgttggccaggctggtcttgaactcctgacctcaggtgatccacctgcttcggccttctaaagtgctgggattataggcgtgagccaccacacctggcccctttctttttaaaagccaaaaaagaagacagagaaaaagtggaaggtagaagaccttgtgcagtccacttgtaactatctaggtagaaggcaaatgcaaacttaatagaaaatttaaattttaaaatagaaataggcattttaaaaatttaaagtgaataaattttcattactgcactcctatctacctttggaatggatttctacaaaatcctctcttttatgagggcagaaaaattgctgtgaagccaagaatagtgaaatttgaccatcagacaaggtgtagggagggtgaaggggaggaaaataaaagcaagctgtggtaagaagctgtgagtcatcctcctttgccttcttgggaaagaacaaatgttctcgccacagtgttggctcatatagacatttccccagatcccaggcaatgctgagctcagagagctggctgaactgtgacagtttccccaaccatgaccatcatttagaatttgcagtctgctctaacctaaaagggtaattatggaaggcaaatggggacagacctctcgctgacctcttggattcttattacccaatgttcttcctaattcaccttcaccaataaccctgtcctctggcatagcaagctgtcctccagatttgtcctccaggttaactcgtgccaaagaacaggacacaagacaagcccagagtgcgacttccttcactaaaccataattgcaatggatgttaggttgggaggtgttggaaactgtctttaatctgagctcaggttgccagtaatatggaactgcttccttgatttaaaccttcttatcactcttccatcctcatccaaaatgagtaaaaattatgacagccatagtacattttaatagcatgtcaccaattacaaaacactgcggctgacataacggcacttgctcctcaaggcaattttgagattgggtacccaggacaggtattgtcatcctctccattttgatgcaggtgaggaaatggagatgaaagaggttaagatgtggtggaggtcacacatttaatgagggagagaatttgccctagaatccaggattttacccttaccccaagggctcttattagaataatacctgactccactttgtaagaagagaatgtggatgtctttcgacaatggggtaagcaggttgtcctctctgttacttccttgggctagattactggcacctaagagagggttgtgataaaaatattctcttcagaaacttcttgtggctacctacctattctaaataataaagatattggaaattgagaactaaaaagctccatcagtacagaagcaaattatgttcagtgtagaagttgtactactcatctgtatttattatttttaaaagtactaaaatatcatctatttgtttatatgggcattttctagttaagaagtgaatactgcttaatacattttggatgcttaataatttattaatattagttgtgttaattatagtaaatagcagattgtagggaaattatgctattaaccttctagctagtgtgtctgagagatatcttcttcatttttcctgtaacagttccttatggggattttttaaaaatagaaaaccttggtcaagtgaaaatgtcagtattttagtagtacctacctggaattaccaaattggttacttaataattaattttgttgttttatttttggcatggtgatggcagataactatacaataattagctattgtagctcaccctcacccttatccctccaaaaacaaaacaaaaaactacctgaatcagccattgtttcaccctgaggttattaaagaaagaagtcttttgaagacattttttttttttttttgagatggagtcttgctctgttgcccaggctggagtgcagtggcacgatctcggctcactgcaacctctgcctctggtgattctcctgcctcaaccacccaagcagctgggaatacaggcacgtgccaccacgcccggctaattttttgtatttttagtagagatgaggtttcaccgtgttagccaggatgctctcgagctcctgacatcgtgttcacccgcctcagactcccaaagtgctaggattacaggcgtgagccaccgtgcctggcgctataaggtatttaagagctgtcatattataatagataaaaccatgatgtcagaaacctgaattttattccaagctctactttaaaaaaaaattatcttgtggctttgtaggattttttagcttttgtaaataatgctgttggggaatcaacaggactaaatctctaatgttgaactggactgggttaattcagttcatagctaagagagccctaagatcccagttacttttgttgatgagattggcagccaaatccaatctcatccttggatctcaatccaatccatctttttgaaggagtcaaggaagaagataggtcttatagttcaggatgtaaacttaaaccttatacaagacttttgaaaggcttccctttcagtgtctgcttccagaaacaacgttgccctgtaacctgggaggtctattagaaatccctctgccctatggaggcagcctgagctcccagaaagtaactattgttttttatgacagcctacagtagagtctcctctgttgagaaacattcagcatgtgagggttttatttaattaacaattgtaaccccaagtattcacattactgtcacattgtgagtgcctgtcctatcggaagtagcccagcttctttagatacaaggcttgagggaagtgaggaggaggtatgggtagctccttccttcccaggtactggaaaaatctggatcattatgctctgtccatctaaaatgcccttggaactttgctctctgttgtgtgttcctcagcagctgtttagcagctgctttgctccacctcagcagtgggtgaaacgaccccactgtctgtttattgaagagcagaaagggccccgggatagagtgccctgaataaacatcagatattgtgaatatttttattcaccataatgaagcacattattattagctgagcactgtggcttcccagctgagagctggtgcacttgacaatactccctcacatccagcccctcctctctttgagcccagacgaggtggggaggctgcagcccggcgggaggttgtttctctagaaaggtggctaggatgcttgccatgtgcctagccctccactctccatcctgtggtctccaaatttcagctaacttgctgccaggttttatttccttctcttggttgtacagttccaggtgctggggttggctagggaatgagcttactatatagatctcgtgtttatttagcacttttccatggagagtggagagtaacatgctataaggacccgatcttctatggatttgtcttctgtataggcccacagagtaaaaaggaggtatttattaccacctttacttttaccaagagggaaattgaactctggagaagtttacccagttatcgatatatccaaatatgctgggatttctaagttatctatattttgaagagataattgtgacatgtacttgtagggccaggcacacatatagtaactcatttaatccttactacaccttatcaggtagggtattgccatctcggtttcacaaattagaaaaacgaggcacagatacgttaagtaactttgaagatcccacagccaagtgagttccagaggcaggagctgaacccagactgtgctctcactcagcctctctgctgtgttcatgtgagggatttgctcagtctgcaggtcatggcacaagagcatgggtgccattagccttgctgaagggtcaggaatgattaaagccacttttgggtgagttaaatgaagcactgagtagtgaaaggatgtgcccaaatattcatggaggcagggtcaaaaacccaggcctcccattcaccagtgtagacacagcccagtggatgcacctgcctatgtacctttggccaaccaacctcaaaggatttcttagataaataatcagtaaatgtctactattgttattgttattgcgttgtcgacacatatgacaacggcaatgcaatgttatcaataacgagcgtgtttctgctgttaataagttggaggaattgagtctttagttctttaactctcaaagcatcatcttgccttttttgttgtgaatctaatatagttttacagtattgctttgagtgaatctgtgaatagatgttttgttgaatgctcagctaaggaaaccagattatggatgctaagtcatagtaactaaaagagagggcaggagttttcagaggagtaagttcagactctaggaaaggacagaggccctggcctaaaataggaagggctcaggccctacctctgcctcttcatgtttgctgtgtgcctgtggaaatgtcccttcagctctctgggccacttcttcctgttaaataaggaggtggggaaatatgattttcaactccacctccagagctgatgatatgctagtttataacctgagaatttttatttctgcagggatagttcctgaatcctctcaatcatgttttgatgctgtttctgtaagacccctggggacagattccctttgtgttatagacatagtggatcttcagaaggccagaacaggagaggaagttcttataataaaacttgaaacagaaataggtggatgagaaatctcccagaagagttatcaaagcttttaattccataattccatttaaactcttttggctatttatgcattctaaaattgagtatttggaagtactcctatatcagaaataatgagcaaggcagaaagcacatgatacatttgaccccaaactctctttggctgttaactttgggaaaaagggtggtgtagtgtgttttatactagaagtcatattcttacattttactgtggtaaaatcatgggaaaaaaaagattaagataaaatgattaagaaacttttttttctcttaaaaaaatccagcattatcagccaggcgcagtggctcacgcctgtaatcccagcactttgggaggccgaggcggggggatcacgaggtcaggagatcgagaccatcctggctaacacagtgaaaccccgtctctactaaaattacaaaaaaattagctgggcgtggtggcgggcgcctgtagtcccagctactccggaggctgaggcaggagaatggcgtgaacccgggaggcggggcttgcagtgagccgatatcgtgccactgcactccagcctgggcgaccgagcgagactccgtctcaaaaaaaataaataaataaaaataaaaattcaacattatcgccaaaactttgagccacaggggctgaaagggacgtctaccacaaactatcctagttttctttatttgcacaagtctctagaaaagcccacgtggcctaatgtcatagacttgatgcgtgttgaggcttggaccctcaatgacggtgttgattgtcctgccattccaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggtgagtctcccatggggctgtcctgccctctctgggagtccctgatctggggctggagtccacagccgctgcccccttcaggctctagtttcaccccatcaacgctgaaccaagtgataccctgaggatggttctgcgagactagatgggccatcggtttcacacagtaccaggaaaatacatggttggaggggatgatctttatcactactgttatgcactctgggtagcagcaaggaggacttaggtacagtgagatttttttcttttcatagcactaggtacctcttttacagttgcgtcttataactatgggcctgcagctgtcttactagcattctatcacgacaggctctcttcaataaagtttattccatttgcttggaaattgggatcttttccacactgtagatggacagagagtgcactcaattcaacaaatattcctaagtaaattgctgtctctgggctaattttaggagtgcagagctgaataagacatggcactttggacacagagggacaaggaggtggtctaacatgggccaacttggtttgatggtttccatctggcattgctgctcatgtccttacttgtgagttcagagcattcagttgaagaaaccatggatagaaaggacctttaaaagaagacaagaactgagaacacagaacaagtggtcatctcttgtttcatctactctctagaccggtagatttatgtgaaaccctttgattccttttgcttctgttatccagcctgtaagatagtaatagtcgtcatatctttcatctactctagaagaatattttgataattcatctagcaaatacattttgattatgggtatgctttgtgatctagagtttgtcttaaattcatcatctgtgaattcagataccattcatatttaaattcttgataataatcccaatctgttatttttatcattgggacattagatatgtcagggtcagtgtaccatttcacagtctataattttgcctcttttcaatgagataaaacaatttattactcctcttgaattttttcacccctgagatcatgttttattcagctctcctacctgcatttttctctgtgttcacaattatggtctttacagtccttggacctctttaaaacgccctggcatcttttttcctcactcccttttagtcaatgtgttttgggttgcatggaatataacatgagaatgccggctagcaaaatgtaactctgggccagtagaattccatagaataagtcaagagaaagtaaaaacgaaggccgttttccccagctgggtatagtaatggagtggaaataggcaaaatcaccctaaagcaggatcctctgtgcctctccctcacccgtggcctgctgtctgccaggcttctgtaatgcagcccgttctgcgtagtgcaaagtgcaagtgactggtggcctctgtttgggtccttcctctgtgccactgccaccctgcatgtattgcttacatctccatggtaactcccctagttaaaatgctggagttggtatttatgttggcagatattgaaaaaaaaaaaaaaaacaattggctccagactgggttctttcttttcaagaaagtaagcagagagaagggaggggcagaattattgtctcattggatatcttctctcagtaattccagtgtgcccagctgaaggtcagactttaacagacacaaagctaggagggttttgtacgcaagtttctttcgcttccaccagcctttgcctagagtgttccagttggcaccagacggacaatcactttaagacagggtctttttcttgctttggttacaacatttgaatcattgcttctgagccaagattcaaaacgaaaacaactaacctattgtcatcgttactatcatttcattttgggggtatatttattaccagtgaaagaacatgaccccaaattccagcctaaggctgagcaaatggccttctcagttcaaaaacaaatgtctgccagacatcctgattggggaattcacatcaatgcctccagcgtcactagctataattgggagagagagctaagcaaacttagtaagaaagacacactcactgcagatattcacatgctcctctaaaccatgcatctgatgggcagggcctcaccaaaaaagatttcatggaagacaaataaaatacaaagaggacttgatttagtaataggattagtctttgtaatctaataggtgtgtagaattgagtgttactactttgttgtggaacactcattgtattagctttctattgctgcgtagcagattaccacaaattaagcagcttaaaacaacacaagtttattatcgcacagtttctgttggtcaggggcctgggcatggcttagctggatcctctgccctaatcacagcgaatctgtaatcaagcttataagctgaggctgtgatctcgtctgaggctcagggtctccttccaagctcgttctggttgttggcagaattcatttccttctgattgtacgactgagggcctcagttcctagaggctccctttctcaataggcaggtcacagtttggctgcctgctttcttcctgagggccagcaggagaaaccttccattttaaggctttaatcgaatcttccctttcgtttactcaaagtcagctgatgaggaacctaatcatatttactatgccatccacttacagggaaggtgtgtacaccagggtctagagttttggaattctgtccaccacacccctcaactaacctttcggccctttatgccactcaagtcatttcctgtctctcttccttagattgacttaactgtaccacggaagtttaacttaaaaattccacacattcattcattcattcattcattcattcaacatttatcatatcatgctatataccaagcattgtgccatacaacttggtaagtttattatcaggactataaataacattttttttttttagttaaaagagggagagaacttataagctctctaaatgattttcgagcattaatcttaactgtttttctataacatttttctggaaataacagtaacacaaacagataattaaaagtacgtctgtatacttcactgcaatagaggggattacataaagtatattgccaaagagaggatgacaagaaagaggaaaggacatccaagaaggtctagtctggtcacactggcactctacttagatttactggcttatctaactgagctcttactatctgcccgatgttatagtagccactggaacatcaaagatgaaaaaagtgcatataaaggtgggtcctaccttcaaagagctcataggacaaatactgttacaactacacagaacaccacatgttacacattcagttcattcatctacctactccacctgaaggaaatgatccagagagagggcctaaaatactgagtttcagaggagcaggatgtttgccaaatagaaggaataatagcaaaataaaataacagaattctacttcagcaagcattccttgagtgcttactatatgcgtgagacacaagggtctcaaatatgagtgagatctgtcctctgcctttgaggaatttgctgtttagttggggagacgtatgtaaatctgtggcggatgttgtgggagagaaatatgcagggtggtgtgaaaagccacaggagcatgaaagccacgagtctttggggaacgcagaggcatatgatgtggctagatgaaattgttcagagcatgtgtaggattgaggggaaatgaggcactagggataggaaagatccactgaaaacccttaactgtaccagtgaagattttgaatttatcctattaaacagcagaaaccctcagagctgtttaaggaagatgtatgggaagttatcacataaaattgcactggattcaaattctggctacaaccctgatgacctatatgacgctggataagtggcttattttcccaagactcagttttcttacctgtaaaacagggataatcctgtaaataggaataaatattagtatagtatctggcatataatattcacatcataattcagctatcataatgattactgtgttatatattattactgttatatgatatattattgtacattgttatatatatacacattattgttaaattttataatgattagtgacatgatcatatctgtggtttagaaagattagtgattctcttgaagatgagctgtattggagaaaagacaatgtaaagaacaattattgaagcctgtgctcctcaaactggcactgcacaggataaattgaaatacttttcacattttgtgtaagtattccaaagaaaatattcttattttaagataaacattgatatattataaagtggactaaaacaagaggttccaaagatattttatgtttttgatggtgtccccagagctacaatctttttccaggagggcttcttaggaaagcattgatctagtgttgctctggtatatagctatttatttttaaatttaagttaactaaatactaaattaaaataaataaacatttaaaaattagctctctggttacactagccacattgcagctgctcagtagccacacatagccaatgactaatgtattggacagcagagatatagaacatttcactcatcgtagaaagtactcttggacagcactagtcatacagtgatacaacaggcagctgctcctcttcactcacttcacaaatagcagcgcaattagaatgaaacagaagaggtagatttgaaagtgtagaactgtcaggacatgctttgggggcaatcatttgatgaaggtaagaaagcaggaagagttgagaaactcctagtttctagcacatgctaggtactccaatctttgaatgaatgaatgaatgaacaaattagcaaatataatgaaccatatctatagtaatgtcaccaaataataagactaacaaggaaaatggagctgatttgggtaaaaggtgatcttagttttggaaacagtttgtttgaagatgcttggagtctgcagtcataaatgggccaatggctcttagcagaggtattagggcaggagataacaaatttgatagttagcagtgtatgtctgtgatgtctacacatctcactatcatgagtcttttataaaaaacttaccccatggaccctgtgattcaaaaatattctgtccctaaaacaccatatttatccagtaatattttatcagcttccaaatttcttaaattcaaaacctagatgcccaactcacaaagctactgattggtttgaaatcacaaatgttaactcagcaaggtgataacacttcaagccaaagcaaagaaaccaggtgtctcagttagctcaaccttattgtagaaaggtgttattttcactaggtttcttgaaatttggaaaaatcctgatcctaggatttcaaaggccctagattaagacagctactaaaagaagtgataagcgagtccatcagagtaggtgagaccacctagggaagattgcacatcacaaggagagaagagctgggaacagctgtctgcaccatccgcataccaccagctcattccagagaggtttcctttgagttcaattggaagagtcccaaaaaatacacagtaatgctaatgcaaacaactgaatgaaggaacggaggctctccaaattagggagccttcagggtccagttccccaggcctaaaacaacagtctttaggcgaagaagaaagagaagccaaaggttatctaaagcctggcctgcagaccctgttagtcacttggctatcttcctcaaattcccatcatgcaagagcttttaacacatgcccactttgcagttaggcttttaaatccaatctgtacaatttctgatgctgagtgacccagaaactcagcatgatttaggagagtgacttgggcttggcataatctggacagatgtggttaatacctgtggacagatggtgttcttccggtaaaatcaggcacttcattgtgttaattaatccaagtgggaccctgaaaatacaatattagctgaatttcctgtctagcaaggccatcagtgctttctgttggctaaattgggaaatcctatatcctggtataatcagggatgttctggaaatcttttccataaggaaaagcttttaataaaagcaagaaaggcaaaagtgctaagtgagctaatttaaagatgaaggccacacaacttcaaggagggccaaccagcccctgcattgagcctgcaactccctcaactatccacaggccttcattgtcaggaagcaataaagtgattctcactttaaattagttcaattagcactttttttttaaggcagaaaatgcttttattaaaaaaaagtgattttctcctttttggcaacctgtatatgaaaaagaattctgtgggcttttgttttaccatttagcagctgttcttgcttaagaagtgccacttttctccttttgagggatgtcaagctgttgggggttaatttcagtcagttctgtgccctcttccccagatgccttttaaaaatgttacatgcatttacatggggatagaatggaaagaacatgataacttatttttaacttatggctgcagaagctctgcataattgtgaggagccaatttgtatagaagagagagattgggttttgtagtggtcagacctgaattaataccttagctctgttacataccagccaagtgacctttgagctcagttcttcatcggtaaatacgaataatcatatctgcctcagtagtagtgaaaaatgaataacttgaattgattgccaagagggaggggtcaggcccagtgcctggaacctggtaggaagaaagaccaagttgtagcagctgccacgtgttgggcgctgtgctgagtgctgtctttgtgtggtctcatctcttccctactctcaccctgtgaagtcagtatcaccctcttcactttcacggaagaagctgatcgaaatcacccagctgatattcaattgaccgaggattcaaaaccaagatggggctgggcgcggtggctcatgcctgtaatcccagcactttgggaggctgaggcaggcagatcatgaggtcgggagttagagaccagcctggccaatatgatgaaaccccatctctactaaaaatacaaaaattagctgggtgttgtggcacgtgcctgtaatcccagctactcaagaggctgagacaggagaatcacttgaacccaggaggtggaggttccagtgagccaagatcacaccactgcactccagcctgggtgacagagtgaaactccatctcaaaaaaacaaaccaagatggcccgaattttgaaactttatactcctcactactctgcaaaaatatctgtgaccactcttctgttcggtgcccagatggtacacaatgaagtattgagcaaatgcttttagcgttggttttggcatccagccccttttggtaaatctgctccaaattcaccttttgctcaaaaatttgtcttctcccagaagtagatttattctctcccattttatatttatttggtgtgagcctttttgttattatttcctttctctttacaaaggcggaagagacggaatttcaacaagcaagcgacagaaatcctgaatgaatatttctattcccatctcagcaacccttaccccagtgaggaagccaaagaggagttagccaagaagtgtggcatcacagtctcccaggtaagcagcacctcaaaagcctcagcctgtagcctggccatggcggggcctccggggcaggctcttagaggtcttgctttactggacattcatgccttgcaagttccatcagctatagccttaaaatatcaaggtaagcacttgatgtgtatgcgtataagtgagtttctaggtaagtacttggcaaaacttgagaagaaccagcagaaggaagagaagaataagtagagtacaatgtaaaaacaggattagggttcttcccatcgagcactcctttgcttcaaatgggtgaggtgtctaaagtgtactaggaaagttatctgcattcctcatgctgttttttcaaattcagtcaattccttagccattttttgcccaacccaggaactttaagagtcagtgaatggaactagttgttatatagccttttaaatgaaagaacttaaatgtctcctcttgatgtgctgactctataactgatgggagtgtaggaattttaacatgtcactgcgattacattggaatggtgaacaaaatgtcactgaatgcccccttcccccaaagagcaataaccataacaggtggtgtctgatgacttggaaagatacatgacataaaatttttataggcctagagttttcaacacgaatatgaagcagagaagtaggcaataattatgtgtacgtgtattttgtccactcaaaagatccacccaaacttcttattcagtctgaacctcaaataccaccactggtttctaattgagaaccatagtgataattctgaaatctatcggagaaggtttttcttagaattttgtcacatgcaggagaattaaatgtactgatatttccattaaaactggggaggggagggagtagtgaaggctactgtagcgagaaatttcacttaccatttttcaaatgaagtagatgctcttttatataaactaagcatctgtacctccttgaattgaatcctgacttctgttaatccctgcagggtgctgatcccatcaacctgtgtttagctgtacagaattaggtccagtcagaatatagagctccacaaaagtattgacaatgaagggactgtccaagccttcccaacaaactaagatgattttacagcagcaaatatccttgaaaacattctttcagataaagcagaatgaattgactcctttttaacctgggccttccttaggtgctttgacccagctggaggtcatttttagtcttgacagttctgggaaacgggaacgtcagcggtcaaactcaagtagcctagttttttctagggctgtcaccattcttatccaaatctaaaccccttttccacaaaaaagggaattaatgctttttgatacttgctacatgtttgaggaatgcttctaggtatggaccacaaatatgcagcaaatatcaaatcactgaattttatcatggaaccttctgcttttaaaatataattaaattactactgtctgaattccaagtgtggaattcagaatttcaacttcctgttgaaggtaaaaggaattctcctggaggtaatttgtagtatagctggatacaagttaaaatcctgatctgttcccgcaaccttcacttccttcattatggaaactcaaggtacaaatagtgtgtccattaaaatccttatttacatattgtgtcacctttccctttcctctgtccatgccaaagtcatgccattctttcttccccatcacatctgtctctccccaaagcaactaagctaccattgctaaacaagtccaatggaagacagtataatatgatgtcatagaaggagcattaagcaaggagcctatttttgacaagagtcaactgtgggatcctagggaactcactctttctttttggatcttagttgccccatttactaatcatggtttgttggatcacatgatttattaaatctttctcctaattcccaaagccagggaatacctcttgggctgtatcattattgtctttttttgaagtcacaaattcttttgaaatctactaaaagctattgatttcccccatgacccaaaacaaagatatgttgcccatacacccaaatccatctgaaatccgcctattgactgtatctcctcagatccctaaagagccctttttctataccagagctactctaagtgtgatccacagaatgcagcatcagcatcccctgggagcctgttagaaatataaattcttgagtgtcaccctaattctgaatcagaatctttgagggtgaaatctataatagaaatttgttttaacaacttccccatgaacacttaactttgaaaagcaatgttctatatgctttatctgagtgatcttttccatgctcacagctacaaataatacctccatttgaatacctaatggaacttctcccctgcagcaccaaactcataaattttacttcctaatggacttcatcatggctctgcccagaggttcttcaaaattaacttgttcaaaatgtgaatcaaactcttcccataaaacctactattctttctgtatttcatgtctcattctgtgtctgttatctatacatccctagtgcctaacgcgtattaggcccttagtccatgactgttgagtaattagttcattcatgataacactcattttatacattgtccagatcattgtctgttggacaatgcaggaagtccctgaactgacctagcaccttcctaccagttccattgttgtcatttagaagggtatcattcccacaacatgtcccctctttacccccttcagctcatattttttttacatataattggacctcaggtatttcttcttcaaaagtcctctgaaattatcttcatctttttcccttttctttcagcttgtgcagttatctgagaaaaaaaatctccttaccttttttcttcttttcctatcccataaatcaaaaagcaaccataattatgactgattcctatgaatagtgaaagttatgtcaagaaaaacataaatttcaaagtgaaactagatatgcagtgatcctgaaatacacccaaaagtgtccttcctcctccagtttacctctttttctgtagacatcagtgtttacaataaataaagcattttcttattgaatttttttcttttttgtttaatattgtggtggtacagactgatttttttttaaaaaagaaaggcttggcatttctgctgtagtataaactgtataagcctttcagtgctatccttataagatgttttaagtttgttaatgcgtttaaaaaattaagtatagttttgcaacagttttctttatctgccgtcgttgggagttaaatatcaatgatatgtaagctgtggtacatgtgggatcaactcccccttccctcaccagattcatagtttgttttgtaattatataaaaacatcgacattttagttcaaaatcatatctggaatgtgggatataaaactttccttccccgggcaggaattatgggggtaaaacttgaatttaactgtgtctccacttgtgtctggcagaggtcttggtatgaagggagcagaggtaccagatcaagccaagacacctgctgcgaaccacatgaaggaaataaattaacaaatgaaagtaaattaggtttattgtgtctgctggctttaacatttaaaccctagaattcaaggggataatcatttgtatgctacagtttttccttatgtagataacactaagctttacacaaaatagtcagtgaaatctggtagattgaattatattgatcctaaggtctatagtgaaatacagctaagaatctcagtccacattaaagttatgtaacttctaaaaatttgcaattaatctatcacacgaaagcacctatatggacatttaaagatctgtgtatcttgatggcatcaagccagctttcacattgataaacgctaggggcatttctcctgaaatgttaggtatattttagtgtcataactgaagatgtaagcaaatttaaaatgcttgctctaaattaaaagggttctagcttaaatgagcagctcctttataggaagatttttgtcacagtggtttcgctaaatttcagttatattaaacaagagaatcgcattttatgtagttgtccttttgaagctcttacttcagatctttttactgatgttgccaaattattataggataagaccaattagcttacctcttcacctctcccataaagccttttttttcttctgcaatgtttctgaaggatgaaatgtgaactttctcatcttctcttaaactactctaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttagttttttctttgattgggggtgggggaaggaattgttctccatttttatactggctgttcctacattgggattttcttttaatttgttaggcttttgattggttaatttctgtatttgattgtatttttggatgttaatgtcactttgggctctttctttcatttccaaagagcaatctgttagactttttacaacgtgggttgtctggaggtttgcattaatttgtctattaagttaagaccaaagtaaattggttagcttgaagagacctctaaattctcctctcagggatatcaataagtaagttagacatagtgcttagagatagtctattgggattctgtcatttggcctgttttatataaagcttttatccttgtcagttttgctgttccaacaacataatgtctgggtcacttattagcatgcattctatgcagaaatatttactcttctagcaaatatcttattagaatgctttggtatgcaaagccaggctatgaatatttctatatattgtttatagttgttgttctttattgttttttgttggtcttctttatgattatcggtcatgagctatgtaataggctttgtttcaggaaatatgcattatatcactaatttaagagtttaggtcaaaatactatattttggggtgtgccttgtgtcatcagttcagaatttctacatgtgaaaaaatgtagttaataatgcaaaaaatataacctttgtgtttgtatgctatggaaggcatgtggtaatttttttttccctttggtaaaggaaagacaagtattttctcattaaataagtttggtttgactttgattagggtgcacagctaagaaaactgatgattctaacttaaaagtttaccaatttaaatatgtttgatcgtaatatgattacaaacctaatgtctaacattttttagagtatgtggtatctttgaccacaaagcttgtttgtccactaaaataagttttcttacagcgactcgttactggagaaatgtagggttccacagactgatgtcttctgtgagcttccagatgcataaatttgttatgataaggtcctccaagtcactgggctatacccagcacttcttttgtggccttcttttatctaaatggaatcatgcatgaagagtagcctgggctttttcaacatggatataataaaacaatgtagaattcaatccagttttaattttcccagcactgcaggttagattcctatgaggagcatatttacttttttagaaatattttgtttttttcttcctccatcatggtgtgattgacaagggatcaaagctaacaggttcaataaccagagagagttccatcttctccatctggtcaattattaagaatttcagacccaacaacaccagttgaactgtgctgctaggcagacattttcacttgtctctttggaagaagtacaattctgtcaacattagcaaaaatgcactcaacactcctgcaaaggttatcataatgcaaaacgatatcaaaatgactttttcctgtccctggtatatctgcatcgcagatggcttagcatgatttatgactagtccttagaaaagccctgtggactttcttcattactaaatttgtaactatttattctttcctaaagcccttaaaagagaaaaataagcattttaaccctctattctgtgtttaagaaatatggttgcctcttatggaatgtcagactatgattacagttttctaaggaatttttttctggtggcttaaacatcatgtgactattctgagcacaaagtaaattattatggaaaatttgagctaagccttccaattgtgcgtaagttgttggaaataatctgcacaggaacccctttgtagtgctttttctaaagtagaggcaaaagaaaatactattgtatgtgtgcaatagcatggaattttaaaagataaacattttaacaggaaaagttataaatgggcttttctgtattttcttttgctcttaaccaacctaaatcatccacacaggtaaagtagaactttaaaatgttcaaacttttcacataaggtgtttattatgttatgtacttgctcttcaataatttggaaagataaatgataattgaaataaattttaaataagaggttaatatgtgaaaatatattttggcagagtttgaagtctagagttgtagaacctaggaacttttcataacctcagtattgaagcagaagtttttttttcagagttttacaaaatataagtactcatttctattgtaaagaaatatatttctggctgggtgcagtggctcatgcctgtaatcccagcactttgggaggccgaggcgggcggatcacgaggtcaggagtttgagaccagcctggccaatgtggtgaaaccccgtctctaccaaaattacaaaaattagctgggcatggtggcgtgcacctgtagttccagctactcgggaggctgaggcagaagaatcccttgaacctgggaggtgcagattgtagtgagctgagaccgcaccacttactccagcctgggcaacacagcgaaactccaactccaaaaacaaaacaaacaaacaaacaaaaaaaccaaatatatttctttgcaagtaaatcctcttcctgctagaggcttctgtatggagaacagcacttcagtaagattacttccaaatatttctatttattgatatgttccatgtctcctatcttcttaagcataattttttttttaaatcacttaagactaaaacccggggggattagcaagcatttagagacatttagcatgcttcatagtttataccagcaaagtgagacaaaatggatgaagcaaagaggaagaatagaaggaaggagagaaagttaaattttgaaaaaagaaagcaagaataggggccagttgaagcactggttaaaacctggggtctataattcttctgtagtggcctagagtaatgcattcttaatttcttaatttcgatgagattataaaacctcagaaaaatgaggccctttcaagaagcttggattatcttctgcagaggattttaacatccaagaagaaagaaattgacttgtgcattacagatgttcactgtggcatgccatcagcgttgaaattatatcacattctgtgattagatcagtggtagtgggcttactgaagctcagaaccccaagattggaattcttttgcttagctgtgtgtttgtgtcaaggacaacagcaaattcaaccatgaaagttcttcctctagcactattttagtcaatggcaagcccatatacataatcttgtaatacccctgtattagtccattctcacgctgctatgaggaaatgcctgagactgggtaatttctaaaggaaagaggcttaattgactcaggttagcatggctggagaggcctcaggaaacttgcagtcatggcagaaggtgaaggggaagcaaggcagcttcttcataaggcagcaggaagaagtgccgagtgaagtggggaagagccccttataaaaccatcagatagatcttgtgagaactcactcactatcacaacagcatggaggaaactgcccccatgattcaattaagttcacctggtctctcctttgacctggggaccgtggggattatggggattacaattcaagatgagatttgggtggggacacaaagtctaatcatatcaacccctaaaaagaggtttggtgtttttcaggattgatgaaaggttattatattaaaactcagagccttcatgccctatgagaagtttttatataatacacacagagagaaggtaacacatacagagaagttgactaaaactttagtaaatccacaggaattcttataattttgttttttaaaaccaagtgaaaatatttatcccactgatgttttatctcatgtctttcttagtatgattctcctctttatttttgattgaagagtgaaaacaatttgtcctggaattggaactctacaaccttgagatacatacctattgaagggttttcacattcaaccagacaacactttactcttttgctttgtcccaagtagaaagtaacaatgaattttggaattcacaaagggaaatggaaaagcaagcatgcatgggacataatttaagcttacatctagtaaaaagggcctatcctttgagctcccaaatggtatgagagtccaatctaatcaagctgaatcaggctggccacataatctatctgaagtcttgatttctaaactacagaaaatggcaactacttcattaaaatactgtaaggaatattgagtgaatacatttaaacactgaattccttaaaaggaaaaagtaaatccgttcttgctctaggtcttttgttctcatctaggggcaaatttgtactcccaggggacatttggtactatctggagctatctttggttgtcacaattttgaagggaggttgttattggcatctattggatagaggataaccattgtagggctaaccagcctacaatgcataagataatctcccacaataaagaatatttggcccaaaatgtcagtagcaacaaggttgagagatcctattctaggtttaagctttatcattattattattattattatttttggattatgaagttaactgattttttttattgttttttgcttttaatttttttgtttttctttaacaaatttaagtctcctgaagattctttagagtagaaatgcaattttctggaacttgtctgatgaaaatggatgtggacactttaccacatcatgatgtctgcccaagcaaatgcattataatcataagtgatccagtatttcttctctgcctagttgagtgtagatttagttctgcacatgccccaaatgtctgggtggcagtttaaatgagctgcttgccttccttcccaaaccaaattcagaaccttttaactgacaaccacatcttaaaatgtgcttctaatggtagctgatggcttcaaaacagcctgcaggtaaggtttctgaatgatcttctcagcaagccaagtctttctgtttcagttctttgagaatgccacagcacctccaagagagcccattcactatttgtcagtggatcgtgtgcttcccaggaggttatccattccatgataaattctttccaacttgcagtgctgggtagagaacatgtcctccccttgtagttcagatgtttttgtggacttccgtctgcttcattgtggtgttagtggcacctggtctcttccctcagcacagtcagtgcttctagatacttatcagagagtgagaagccatggtaatattgtacatgggtgtacagacacaatgaaatgctgaaacagcacagccaagagcacaagggactgtttcttcaattactgctctgatacaaatgcacttgtatatgaagtacatttatatatgcatatttatctctgtgtacattaggcagccagacatatttacagtttatgcacatgtattttttaaatcacctgtgtcaattgcaatgtgtatcttttaaatgacacattccatgccttcatggttccatggatgccacgtcattggacatcatgtagccctttgggggtttctcccatttctaagtttgtatactaatttccagaaaaacattggtcaaacttatagtccttatgtttaggctagatttaccacagtggaaccagtggaatctgggtggtgccaggatggaccttaaggttgactctctgggtgatgagacatcatctagagacgatgggagagaagtaaaatacgtgagcctgaaactgaacactctggggagttgggtgggggagtctgatgacatataacaaattataatttgggttcttggagctgattcttcttggttctgatgacatctaaatgcaagcatgtattgtaatacattacaaaatgacttttattatttaggttatatctgtgattacaaaaaatatttgagagggatagaactagtatatagagatattatatatctacacgtgagaatgtgatctgtgccacacattgtttcattcatatgttcaggaagacagtttcaaagataggtcccatattaatggaaggaagttacagaccaaaggctttgtcccactgactgggtataagccacacctggccagatcttacacttgttttgctaaggccctacctttctaattcctttcagataagctaaacagagaaatgtgggccagatgagacaggacaagtcgcagagctatggagatggcatagtcctttggttgatgcttgagtcctcctctaacccccaaagaaagcatttattttttcctgggaaagaaggaatgagaagggagttaggtggaggattgttttatttagtaaaatagctaggttttttttgcatgcaaatgaacatcccacaggacaaagaaaattggagtttttttttttttttaatgttgagttgtccccaggtttataaatcatctgctttctctaaatggctcttgcctttaaagtatgaaaacaccatgaatagcctagatagataccataaataaacagtgcattgtgtcagagtttagagttcatcatttgttaagtggtccttctatgggggaaaaaaagtcctctcttctgcttagctgcacctcttcatgtggggcaggaaagctctcagagctcaaatccctaccttaggagaaaagaaaagtgtcagagctgaggcatgaatcattgttgggtgattccacactgatgatggctgtctcagaatatgagggcaagagcacaatttgagcaatatagggttggaaataatagagtgcaactgacctgggtccctaaggtctttccttttccaggctaatgtcatgttttaaccaaaccttgcacgttgagctttctttcctaatgcgctgagctgcacgatgacttcagaataatattaagcttttgcaagcccttatgcttaggttgaatgtgggctaggttcaccgcagtggaaccagtggaacctgggtggtgccaggatggaccttaggctaactcactggatgatgcttccatccctgggaggtgaaaagcagatggctaatggcccttcttgaggcccacttattattattattactattattattattagcagcgatgtttcatattttatgcatgcttgagaattcctggcccattattttgttttctctgtagtcacaggtggcagagaagggtagatcactcccacatattcttacagtcctcaaggttccttgggctgttgccaccctgcaagaaatttcaccttcattttagaaattaagaatgtcaatagacccatatcatagagccactcctagtaggtgacattgccttcatgcactccctcccaggtgctgctcctcacaggggaggggatggtttagcaatgacatatttagaatccagttgaatagtttatgtgctctatcatggtggcagaagtaccagtgaccagcccatagcctccatcttgtggtcccctggccaaccctagaattttagaggcatagaagagagatcctaggtctagagactacaatccaaatagactaagttgggaagaataaaggttccctttcttggcttgaagttgccaaggggaagcagttctattgacaacttgcagtaaggtatggcttcacataacataaacaatatgcaccctttattgcttgctctgttcttcatgctactaaccagactctgttgatgttatttttattttagtttttatttggggggggttgctttgcatgtcattcttcctcttggctgttagttgcggggtttgagccttttcctttctgtgattcaggtgcctcactctttcctttccaggttcttccagttcttttaacatgtcaaactctggagatttgttcatgagcgtgcagtcactcaatggggattcttaccaaggggcccaggttggagccaacgtgcaatcacaggtagggacccagccaatatgtcaccaggtgaatgccttagagtccaagagccctcagttgtattggacttcctgcttctgtccagagagagagagaaaaacagatcagaaccaaaaccttaccaacgaccgaaccaaaatcaagacaaccattgtcatggggaatctcgtccacactttgtgaatgcatttggctctggcttttcagttgtacttggaaggcaggagaagaacagtaagcacagggcaaggtgaccgagacacatcaggcaggtggaaccagcatattctttattcaccaaagggaaaaggaggaggtgttcaggatgttacctcaatttccaggtctccctctcatgtgttggtttctcctgctcaatatttaccatataaagaggcaattaacaagcaagcaaatatattactatcggacgttttcattttaagctttaaaaacacccagccaggttgactaaatacatttcttagtcatccttgaggtcaagggacttgagtttctggtgatgagtagaagtccacattgggaagcaaaatcaagccatgtgatatcaaattttagtgttccatagtaagcagatttccttcatgatacttgaagaagccatcctactacctcagcatgaaacatgttgtgagagggtaaagtagtatgctgtgggtcagaattactagggaagttctgagccatgtcagcctagtttcccaccctccatgtggaacaagaagcattacaagcccggaacagaccaactggtcagcgattcacccctttcttgagaaacattgcctggaaaccagtttgaagtgatatggtcaggctttggtcaagtgactaaacaactggccatcacttaagtcctcaaaaaatacaaggtctcaatcaagtactgctctctctgtgagatggctgcccaaacctcctctaaacagaacctttgtttttataggatacccagcaaaggaacagctgtataggatgacctgtagggaagaaaaatggggagaaaagaaaattccttcatgctttcccctccagctccctctatcatcctaatccttaccatctcatgcagacttgttgaactagtttcaatgtggagatcccagttttcttttaccattttacgtcttgcttactgaactcagaattctttatggattggcatacggaggaagctagcctcctcctaatggactctcccaggacaactgtctccaaaatgattgcattaatatggcatgcccaaatggtggcctgcctgatgatgatctgcctcccttttcctacacctctctgactaattttctctctgttattgttcatctgtttaggtggatacccttcgccatgttatcagccagacaggaggatacagtgatggactcgcagccagtcagatgtacagtccgcagggcatcagtgtaagaaaacaagcccccccaccccctgctttgtttttattctttcactaccaattatttcaaagccatagggcccagaatgccacttagtagggcttatcttagctttacggtcacctagtttcttgtttctgtatcggtcatgccatcggcagcattctacccacaaaaaaagtggcgattgggcaggcttcatgcaggcagctggcgtctagggctgtcagacgcaatcagtgtttgcatggcacctgcggccacatgcgttcagctagaggagctgctaaacaggtgacacctagtacaacagtggtaggaaatgtgaccacaagctggggcctgggaacctgggaggtgaaaccagtagccaaaatccattgcatccacgtctgtggtctgaaaaaaaaaatactttttttcaatctgtctatggacgattaaaaagaaaattaacacagaagctgggtatgtagaagggatggggagggatgcagaccatcttctacttgttcttgggtacgctggcggctcctgactagcatgaaaattcatagcgacaagctatgtcgcacagagtgaaatcgatcagacagacacaaggagaaccgagtgtagatttgggacagcaatccaacttgatttctcagatcaatcgtctgctttctcagcagcggtgacagcaagctgggacaagagggcagcctggaaaaggaggctgttttttagatcagggatgattcctgggcttttagaggtcacaggaggcttgagtagaactattggctcttaactattgaagaaaggtttgggtggtgggtagtgatcattttttattgtttgtttctgttgctatgattaaagtgaatgagggatcgaaggaagaagagttaggcatgatttattaatgtaatctatactaatggagatataatgtctgcagtgaaggaggtgatgacctcttcaactgcgttggtcaagtcatacatgattctgtctggtttgggaggattaagagaatatcagttatttctcagatcagatgaggaatgattgaacacattaggaattcttacctcataaaagagaaaatttgggggttacatagtagtgtaaggcatgctaacactattagattcatcatgaatgatctaaaggggttaggataggataggactactaagtagtggattcagagaaacaggtttcacttcaacatctgatggacctttctcacagtaagagtcctccaaagaaggggttggctgcccttaagtgttccccatcattggaaaattcaaacatggcttggctagctgcttggtaaggatgttgcagaaggaagtcaggcagcagattttgattgtcttgatgacttttaaggccacttacattagggagtctttattttctacctttttcaggcagaatctcctcttgagtttacacaatatttatcaagtcttctctggaatggaaggagagaagtcaaagttaaccctgttaaacatattctagacaatcattttactttcttggaaggatttttaggacagagagattcttcccatcttgtgcttgttctaactacattaactattagtactgcattgatggctgacttactgggaagactgcttggaaaaatacaagaagccattgtgggaaagtgtattctccaaaagaattccaaatgaatgaagttgtttggattttgtctgagtgcaggtttatacacacatgcatttatgtatttcctgaatctttttgggatataagtttttccagagaaagctttgctctgtgcataagcagaagagaagaacatgaggaaagcacaagagtgtagggacaagaacctggccatactcaaaaggaactgaaggaagtccacatgactgggcaggaaatggggctgacactgctgttatttggcgtctttctttcctaattgggcagcatagaagagagagagcagcagtcagactctggggggtgggggggggggtcaacactgacccctctgacatcatctggtgggctgggaataatttctgaaatagtgtaaccaaacatgtgcagacaattatgtctgatgacataagcccaccacaaaaactgggcctgaaaatgccacttgaaagagtctctcactttgcattaatttttttttccatgaactgtggttattttatttctgggtctttaatatgcagggtaaatgaatcaaaggctgatcgtgatatgttcttttgatatcagttttaaattgtgccacctgcaggaggctaagcttgttatagtgagatgtatttttagatggtggtattcgatgctaagacatgtgtgtatagagcaggacaatgactgccagcaggagagagagaggaggggagacaagaagagacaaggacaggaatgaaagctttgagccaagaaatgaaaataaacagttcctaaccccaaagctgcagtggaattcccagctgggctctggattgtgtttgattcggtggaggacattttctgggcagcgtttatctgctcccctggctgggctttcacagcacccatatcttatccaagcagcatctattttaagccctgtaaagttcagaccatttgcctttaactgaccacacagcagtagaattgcaaggtgcggtggtaggagtattataaagggagttgggagctgctagtcctagtaactcatgtgcccgtgggcaaatattgaatctctcttctagaaaatggggacagtaattcccaccctttatacttacttcaaggactggcttagggcaaatgagaaaataagtcggaaagggattggcaaagcataaattattccacatgaatgcagtatgaaattttgtaagtgataactttctgatttgaccttttttctcctctgatgtgagcagttttctcagtaggtagttcctagtgaggataggttaggacacatttgtcacttttttttctcttctgatggaaaggtgtgcttttgagatggatatagtgttatgcaaggcctaaagacccccttccttagccatggtgagagttaaattatacctccttaagtactttgtgttctcatgtgacaatgggcaatacttactaagcttagagtggctctaagtaatggagggagattactccacttctctgtcaatcagacatacttaaagatcacttagctatcacattctttcctatccattctcactgccaccatcctagttctagaaatagttcattaactagactattgccataacttcctaatcactgttgctgtctttaattcctcctctctcccacacaccctctgaattttgtcattcgttgctcagaaatctattgcctacccaagcaagctcaaaccctgagtacgacattcagggtctcttacatctgggcccagccttcctgtccttctacctcatcctcctgtcatcaaaataaactctggatgccattcagtatggccagctcatctttacctcattacccatttttccccttacatttactcatgtatgccatctacacaaatgtcctttcattcccacatcacctctccatcccaccccactatccaaatcacactgagtctcaagcccagctcctccttcgtgtctttcttcttcttagtccttctccccctcttctctctactttatcacagacacacattttctttgcactgtacatacatgcgcagaaattacctctgtgtctttcacttctgcccatgtgtatggtcctaaaaatgcatgttctagttgctcaaaacatgttcgttgaatgaataaatcagggaggggaagaaaagatgctactaaattaaaaattcattttaatgaccaatagccacatctagtgtaccagctataaagtatctgatgagaattactactttaaatgcttatccacaattatactgtctttaagatccaaaaatatccttaagtctttctttttggaaaaagtttttcaaactttccggctgatgtatattctctgagaataagattcaaatcagcagtaagtgtgtgaatttatatggtgatgatattgcagacataattatcctcagcagtaggatcattcttattatgaattttgtaaaatttctttcactcctcctatccttaaagagtccctgtgtttctatactaaaagaatccctgtttaaaaaaagtatatatacctgtttgtaggatagccatgcatgtagcaacatagtattgtttgtgggatagctgtgcatgtagcaacataacattgttgtaactggattctcattgttgtaattgccctccctactagatgtggtattggaacctccaaggacaacctggaggaaggtggaagcaacttgaaattgggaaacttaggtccttcttgtgacttttcttttaaggagtcacttcacctctgtgttgttgcttcatctgtaaagtttattagataagcaaactgaaagctctctttcagctcaacagctctagaattctacatttatgatctttgattcattgttagctcaagggacaccagactaaattgtagatcatccctccagaaaactctttcattagagttagtaacttctattctttctagccaaccccagtgttcaaattatatcttgaaacccaaatgggaaggaagaagtgctctcgttacacaaacttttccctttgaattccttggatatttgtgatagcagaaagcattattctttagggtaaaccttttttgtttgtttgtttgttttctttttttttgaggcagagtctcgctctgtcacccaggctggagtgcagtggtgtgatctcagctcactgcaacctctgcctcctgggttcaagcgattcttgtgcctcagcctcctaagtagccgggattacaggtttgcaccaccatgcccagctaatttttgtgttttcagtagagatggggtttcaccatgttggccaggctggtctcaaactcctgacctcaagtgatcctcctgcctcagcctcacaaagtactgggattataggtgtgagccactgcacctggccactatatttaattgttttaaaatgtgggttatgggaatgaatttactccagccagtctttgatgtaaatagatacccctgtggatttttcttattcaaaaggtttggtgaaaatggaaataagtgtcagcattatctctacaaaggtaacatgccgttaacatcaatttatgacacaaaaaaaactcattaatcttgctttgtaatcattatagtaatagaaaaatagagatgaagcttttatcattgtaaaactgtaacataggtgtttttgttttttcttttctcccatgttaggtaagggggaaaaaggaacatttaccaagtaaataaatagtatataaatcattaggacaaaaatagcctcctatttaaatgaacatatttcagacatttggataccacggggatacttagtaatacttggccacatgccataattttaattttttcttaactatttctgagagacctccttccacttaaagtatatattagtaagatgttgccacatgtggaattgtaaggctgggaactgagggtaataattaaaattcatatgcatatctttgaaaactcatgttaattatacacagttttaattcttctattttaccagctgaatttgaatttcaaagggatgaaaacatacccagatgtgccccccagttggttgtctttgggtaccttctggtgctatgaccaggaactagtgaacagccccaaaactgaggggtaaaggtaccaaggaaaatcgaggggtctgaatgtggcagaccagactgtatagtgtttgaaggcagcagagatagagtagatagatggaagctaacagcctcactttccttcatgacaaaactattgggaaacagagtaagtaagtgcctttccttcttatagggcctttaaacctagcaccataacaaacctgagaccagaaaagcattttatttcagcccacgatgattgaagaagcaaaaaatatcccagtaatgtgatttcatatgcaatccaatgtttttccccagctcccaagtgaaagcccttaaaagtacaaatgaggtcagatcattcaatggcttattcatgcattcatttattcatttgcttattcattcattcactcattcattcaataaacataagcattttttaccttgaggaatgaagctacatcatggtacatccaggtcaaattggagaaactctgatgtcagtcagggtacattttcccttttagtctcattcagcactttgtctgggattgaatttcctgttcctagaagactagaccaagggaactgaccaactctatagcctaggagggaatttgaaattaaattatatgacagaaggggggaatttaggaccaaccagcaacagtttgagaaaagtaccaaccccaaccaaatagatataccatggacttaataatataataaaaagcattattttgtagaaactgcttctctctttgtagaactagttgcaatgagttatgatcttaaacctagtgatatgatcacactaaacagtatcacatttaggctgtgtgtgtttgtgtatgcgtgtgtgtgtgtgtgtgtacatgtacattccacttttgcctgtgtgactatgaacaagtcagtttctcatgataggactcagttttctgaattccaaagaggacagttgagctggattttgtttagggcatcttccaatgccagttccatttataaacaattattgtttttccattcccaagaaaatgcaagattgtgttttggggaagattctcaactgtgagatgacagcgtatgctatgttcctttcattgcaattggtgttttatagcatcctgcccagcctggcccgcatttggccccgtagccatgctgtcctcaggctaggatctggttagttgttccagactcaagttggtccctccttctgctctgtggagaaaaatcacaacctcaaagggataggtttttttttttatggttgctcctgaaagtggcatggtccctctagatgtcagcaaatattaaggcaattaaataaggcaaattaattatgggaaacattagcattgatttctgaagacagtcttcttcttgctgagtctagcctcaccccttcttgccttttaggaagagttccatgttcttagacaagcttgttttcggataaaatattagacttttttcttagaaaatccctttgttttaaaattggtaatttttaaaaatcccaatctctggctacatttgagtttgaggaaattctttttcacatctctaaatatgtttcaatttgatagtattagtaaataagtaaataaaaatgccttattccacaaatgtttattgagatccttctaatttccagtaccaggaatacacacatcaataggacatggttcttatacttcataaagtcatagaaagcaaaaagaactggcagttatctggttcagttatctgattctctgaaagagaagaaatataccagccagtatagtcaatattattttcaaaaatttggtgaatggccattgtaaggtgcatttacacacatataatcatactcctatcaactataaatatatgaattgcttataagcatgattgacatttgttattcttacatagattttgtgagtgactagcaaaagctgttctttgcttctagaaccatgctgtcccaatataactttttgcattgatggaaatgttctattttagcactgtccaataagttagcctttagcaaaacatagctattgagcacttgaaatatggctagctcgttatcctcagcaaactaacacagcaacagaaaaccaaacaccgcatgttctcacttataggtaggaactaaacaaagaaaacacatgggcacatgggggaacaacacacactggggcctgttgaggggaagaggggagggagagcatcaggaagaatacctaataaatgctgggcttaatacctaggtgatgggtggagcaaaccaccatggcacacatttgcctatgtagcaaacctgcacttcctgcacatgtaccccagaactttaaataaaagttggaaattaaaaaaaaaaaaagtattgggcatgaggtccaaaagagaattggtatcaactaagtaccgttaacatacaagatatgacaatgaagaattaatactgattagctgctagatacgaagatgcttacatataaacaagcacgtttttcaaaataaacatcttgaaactaaaaaaaaagaaatatggctagtttgaaaaagaaaataaatgtttaattttatttaatttaaggtaatttaaattttcagtagccacttttggccagtggctaccatgttggctagtgaagttctagatgctctgccggttatttggtaactgtaacttggtaaagtaagttaaaagaataaatgtgatggtgtgcaagagtaatataaaactagaaaatataatttaaaaatttagaatagctaggaactatgaaaagtaggaagaaataatttactaatcaactacaaagcattagcagaataaaattggcaggagagtgataaaatcacatgtaaattgcaaaatgaaggttaaaatgaagccaccaaagtggggtgacggtgttagaggtgtcaccatgctgtgaaaacagagtagacttcttaacacaaaacatagaaaagcatgctttctgcttaaatcagcctttccaaaaataaatagagctctttattaaaaattaactatatacaagaagtgaactctggttatcataataatatgcttcaaactattaaataatatggaggaagatttaaaatataaatatagaaatacctacatttgttatggtttttttgaaataatttttcactgtgtcagccactaattcatccaacctaataattcttcaagcccaagcaggacatgtctttgaactcatcttgaactctttctttaagtctaaaccctgtagggcttacataagatagagtctttgtttcaagtctcccaggtgacctaagcctttgctggcagcctctgcctcgccgtttcttcctccctgccctgctagtctattccaagtgtagtctgcagatcaacaacattacctgggagcttgtgagccatgcagaatctcaggccccgcccagacctattaaatcagatgctacaatttaacgagatcccctggcaattgttaagcacattaagtttgagaagctctgctctagtgtgtaaagtctacatgctctctagggcttactgaagagaaggaattacatagctttatttgcattaaggataccttttaaaatgttttcaacattttatttaaaaaattttcaaacatatggaaaactggaaagaattttacagtgaaatcactattctcaccacctagattctgtcattaatatttaactctactggcttcgtcatattgtcacccttttatccttctgtgcatccatcaatccatcttgatttcttttcattcatttcaaagtaaattgcagacaacagtacattttctcctaagtaaatatcctggtacatgtatcattaactagagttcaatatttatttgcaggatttttctcttctggaacaaaattgtacacaactaaatgtgcaaatcataagtatccattctcttgaaggttttttttttgtttattttgttttttgagatggagtctcgctctgtcacccaggttggagtgcagtggcgcgatcttggctcactgcaagctccgcctcctaggttcatgccattcttctgcctcagcctcccaagtaggtgggactacaggcgcccgccaccatgcccagctaattttttgtattttttagtagagacggggtttcagcgtgttagccaggatggtctcgatctcctgacctcgtgattcgcccacctcagcctcccaaagtgctgagtctcttaagttttaacaaatgtaatacacttgtatataaatttcctaccctttgttttcttgtgtctacctcatttgtatagtttacaaaacaaaataagaaggaaatggaaggacagggcacatagttgtccacagaatagtctgttcttttcccagcagccaggggctccctcccttgcacctcctatcctcagtccctcattctatcttatagccaagcattgctagaaaggccaatttaaatcaaatgagatggtttagttttattctacacttgtctcatgttctgatatggtgagcctgcttttaaaggcttgtattcaacttatattcacatttcaatgagaaaagtttttgagatatataaaaatagaaactttctaatagatatcagaaagttgaattatagtgtgattacctcactattacatttttcctcttttgccttttgccgtttctcccctttcttctttccctttatccagatagacccttgacctctagtccttaggccaagtgaagggaattgacaagaaccttatagtgaaagaatttatgttgcctggtgataagcattttggagaccgaatgatatggaaaagaactcttaagaactcaattatgactgttctgttgtgtatcctctcagggtggcatatggaaggcttacgactagttcatttctttattaaaattaaatttggaaaatatttagacagctctttcctggatctaggctaccctacacctttattgtgtcatatttggttaacctgcctagatagtgacccagtgatcatacatgagagcaggattttagatcaagtgttacttcgctgagaaatgtgtggtactcattataacagaaggcaagactgttctagaatctaggtgtgaagtatcagcagaggtggatttttaaagtaagttaaaagaataaatatgatagcctgcaagggtaatataatataaatagaactagaaaattaaatagaaaatataatttaaaaaattagaatagcaaggaactaagaaaaagaaaagtaggaagaaagaatttagtaatcaactacaaagcactggaagaataaaattggcaggagagtgataaaattgcatgtaaattgcaaaatgaaggttaaaagcaattaagatacacgggtactgaagagaataataaaaacataaaataagctaggatgagtagttaaaataaataacaccagctaagaagatacttacaaagattaaaaaacagatcaagtagtaataaaataaggaagtggtttaaggcagtaaattaaagaacaattaaaaaacaataaggagagaaaattaacaggccaaaatgacacttaataactgtattaatagctaacatttattgacttctttctatgtggtagacactttatgtacattaacttctttaattcaagtgtattaaaataattaggaatttatttttggggtaagcaaaaaaaagttcagagaagggaaagccaggcatcagggcaataaccctcccctcgctaaaaaaacaaaaacaaaaaaaaacaaaacctgaaggtaagcaaaatagatctgcagatatcaattttcattccttgtctaatgtggtgatttttgcggttgaaaaacacccagtacctgccctggtacttttcttcagatcacaggttcccgaagtggctagcgttataaaatgagcattctctttttctctcgtcatagataagattgacctttgttaggggcaaagacgttttcaatcagtagaatccatagcccagaacctatggcagtgggcaaacatctcataagcccactcatcttacgtgacctagctcaggcctatcttctggaagtacttcctagttccttcagactgtgcctatgtactacttagtacactggagttggagtggaatttcgtttctgacacttatctttcattcctctctagaccatagaattctgaagagaaggatcatagttttatatcctgttcctcaactcaggcctggtatacagtaggtgctcaatgaatgcttttcaaagtgagcctagttgaacctgttgtcagtgggttttgtgtgtatgtttttttaaccagcaaccggtctattctgactggattttctgcctgccttgaacccccacaaacatgtatttttgtgtttctattatccagagaatttcttccacaagaaaatggctttttgtacttttttttttttttctgtttaccacagactggtacccatcttttacctccaacttatttatattgcataccctataatttttatgccagaaatattttatgggtgtatatataccctggatatgggtatatatatgtatatgtgtgtgtgtgtgtgtgtgtgtgtgtgtgtgtgtgtgtgtattcagagctcagatatctgtgactgttttttctcttttccatacttttctttggggcagctgttatctctgtggccttgagcttgatccataattcattcattcactcattcactcatttgtttagtagatgttttcttgagacttattattactcagaatagtgttgggcattaaggcaaagaaaatgaaaaggagacctaatgcctgttcttgagcagctctctgtcttgatcttgttgtttagcctgtttccattggccctatttttctttctttttttttttttttgagacagagtctcactctgtcacccaggctggagtgcagtagcacagtcttggctcactgcaacctccacttcctgggttcaagcaattctcatgcctcagcctcccaagtagctgggattacaggcatgccccaccacgcctggctaatttttgtattttttagtagagacggagtttcaccatgttggacaggctggtctcaaactctggacctcaggtgatccacccacttcagtctcccaaagtggtgggattacaggcgtgagccactatacccggccagccctatttttcatggaaaggaaaaaacaactattaacactcttcacaggttattgttgtattttgaaaagagttatgaaatcccttgctaactttctcttctctggggaaaagagtctgagttccctcagcctttcttcctaagacctgtggttggctataaattgcattggttgctcttctctaatgacctctggagattggcaacaccaaacaaagacatgagttagatatggactcttcttcagacactttgtttaaattttaaatttttttctgattgcaaattagtatttaatgtagaaaatttggagaattcaggaaaaccacaaagaagaaaatttactgttaactttgtgctcgtagccttctagcactttatgtataagtgtgttttttatgtgggtgtaagaaagttacatttccttttacctacctatattactaaaaatgtgttatgaatattttccatatcattaaacattcttctcaagcataactttaaataactgcataggaaactgttatagggaaagtccacaatgtgtttaatcaatttatactatagaacatttaagctacttttgattttggttttttttttttttttttactattattaataacacggtggtaagctttatagtacagaacatttaatgcacattttctgttatttccttggataaatttctaaaaatggaattgctagatcaaagggtatgcataagtttacagtctttgtgatgtattgtaaacttttcttctaggaacttctattaatttatggttctcactaacagtttctggtagtttccatttcctcacaccctcaactgtttttcagtctttgtcaattatcaaatcattaaatggcatctcgtttttattttaacttgtatcccttgggttgctagtgcgattgaacattttttatatgtttattggccttttgtacatattctggaaatgttcatctcttttcttattgatttctaagaactcttataatacaataaggatattaatcctcctgcacttggccagcatttagtaaatagaggaaattctatttctgagtggaggaggactcctgtggaataaggccccaagtctcatcctatttctgtgtaaagttcttcagagtgaaagctggattgttgccctaggaaaactaaaggcagatctgtaagtgataccagtattgatcttaaaataaataaattaattaaccctacaatctgaactagcttgacattttctatttttctgatctatgaaaaatctcaggttgtaaaatagtgcccaagaattttctaaaagaacctagagatatgttagtggaaagtttagggggagatctgccctaggcctagtatgaccctaagccaaataaataaatccttggcttgtttatatagccaggttgaagagataatagttacatctattaaaaaagctttcttatgacctttgctacacttaggtcaagaaaatggtattttgagtgactagatgttttattttggatgctcgatcagtctccttgtttcttttactatctgtaagataacacattcttctcagttgttgaactttgacatctcaccatcatatgctctgcccatcttattccgtagcagcacacataaagaaaggccaaagcagactcctgaacccacagtacagctggaaggtttctactgcagagattctgggactctttaaaaagaaaaaaattaaaatttcaaaaaatcaaacccccttacacttggatgagaattccagaataaaagagggtgtcccccagcatcccctgaatatttctagggtggtgtcaagtgaattcaaaattcttgagcacatagattgttttcaagctcttgttttcatttcatcagtaaatagaattttaaaaacaacaatatcctcccatcagtaaatttggcacaatggatactagcactccgttctcgtacattcttgtcaacattttctttctgcatcccccacccccaagcctgggcctgcttcccactatatctcccacaacccttctgttagctgtaatgaccctgcaaacactaaatggcatttgagtgcattaagcagcaaactctctggtgacatagcaattatggctctgaaatagatttggtgcgtcacggaagataagggttttgaaagtttctattgtgattatagcctgtaactcccacaaataataggcttcaaaataagaggctgccaacggagcctttgtggctttgtctcagtgatggcacgtaaattgctattaatgtcctaagtgtacttgaatatgccagtctttgggatgtggagttggctcagtgtctctctttacacggcatgtcattgttggtctgataatctggggtaattgctgtctcttggatggtcagaaaagtgtaaggggtttagcttcctgtgtgatggtaaatagcctcaaaatttaccccacgagggcaggttcacacatactggctgtgtgtgtatttcatgtgtagccaccgttcaccgttaagatgtgtatacaatctctgtgtgtacccttagtaaataatagccttgtcaacaaagccaaagcaaaatcaaaggttataaaaatgaaatgacgaattcagggctgtataggttcagccaatcagataatttatattgagagtttaaaaaagaaaaagaatacccttacttgaattatctaggtttagctttatgaggaagctttatgcttcctcttttctagtgtagctactcttttctagtgtaagtagcatctgtgtgtctgtctatattctttaggtagtatgagtacattcgaaatgtatatcagctctacgtgaatataataaatgtggaaattatgcatgttgtcgaatgctgtttgttgatgtttagaagtgtgtttttattttggtttgtgcagctgtgcaggcagaggttatttattcagatataagtagaattctctgcactaaggcacctttgtttagctaaaatcaagctgagcttatttttctttgccaggagatcaggatagcctttggaaaaagtaagaaaatcaaacttgaagctttagcctcttgtatgtccatttagcctaaggaccttaagtctgtaagacatgaacacgttatgtgtaactgtcctatttgtacttttaacagaaatggaaaagcaactcaacccaaaacctggaaatgcacaccatctcctatactatgtgagttatggagaggctcagctaaaaccaccccgtgtctcagatcccttatatggcattattaatcctggatcttcgcaacagattcattagaaaagaataaagctaagaaggagccagagtagatcttgatctcagagttgatgtattatacaagcgcactttaataatgtggcattaggatgttggcaggagggcacactatgatggtgctacagttgatggaatcttccagttggtgactgagcaccccttagcagttagggtgcatgcaagataaaattcaaggtagtaacttctaacaagagagtttgttttcataccgtgtgaacatggatcagatataccatcttactcttaggtcttagaccagaactctgccttgccagtgtaagttaagccatattcactggcaaggtggtgccgcccatggtcaagcctcagaagcatagccctgcaggagcagagcttgtcttgttcaaaaccaagtttgatgaggtggattgttgcttagtagcaggagatattagaatcctcggacttttctgaggccagtcttgtgattcatatgttctagcatcttaataaacaacatagggattcccaaaggtgaactgaagagcacaagtcacctgcctttagctgtgagcatccaaagtagctgtgctctgcatgtggagcgcacacattgtcccacagccccgtcttttgaaaattgaaatgtccaaaaagcagtagcaggcagtgggtactaagtctggcaaatcctgggttctgagatctagttttctctcctgagaagtaggagtaagagttcacactagatttgtgtaccactgtgtatttgtgatccagagcaagagatggacctataactgtgcagttatgctgggcacctgcagccaagccatccagtattcacaggaacgagacaccaagggaaggcttcaaagccatcatttctccttccattcaatcaagtgcttaattgagcagctgctgtgtcaaacatgagcctagtcctgtaatggcttgttgttgaatgatttaccatctcattgaggataaatatcaaagtgcttcatgtagcctgcaagtctgggcatggctaagtcctctcctctccggtcctgtcttgcttcacttaccactgttctcccctgttccattctttctggccttctttgagtcccttggagactctggaaaggcttccctttgccccactcttggcttgtctgttttctgttcaccttcaggctgattttccgtaagcccaagtgaggtccctcttttgtactgtctcctagcacttattgccatctagaatctgtatacattattttgataatatagcaaatgtcaatttcctgcaaaacagtaaactccttgagagcagaaacaagatttttttaacttattttatcaaccactgtatgcccagtatgtagcacaagtgggcactgaatacgtatttacgtaattaaaaactaagtgattacagccaaaaacatatggtgctcacttggagattttaaatgataaataaaagttgcacgtagttttaaatgtcaaaatgaaggatcagtaagtcagtggtattagaggctagagacatgggtgatgtgtgccttgaagaaacctacaataagaaagtgactctcaagctgggccttgaaagatgacacggatttgtagagaccagaggagatagacaggcaaaggcaaaaaaatcctctcacttgacttctcagtacagtaaaggaaggattctcactttgacaatgaaaaattattatttctttgcagcagcgtaaactacaaaagtctttgcagcaaggatttctattctccaccaggaatggctgactgcattgcactgctaatctttctgaacatagagacctataaacaagatctcaggattcaagaggcttgatgggagccagactagagaggagtgtggtggtgtggcattgatatgaagccaccaggggctgacctagtggtaggtggcaattagagaggataccctggcagtcaaaggactatggaaacaggaatcctagagccagcagcatgagttaatccaagcagaggattggcttctgggaagtacgatggcaggtagtagttggtgagctgaggttccagagcagtattccaataacaagagcaagtcactttctcggtctttaaggaactgtaataaatagcagaaaattaagcaaagctaggcataagcttggtagagatggtctcaaccacaagaaagaagttcctatatgaagacactgatgcaaaatgtccaagtaagacaagtggcaaaattgattctgagttacctatggtaccaaactaggccagaagaaaatttcttctgtctgagagcacatgttattcccatatagggttgccagatttagcaaatggaaatactacatgggatatacttataaaattacagtgtaacagggcatcccatattttatctggcaatgtcattcctagatcctaagagggaagctgaatctgtatatgggtctcacaccagagagagaaaagataggggctcaaggacacaacaggccattaggagactatgtctgttttgcatttttgcaattcccactgtgctcagggtggtaactgggatacagatgcaggatgggttgtcttctccttgtgcctttctggagaacactccttgttaagatggtgtgctaagctgtggcactgcaactgtcaggttccagtgtccttctcaattgctttccctaaacgcaaaacaaaacagtataaatattaattatcattgcttgtttgggataagctatgaagcaccaaatctccctgatgccagtttagtaagagaaacgttcactgcctgaagattaaagttacccagaaacttggcagtgcttctgctctgtcttttgagtattttctaggtgtacacagctatttacatatagttggaatgaattatggaggtcagggatctcatgccatatgtctctccatgcccatgttgggggatggatgtcacagtgccaccaagtgtttctttacttcatcctatgcctctccaagaaacatttatcaaaatcggcgatgtgtcgggcactgtggtgggcactttggaataaaagataaattccacacccttgcttttatggtcgggtaggtgaaaccgacgtgtgaaggaacacacgcaatacagcagcacatgtgctgtgacagaggcacatacatagaactgggggcctgcaggaggaagaaacaaaaagcatggccaggggacagatggatgtgcaaagatattcaaattcagtcttacaaagcagccaaggtgtgagtgagatgtaattggaggagtgagggcacggcattcaaggggaaagaagcaggcatgagacggctgctctgtcctgggaaattcatgggaatgtaaataattgtgttgataggggaagtaagcaagatcaaggctgcggcagagctgctgaggacattgaacctcatcttgaggccaatgggtagccattgaagatttcaacagggagatgacatgcacagaatgacacttttgaaagatagctctggtggcagctagagataggactggaggaatacccagaccgggcctggatctcttttccactgtaaaattccccaggaaattttgaatcttttgacgtccctaagggggctttccaatagcatcttttcaaagtgctgtctgtgtaatcttgggaaagtgttaagcatatcaggaagacatatttcttctagcttgatagaagagtgatgaatctaggatgtgacctctgctgtgtgagctgatgtctccctgatatatagtggctctgtgtgtgtttgcatagagagggaaagaggatgcatccgtgtctctgtttttcttcccggccgttcccaacagtgactgggtgattgaggggctggagcacgtgcagctcctcacccacgctgaaggcatctctagtaatggcatctggcccatatgcagatctagctccactctgtgctgacatcagccggtttgtggcacctcagcgtatttctgggttgcaaatgagagtttcttagtgccaggcttgcttgggctgtcacatcaggtgatgaattctctgcatcaaccgtgtgctgctaaggtaatcgcagaggaagagtgggaaaaagaggagatggggcaggtgcttctcagccctgcagccgctgctcagggctaaaagcagcactggatccacaacagggagggagaagcaactatctgtggtccccgttctggttcaaggagggtggtagagaaaaggcagggttttggttgcaattctgtgtcacgtgtcctgtcaggagaaaccacgtgggttttcccatctgccattgccccatccttggctcaagagctagctccctctacctcctcagacaggcatgttttgcattaccttttaggtgaagttctagcaaaatttggtgtatatcaaattatatgccaaattctttaggatagaccatagagtaaatagtcatttttattcccgaaacactttgtttccaaatatctttgtgttttggaaatccagattttcttatcttgggaacctgctgtattttatcttagttttatattctatgagcttctctcttggtgagctccaggttgagctgctctgctggcttaggcttcatctggtagaattaaaagttacattgggtcacacgtcccaggtgttgcatcacaggccacagaattacctatataaaactgagtgcaaatgtagacactcttccactaaattgtttttagcaattaaaagtgtacctttggttttgcagattttacctcccaccctgtgacccctcagtgtggtttatgacattagcatttccaagagtgtgttcattataaagaattgtttgcatcagaaagtagagagggaagctgaggtgcagaaaaaaaataaaaataaaagtcttattttccaccccgcccccacccaccgcacagttgttaatgaaagcatcctctcctctcactctgcccagagataaataaacacacaaaggcggagtttcctacttaatattcacccacagtcgaggtagagggaaggaattgctccccagggttaacgtggcagtaagcgaggtcagctgtttcccaagacggtgcagcctctgaacgtcttccatcacagctagaatgatacagctgaagcagccgaagtgatttacaggaaacccagttaacttgagtttgcttgcagtttctatcttatgatggttttagcagtaacagcagcaaataatataccgtcctataaagcacctctagagaaaagaattcttccacattccccagcatgacatgcttcttctaaaaagtatttgtgtttctctaacttaaaccctataggctacaatgtcctaaatttggtgagaagtgggaggtcatagctggcatatcctggaatagggtggccaaaagtctcattttgctcaggctgttggggtctactcggatctgagactttaggtactaacatgggaaagtcctgggcaaactgggatggatggtcaccaaatctgagggggtgtgtgtgtgtgtatctgtgtgcatatttatggttggagggggagtggaaaaaaggggagtgaaagaggttttgtttaatgtatttcttttagctagaaggttttatatattcttcactaggccaactagaataatataatgctggttttgagattagcttgaaataattcctatttctcccatctgtgggttctctataccccctaacatcttacacactggtctgagaaaacagaactttttaaagaaaagagatcaaatttttactatttgagttatttcaggtctgggatgactcaagaagaagtctcccagaaccttctgggcaatatagaatgccttgtcaattccttcttaatgaaacaccacagaactaattttctttactaatggcttcattttttgcaccacttattgttatcttaatggaattatggcatggctaaaatgatagagtggtgatttgtgagcaatgtaatagaactccattgttccatgacctatgacatgtacgctcactgctttcatagagcttccttatctgcttattttataccagggtgattctaagatacatgccttttttctttctttctttctttctttttttttttttttttaccagaattttactctacttcatgacattgtacttaaaaacttaaaaaaaaagttttcttaaatttctgtactgctgagtcatttttattcctgaaacactttgtttccaaatatctttgtgctttggaaatccagattttcttatctcgggaacctgctgcattccccagtgtgacgtgcttcctctaaaaagtaggacccctacctcctgcccctacagatacactcctgcctgcctgcctgtctgtctacctacctatctatctacctgcctatctacctgtctgtctacttatctatctatctaaatatctatctggtaaacattcacatataaaaatgagtaggagaaacagataccaaagcaattatatgtgtcatcaaagctgaataattttccccaagtagtaggattatgggtgcatgctgtatgttttgttttttatgctttctaatttcccaaatattagcgataagtatatcttatttttattttaaaaaatgacattaaaggatcttctttgggaaaaataaacgtggccgccattcttagtcagcctaaaatggcaccagaatctatattcctggttgggatgggaggctacaatattatcacccctatggcagactttcattaggaatttgaatgaattctgttcttgattctggttatactacagagtctttgcccccaaaagttggaaaagctttctgttatgaaagaaagaattattttcctccttattgttctccgtctaatctgtttatcacaaacagcagggggaaatgtcctccaacagagaaaaggagtgagaggagtgacttgactgggttaggagatgggagattggaacttgagagcagttatttgctgacccaagattggggagcggtgttcttggcattgctcaggatgccctcttggtatccagatctgcttttcagtgaggtgtgaacaaaacctaccctgttgctgaagtaactggtaggagctgctttgaattaaaagcctggctttcctgggaaaattggagcatcatttgggtgagccaatgataaagaaagccaagtggttgaaaagcgcagagaaaatggagcccgaattcaaagatctcaaggcctgtgttctcagtcgtgaaccgggacacctgcttttctcttgcacctctgctctctgatgaataaaatgggaacggcatactccaggtgccatggagtatgcaagagttgaagtggtgctccctcccaagcagcaacaataatacctgccccatctcccccaaatttttcagagaatgagaggatagtacaatagaaaacattttaccagggatgtctcagacctgatctgttcaacgtgaactacaaaggaacacagtaatcgaaggggggaaaggcattttagcacacttatatttcaatgctttaaaacatataagcaatcatgaattatgcatcatgaattaaccactatagcaaagcattcttcaactattttagtgctgggatttttttgaaaggggtggttactaaacagatttttttagaacagttttaacagttttattgttgggatgctcctggatctagagtcttgtaaaatgatctccaaatattgatcaagcctataccttcccgtctcaccacctctctggatatattcacacagactagtccttatggccttggcaccattgttgtatctgttatagtcacctgaattagcctctgtacttttcaaaactcacctcaaagagtgctccctctatgaagtatttcctgatgttgcaacaaaatgtgatattgttttcatttgaaacttcatagcaatgggactctaccatttattaggttctgccttgatttataagttcattcgtgggcttatctccctccttgaacacatgaactacatctcactcatcattatatacccatgagcatctagtatagaaccttgtgcagaacaaatacctggaatcccataaatacatgggacatccagagtcagaaagaaccctagaaagcatttgagccaaccttcttatttttcaaaaaagaagactaaggtcaaataggtgaaggtgctttaccatcgacattagctagttgttgccagagccagaaccaaaacttgagtcccttgacctgcaggacagctgtcatttcactgctggctgggacttaattacagagtctttgggaagtataaacacatcatactagtgggaggtattaacatcatatccagaggctcactgggaggacccaaacttatttgagggtgggggcaatattatcacccacagtaatagttgcccatttgatgagtgtctccatgtgccaggcactatgctaggtcctttacacaagatgcctcattgtcattgtctgctgaaaacagccacccaatctcagaggactgacttctctccctttttcccttctaggctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaact

SEQ ID NO: 37635 - DNA, 109402 bp, Homo sapiens
gctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgtgagtggccggccgagggccgggggcgttgggaggcgactgcctgcgcgacgcgcttgggccgggtactcctcccgggcggctggggaggctgggccgcgctgagcagagccaggaagtgtctgcgagcggcggagttagtttcgtttcggcttagccttccggagatggcgtgagcccgttgcacggatcgggaaactgaggcccgaacgttaagggaactgcggggacgcgctgttaggaggcggcagagctggtggtaacctgacccgtgggatttcaaagttaaagcccttttcccacggccacacggcttcgtgggactttatggaaatattgaaaataactgcggtaccattgtcagtcccttctcacctcgggccggacgtcgctagtggacgcgccggccccgagtcccttcccgcggccgccagacagacccccgacagcctaactcggcgtccgtatcgccgtcggggcggctgaagtcggagctttctgtggagcttgttaggcagaggcacctcgactgtggcttttggaccacacttcggattcacccgggcagatgattaaaaatgccggtttcgggacccgccctattcccatggaattagtctggagcttgggccccggagtctgcatgtctaataagcgtccctggggttaccaaggcaccccaaagtttaaaagtcactcggtgttggaggatttttagacagacgcgatactacaagtactgctaatgacctattttaaaatgacccagataatcgcagtgtgactttatagccactggtcaatgtggatatgtgcaaactagggaagctcctgatcttgggtagagaggaagcaactttgtcattgatttgagaattcaagtaggactcctttgactaagtgttcaatactatagaatctttacacacttgtgaatatatttcctagaattcataactacttctagttgtccttgttttgtagccatctgggacgctgaatttccaggtcagtctccaatgcacgtttcgtctagtggtgggaaaagatgagttatttcttgatattataaagattgatattttcctgatatttaaggatattaaatttaaattgatattaaagatatttaaatatctttttgagatttaaagattttcctgtggcaaatctttacatagtcctgatgtagagattacttttaactcctcatacatgtgtgggtactgtggattttgttttcttcacacactactgtgtgtccttaactcacgttcttggacttcgcatccagtaaatatgtccagtttaaatttctgttttattccttttggctggaggaatatcatttacaatcatcttcattgttattgccagtttagtacttctaaattcatgttcacgttattcagtgaatatctgagactagcactatgctaatcttttattttctgagaaaccaaaggggaggaggtaagcacctattgaaagttgaggcttcaagtagaatttattggtaacatgccagaattatcctgtgaaataaaatttttagttatgttctagggttatctagcttcacagagtggatatagtaaactcgtttcttttcaaatgttgagttcattctgcaaaatgattttaggatgggccatggtggagtttacatagttaagaatgcagatttcacaccctgactggaagacaagtgaaatgtttgttttatctgtcattgttaatatttgtcatggtacattttttatgactgaataaaaatgtgctgtggattgattgggggtaccagtgtgaggtgaatagtgttcatatttgccttttctctcctttggcagtcacagctgccgaaattgctgggatagtgcagtggacaacaatatttctttgaaattctgtttgtagaatatatatccaacacagagatggcaaaattgttattctctgtaggaatttaggaggaagttcacagctcttaggaggaaaactgtgctcagataagctaagtgtttttgtttgattggttgttttaatgttaaatggttgagaggcttagtgataagcccaagccagttaatccgtacgagttttaattaaaatcaaagggttggaggtgatcactgtggtctctcagactctacaattccgagagcaacccttgctgtaagtcatagaattattctactcttgctattttgttgcttatttggaatattggtactcattgaaactgttgttaataactagaatccagtgaagcatgcagtaaccccactggttaagcaatgatatatctcatgaatattaacagccacttcactagaattattttggagatccgtagactctttgagaaagcaaccacctggaaggatgcctgacaggaaactgccaggacacagaaacaattttgtggtcgtgttacaagcctgtagtctgaaacaatccttaggcacagatttcaagactatgctgctgaatgctgttgcaaacctgtaaacctataatttgacacatcatttttctagaggcctttatttcattctccattcaaaggaccattaagaagcgttttatttgaaagattttcaaactctgaatcggagtttgagttggaacgactgttaaagcttcttcatcattttatgttgtgtatcgggaagctgagccttctgagagtttccatggagtaaaaccatgacttgaacacagaactggcccctataatcagtaaccacagtgagcatagtaacattaatttttctctagcactaaattgataatagtttagcctttttttccccttgagttacattaagacaaatgtaagcttggtcaaaaatttaaatcgttctgtgaacttacaagaatgcatttgcttccatcctgtcacagaaatctttggaaaagctgtggatatcactggtgtgctaagtagattcttgtttatatagacacaaacttaaacttttagtaaactccttatgtgaaaatggctcctgagttcacagataacttgcctcaaaacaggtccggtaaaatgtgctcttttattttatatgaaaagttattctatattttctagggaaaaccaaaactctcaaatattgtttgctgttaaactatactttgagtaattatgtgtgttgaatgctttcttttctcatttaggtactgacgttgaggtctaggcaaatttcttaggctgtaataataatatggttactccatgtttgtttttcttttgatgaggctaattacatttaacttattttttaatttatttttatgaaagaaatgcagaatgaattataaaagagggttgctgattgaagtgttttccttttagagacacattacatgcaaacttgacctacactttcatattactggattattagccttttgtgttcattcatattctcattctttctctccccttttcccctcttcccccctttcctcattgtccctttgcttccttctcccctcccctcccatctccctccttcctcccttcttctacccaccacctatgtgtcctgccagagttgtagctgatgaattttcttttttgcagtgacctttggcttgacactgccctgtttgctgcccagatctcatctttcagtctgtccccacttgtggggacatggggctacattaatgattatgtaggtggtaggagataatgctggagaaagagaaagccagaatttgaggtttttttttttttctttttttgagagggagtctcgctctgtcgcccaggctggagtgcagtggtgagatctctgttcactgcaacctccaaatcccgggttcaagcagttctcctgtctcagcctccctagtagctgggactacaggcatgtgccaccacgcccggctaattttttgtatttttagtagagatgggatttcaccgtgttagccaggatggtctcaatctcctgacctcgtgatccacccgtctcggcctcccaaagtgctgggattacaggtgtgagccaccgctcccggccatttgaggggttttatatgctctcgcaatcaacagttacggtggcttttttataggcttagtagcagtttccaacttactgattactttatgaagacttacagtttgctattagtaataggaagtaattattgaatactgattgtgtggtaggcagtatactttgtgctttacctgaattatcttctttaactcttccactttgagggaggccctatttgacctgttttagaagatagagagattgaagttcagaaaagttaagtaacattcctaatgacagtaagtaatagagctgttattgcaactagatgggtctgacctcttaagtcccagctcttttttcatactatagtgctctgagccaggcaggagttgaacaggatcccatcagttttacactgtcacttttgcttagcactgtgcctggttatataataggtgcttggtaaatgccaaataaattaaaaattgaatctttacaaaatttttaaattgatacataatattttcacatttatggagtagggtacatgtgatattttgttagattcatacagtgtgtaacaatcaggtcagggtatttagagtatccatcactttgagtgtttatcatttccatgtgttgggaacatttcaaatcctctcttctagctactttgaaatatacagtacattgttattaactatagtcatcctactctgttatcagacattagaacttactccgtctaactgtatgatttacctattaaccaacctctcttcatccgccttgctcccccacatgcttctggcctatatgcagaatagattgaattgtaactggagtcagataagttattctttggataccataaccggaacttttttttcccataaagatagtgttataaaagttttataatttggccaggtgcagtggctcacatctgtaaccccagcactttgggaggccaagaagagaggatcgcttttggctgagagttctagaccagcctgggcaacatagaccccgcctctacagaaaaattaaaaattagccaggtgtgttggtacatgcctatagtcctagctacttggaggctgaggcaggaggattgtttgagcccaggaggctgaggctgcagtgagctatggtctcactactatactccagcctgggcaacagagtaagacctatctctaaaaaggaaaatatatatatatttagtttatgattgtgttctttgcaggcctgtctgtaccacatttgaggtctgagacaagaatacaaatggaggtctgcaaatcatagtttaaatcagggattttcagtctttacactattgatgtctgggacaggtttaggggtaacaggggctgtcctatgcactataggacattaaacatcatccttggcctctacgaactggaagccaggagtaaccctcctgccccaagcttctgtcaaccaaaagtgtctctagatattgccaaatgttctctgggggacaaaattgtccctggttgagaaccactggcctaaatatttaaatgttatagaccatactatgcccgcagcctggcctgctttcccatgcagggtccccagcctgctccctaggcattgccgtctcagtgcagaggtccaagtagcttgcaggcttgatccagtcagtaggaccctggcctgggattgactgtcagtttccttcagggagccagggtgggcaggttcccctcctttgatactgtacttttccatctcaggatttctagatagatagttccaagcatctcccagaactatactagccgagtagctggacagatagaaggtggaagcctagctttttggggaactcattctgcttagactctgactctaggtgacatggaatggggaacttgaagcaaaaacagctgcagccatctttctctggtaatttgagatggagtctcactctgtagcccaagctggagtgcagtggtgtgatctcggctcactgcaacctccacctcctggactcaagctattctcctgcctcggcctcccgagtagctgggactacaggtgtgcgccaccacgcctggctaattgttttgtatttgagtagagatggggtttcaccatgttgcccagcatggtcttgaactcccaagctcaggcaatctgcctgcctcggcctcgcaaagggctggaattacaggcgtgagccactgtgcccagtctttctctggttttctagggcagtgattttcagttatcactactccatgcactttcccacccacacacacctctgtaaaaggagagacagtcctctgtgtttcgcagggcagaggccctttttttcatgggtcaaataagatactgatttttaggatgaaaccacattttactcattacatggctcaactctggtgtggaatgatccagttatcatatgcagtgtttctgttgtggtgggatggattgcagtgaatgaatcttcatcctatagtgggagtagagaggtttttattggtaccatttaaggaaaggggtcccagacagtctcagaaataaagagaagggcacagaaaatcccaatatggcccgcaactgcttcagagaagaaagagtggaccggaagataggacatgagtcgtttgtctaggttaaggagccttcagtctttttgctaaattaacccttttgagaatctgatgaaagccatgattattcttccccagaaatgcagattctcacccaaagttttgcatgtaatttgaagcaattcaaaggcatactaagatggaaaaatgaagtaaatcaccacagtggcagttctctgagaaaagcaccctaactgaggttgtggaagaatatcatttgccaaatatatgatgccaatataagtatgtctttcttctgcttttttgtctgttttccccctaaccttttaacattatcttattttttcttaccttctctgttagcctactgaaatctttaaggtatcatataatatatagatggatattcagtaaggcttttctaaaattggtatctatgaagagagttagtttaagaattgcaggatcaccagagaaggaactttaagagagggaaaaatgaaattgaatagaatttgaacttaaaaggccgttttatccaatcattaaggggaaagtgaaaccaaagtagttttggggccaagggtaaagttcccctttgccctctgaaggttcactgaaaaatcaactgacaaaaggcagattaattggagaaaaggcatacaaatttatgtaacgtatatatgcacaagagccttcagaatgaagacccaaagatacgggggaaaatgcccatttttatgcttaggttcaacaaagtatggacattatatagaaatattggccaaaatacgaatgatctaatgttaatagactgagtggggaaactcagcaaggcccatctagatttttcttggattatctgagcatgcattcttttcttctgggtatggggcaggaccctgtctggcttggggtcttgtgacccacagtcaaacaaggtaggtcaggtaatttctttatgatcagtttttacgcagaaaggccgagggaaagttagagtaatatttttcagttttatgactgggtttggggaaaaagggttctggtttttgtaacccaccttggggaagagcgattctggtttctatagctagccttaggggaaaatgggactgagagacaggaaggcaggagaaggtcagagaaaaacttttgtttttgaggccttcattttggagtatgttttctgaggcccaacaataggttaactgtgccattcagctagataatggtgtggtactagaacccagctcatctgaatcctgggtgggtgtgctcacagctacatacttcctacgacctgcatggcacatggaaggggtgggagataagcaggatagaaaccatggctaacagtatgaagaaagattcaaaattaatatcaaataggaaaaaagatattatttacagcatttgtacaaatctgaaagcaaaatactatgaatcctatgtggttagagtacatttttggtctcttagattaccaaaagacttaacactaacatgcagaggcagtgaagtacagtagaaaagacagaagtttagattggtacagcatttttagaaagcaatatagcaatatgttatcaaatacgcaaatcttaaaccactgacacagtaatttcacttttggggatctatcctttttcttctctataattggtgttttccttctacagttagcattctacaatcagagaagaagattcttaagatgtttttacagctcaacataattttttcaacatttttataattcaacattttataaaaatttttataatttttttcaaaaccttgaaatgacatgttaaaatgctgctttgaactggtttttctttagcctgtagaaaagaactttgagttactggtcaagtagttttgaccatactggcttaggaaaacagcgcatcagctgtctgattgctatcatgtaaaaatctgtgaacgactttgagaagtcattggtggattatgttgttcaggaataggaatggagctttcttcctatcacttgtatttttttttttttttttttgaaaggaggaggaggaggaaataatttctgccttattaagtggtggtttaaatcatgaaaacctgaaaggttgagatgagtcatgatgtgggggttcagtttattgggaactgacaggtttttatttttctgttttttttttttttttgaatgatcttgtgttgtagagttgaatacagttctagggaagtatgatcacaaaatgaatgttggcagttcctcctatgattaatatgtcagacatgtcaaaattctctcatcatgtgtatttgccgggtttattcagttcttgaaatgaggcagctctcaagtatattctaaagcaaacaggaactactatttttcttctttccatgtatggtatcatattatcccttttgcatatgtatttcttgctctctgactttaggtgttattagatagtgtgattctaatttttatggaggaaggaaacactagtcaggtttttttttttaattttacttctgaatcaagagttttctgtattcttaaattaggcattaagccatttgctttacagtctttaagaggaattctgtccttctaaatgctatttttgtttttattcttagttggtgagttattcagctgtacctttttattgttattacctgaactccagggtatttctgctgcagtagttttctggataatgctaagtgttcttcacatccctgttgtttaattggtgtttttgaacagctgtcttggcaattagctaccaagttcccttgatgtggttacagttaactgtaaacgaatttcactcctgatgagccgagtgaagtgtaaggtgtccaaggttggcgttgtcatttcctggaatctcataaactttgcagaaggtactgtgccaggctaaaggaatggcccatttatgacatctgacttggattgttttattttattaacttagttaaaaataatttactaactttttaacccactaactggagaagattttatctcctacgcatatttagatgtaatagaatttacgtaactgtgctttagaggtggaaatgctttatgaacatgttgttagaatcagcaggttatcagttcttgcattatcatcccaccatctgctgcagctggctctagaagggcatctacagtgggggggacactccaggcaaatgtataacacctaagattctggctctaagtccctatggcttctcctgttttcttagctgggctggagtatgtgaatttcagaggtccaattacttttcatttcacaactcaaattggaagcagacttaagtgacttgtcatgaccccttttcccttggttccatcttgcttctttgtttggtcttccagtgatgggggtatctgccccaggacagttctatttctaatacctatacagaagctccttcccctggcacagcatcctcattgttgattcctgaggatttcatattgctcttgacccacattgatgaatacaatcagtgagggtggcccaagggaagcttgagcttttagagccgagttttcaaaatttcttccacagagtataataaggactgttgtatgggaaggattccgacaagactgtgcaggtggccctctctatctgaccagcttcagctggagcagctctgttttttttttaacttttattttaggttcatgggtacatttacaggttagttaataggtaaactcgtgtcacaggggattgttgtagtactattgtattgttgtaatattattgcacccaggtactaagcctagcacccagtagttattttttctgctcctctctcttttcccaccctccaccctcaagtgggccccagtgtccattgttcctttcttggcgtccatgagttctcatcatttggctcccacttataaataagaacgtggtgtttggttttctgttcctgtgtcagtttgctaaggatgatagcctccagctccatctgttcccacaaaagacatgatctccttctttattatggctgcatagtattccatggtatatatacaccacattttcttcatccagtctgtcattgataggtatttaggttgattccatgtctttgctattgtgaatagtggagcagctctatttttatctcttttatttgtgacattctgcatttggtttcagtagtgttggctacttgtaaaaagtttgaggtttatagtattagacattagaatatgccctctgacaagaatttaagctgttttataatcaatagctcgggaacctagaggcaaaaataaaaactgtttagttgatagtgcctcacctgttttgctctcatgatctccaagatgggagattttataatctcttcttgtagtcatttcagtcataggtactgtcagtatgttcctagaatcacaagtgttctttcaatttttcttgttttcctgttggatttctcttagcaaatatttttgggcctacatttgtaaagcactgctggctggagaatacagaggtgaataaagcagtccctagcttcaaaaagtttaccttatttatagaagggtataaattgctataacacagagaatggcaagcacgattagaatggtgctattgggggcccaggggagagactgcacctctgattgggagaagagagcaaggggaagatgagtggaggacagctttctaaatccaagtgccttaaagtatactacagatacagtggtcaaaggagaaatgctggattggggaaactgtttgagatgagttatgcaggtggaaataaccattaagcagtttaagtgagacagtagtgctagggaaggtgaagaatctaaggctgtgtatgtgtgcacacctgcgcatggtaattttgtcttttattcacatatttattgaatgctatgtgtcatttattatgctagacactgaggatacggtgctatcctcatacaggacatatggacaccaacaggggtgtcgtccctgccctcatggatcttggtctgatggggaagaaaggtgctcagcacgtagttaaactgatgagacagggagctttagagggcctatggtttctttcctttactgctgtgtttatagttttggtatagtgtctgggccatggcacacattcaatgtatgtttatagagtgaatcaaagaaatgtaatagatgttaataataaaagaaacacaagttgctatgtaaacatgtaagtgagcctggaggaaaagcagttagaggttattaaaatacagtagtctaattggtgggctttggacttggatggtggttgtaggaaggactgcagtgaacaaatgtgaacacttttgaggaaatacaattgataggattaattggatcaaaggattgagggagaaaggggagtaaggatttactcaggtttctggctttatcatatgggtgaatggttctggtttgctatagggactttttggaggaggaggaatttggggaaattgagatggaagatgagtccattttaggatatgatgagtatagtgccttaaagacattcatgttatgtttgtaggagtaatagtgcataaaattactgaaggataggttgtatagaggctaaagaagctgagggcaaactcttgaggaacatgtttatttaaagatggagtgaggcacaggaaccgaagagggagcaggtgggtcattttttaaacaaataccattgcaacaaatgtttgcaggatgagagttatgcaagactcaaatgactcacacttatttttagtagcatttgaatattccaatgtagcaagaagcagaaacactggacagtctcttacagtttgatctgatatgatgacaataaaggtaatttatgaaacaattttttttaagctttaggacttaagaacaattgttgtgtctcagccgtggcagttctgtcctatacgtctggcctaaactgtcttttcacagcttcctagctgggggaggtgattgtcaaattataattgggtgagaggatgtaaactgtaaattgtgcagtttgcaagtagaaattagggtggctccacatatataagctaaaataaataatatagaactaaactgttagtaatttatcaacccattgccatcttgagaatcataatgtgtatttgtgaaacaacagaatgatttgcaggcagcagatgtaatgcttatgcagagttgctgggaaactgctttattcacacaaggaactgagggacattagagacgagctgtcacctgagagtatcagtcagctcttggagttttcagtaagatttctttccccttatacagcgaatactgttctcctttcctccccgtcgattggtttctcggcatctacttggtatgacacagtaaacaggctctattctctgttttcagcaacatagaaatattgttcagcctgtcctgatggagtacagcaacctgctgattaagggattaacaattttaaaagtattttgtacagtggttcagggaagattagagagggttgagtataattgtggtttggatgctttgcttttgccaaaattggcagttgtttcaaccattcttaatattttcatctaaaattgcacagtaattaaaccctgctaaacacttttaagtatttgcatagaggtgagataatgttctattgattcttttaatttgtaagagtagattaagtttatctttatagttgcagtaataaaatgaattatacaaatatatacagaattccaggttctttgtgtataatgctacagaaaaactggttggtttgttttttttccatgcgtcagtagtagtaacccttatctttgaacttgaggtaattttgtcagttggtaatacattgaattcttagggtagcatcagattttggtttatgagccatttaagaatattgattagaaaagatttgattttcttcttagaggcatatgattaacataaaaataccttgttaatgttgtgaccacagtgtgtgtttgtgataaattaaaagaataggggcctggcacagtggctcactcctgtaatcctagcactttggaaggcagagacgggcagatcacgaggtcaagaggttgagacaagcctgaccaacatggtgaaaccccatctctactaaaaatgcaaaaattagctgggcgtggtggcgcatgcctgcaattccagctactcaggaggctgaagcaggagaatcgcatgaacccggaaggtggaggttgcagtgagttgagatcgcaccactgcactccagcctgggtgacagagcaagactctgtctcaacaacaacaacaacaacaaagaataggttaaaatttaaagaagtcttaggcttttgactttgtgttactataatttcatgtatagagtgaatataaaatgtttaaggtttcttggttttagttggaagattggagagaatatatcaggcattgaactttgaatgcttaaattagtagaataattttttaattgaacattttacttaactagtcctgctcagcaaatcctgtgttatatgttgctatcttcaaatgttggatagagaaattacttaaaatatatattttatttagatatgtaattagactgctacttgtcttttcagttactgtttaatcagaaaatgtaatcatctcaattcaaatgaaaatctctaacatatggcatagatgctgtgggtgttatggaatctataagaagaatcaatgctgttggtatattaaatgtatttcctctaaaaataattttggaagttacaaacactcctacagatttaacacttttgttgctctgtgactaatgaggaaataaaattttttaaaaaatttaagtagttagggttttaaagctgttttaaattttgcctgagataactcatatcctatttgtgaattacttagaggacttttaattaaagtaactcaaaccaacttggttagctaagaaagatcctagtcattgcctgtgatagattctttatgctcataatggtaacaaactaatattttttgatttaggggttttcctaaactatggtgccttactttgtttaagcagacactgtcctttgtcagtgatttttttttttttaaagcttagctaaaaatctgcagaaagccccaaacctatcttttttccccccatattcagcttttcattttggacaataggctagtagaattttaaactgtgaccttagtattactaatgcatattaaggtcacagtaagtataccgaaggaaatgattgatttttaaagcagctttattgagatataatttgcataccataaaatttacctgttttggccgggtgcagtggctcatgcctgtaatcccagcactttgggcggtcgaggcgggtggatcacaaggtcaggaaacagagaccatcctggctaacacagtgaaaccccgtctctactaaaaatacaaaaaattagccgggtatggtggcgggcgcccactactcagctactcaggaggctgaggcaggagaatggcgtgagctcaggaggcggagcttgcagtgagctgagattgcgccactgcactccagcctgggcgacagagcaagactccgtctcaaaaaaaaaaaaaaaaaaaaaaatttacctgttttaacggtatgaggaaacttgatttttacattaaacaaaatccctgggaaatcacctggacagatacttttaacaaatgtgaattttcagatgctccatcttttcttctccctagattttggttcattaggactcaaactttagtaagtattaggagacttgtgaaaacgaaagactctgaaatcccagttctttttaactttttaattgtaaggaagatacatttatttctggattttatatatatgtatatatatattatatttaagtttaaaaacctgaaagcttccagtatcagattactgtagtgacaagcattttaatatgtgcaggaaagagtaaaaagtaaagacttttctgcatgctgaagttacagtacagcagaggattctcaccttagttttacaaaataaaaaggggccttagcttcaaaactggattttgcttggggatggatttgctgctagaattttgtgaaagattatgtaaaaatatttccattattttccttgtcagttttgggacacttgtgccggagtgctttgttattgtaagctgaaacttcagtgcacagtgcactgtgggtggaaaagctttaagacattctagaccctaagcagcaatggccattttgctgtgagtttgtaaagtaaaaacgttctctcccccttttcctaagatgtgcatgtagcaaggatggcaaagtcctccctgtagctcttgcttgtggtcttggtatgcagggagtttaccaggaacttcttatgtagaccctctaacagcataaaaggcttcttttttctttctcacatgttcttgtattcttagggacattttttagctcagagtaacctatgataggaaaagaagataacttctagaagtggtaagttttgtaatatgacagattctcaagcaggatgtcgcttccccattctgtaccatctgacttaagttttgtacgtctggagagcagtggcagtaattgtataattttttggcagctgcacaatgttttgacgacgttgctttagtctccaaagtagacagttcagattttttttttttttcaaaaagaactttctcagaaaggcagtatagtgtatagtgttgagagtacaggcttagaggcccttaacgagatccatgctccatgcttctcgttgtatggtcttggggatattattgtctttctgattctctatttgtaaagtgtaaataacaatacctacctcatagggtcattctgaggattaaataagaccaaacctagaatttagtggacactcaaatatttggtaaatacattttgaaagaatcagactagtagatgagggatagataggagcagggaattcttggagtagattggatcttgttgccatttggttaagtcttctgattttccattgtatttgcacaatatccatgaagccagattttgtgcttttgaaaaacacttggattagaatttggtgtattagtttgctgagctgttgtaacaaagtgcaaccaactggatgatttctacaacagatatttattgtctcactattctggagggtagacctctgaaatcaaggtgttggcagggtgggttctttgtgagggctgtgaaggaaggatctgttccaggcatctccctggcttttatatagccatctatctggagttctgactgtatgtgtgtctgtctctaaatttttcctttttataagaatactagtcgtattggattaggacctaccccaatggccctatcctaacttgattactactgcaaagacccccctctctctagatatggtcactttctgaggcactggaaattatgactttaacatatgaattttgaagggacacaatttaatccataacagaggtatatcagacatgagaatgaaacagacttttacttacaacattttcatttttttaattgtgcgtatttattaaactttgatgtaaattaatggtataatctttttttcttttactgagcccagacattcatttacctaaacttaagtgaagtgtatgtggcacttgaaaaagattggtaaaattgaacaaaaattccttatttccttgtcttagttattttgtatgttactattgagatgagggaggaatgtttgagtttgagtgactgaaatatcaagggaggagttaaattctctggaggctgacctgaagtcattttggcatttaaactggtttcagaatggtacatatctactaaatatagaatttactggtgtacatgttgtacgaaatcttatgtgtattagttttctagggctaccgtaacaaggtagcacaaactgggtggcttaagacaacagaatatttttctctcacagttctggagtccagaaattcaaaaccaaggtttgggcaggatcatgcttctgaaggctctagggaagaatacttctttgcctcttttagcttctggtatttactgtagtccttggagttccttggcttgtggcaaaataattccaatctcttccgctgtcttcatgcagccttcttgtgtgtatccatatctttcttttttcttataaggataccagtcattgaatttagggcttaccctaatccagtatgacctcatcttgattatatctgcaaagaccccatttcgaaataaagtcacaatggcaggtataggttgaatattcctaacccgaaaatctaaaatgcccccaaatttgaaacttttgagctcctttttgagcactcaaaagaaatgctctttggagcaatttgaatgtcagatttttttattagggatactcaactagtatgtattctacaagtacccttaaattaaaaaaaaattaaaaatctgaaacacttctggtctcaagcatttttgataaggttaattcaacctttactggggttaggacttaaacatattgttttggggaacataattcaacccacaacacttgtccattgcttcttaaaatcacatttactgttaatttctctcttaaattctccagttattctgactagtaaatggacagccttgtttccacacattaatgtacttgagtgtgacagctgagaactctcccactttcctgcatgttaacctattgccttggttttccagctacataatcatgctttcactctttgtccttctgtttcagcagtttgttggaaattcttagattggttttggtttcttgttgtctttaccaactcagtgtcataagttgtatttaaaattgttgaactttctgttttataacttacagtagattttatctccaggaacttttttgtaattggaatgcatattgacttactactgaatgcttattactaataacactttctattgagacaacaatgttctccgcagaatgaatggtatgagcacatgcattggaatgaaaacatttgagacttgatttgaaagctgtattcacaggttttgctgtgaaaaatgttatgctttattgggaagtaatgctgaaaaggtagagattatgcataggttcacctccaagaccggcctgtcaatgaagcataaataaattggggagatcgttatttcggcaaagtattatgtggctttactgtttaaaatatgttggcatgtgtgtgtataaagctaaaataagccattgatcatgtatactttttaaaataagtgatttgagtttttgtgggtatgcactgaaggaactatcttttaaattgtttaattgtggatactatattatcttttctattctcaatatttgtgacatataataaaatgttttgtactcattctttctaatgtgttcattttgctctgtataaacttcacggcctttaaaaaggcatctgggaaaatgtcagggtgttttttttttttttttttgacaaattggaaatgccacattcagatgacttcttaggaagaataaaatgttgttattctgagtctaggtttgaactttaaagattcatctcattttagtataaagtgttttatttaccaagaacttcagtaggctttcttgtcacctgaatggcaagttaattcagaaggaacgtatcaaaataataaaatgagaaaagttaggaaccagcattagctgagtcacaatcccctgcttaaccttatttgccagtgcgcactcagaagaactgcttcttaccaaaacatctgtctcttcagctttcagtaggaagcagtgtcctttggcttacaaagaagtggtaacagaactaagcgaagatgaatgaaacagtttgaaattggcattggtagatttagtttctttttttaagcaattaaaagcccgcagcactgtgattggcatttttgacgtttagcttgtgctacttagtatcagagacttagtatcagggacttatcagtaagtccctgatacttactgtaattgctgtatcttgctaagacctgctgtttagatatttcttaggtcataaaatgaatgcttattagattgtttcttgtgagaactaaggaccaatgtagagatcatttattaccagagtatgattattagcattttatgccaaaggaattatttctgcataccccattcagcatttttatatactgagaaataacattaataaatatctaattatttgtccttgactcggcatttttcttcatagttgttaatataattaattttttcaccaagtaatttttttatcctttgacacgtgaaaagactaatcatataattacagtgttttcatcatgctactgccctactctaacattttgagttgtttacagtgcttacagagtccaggcttaacatccatatatatgtacaaggttgtctaaagttttgaggagagacaagtatatattggcattatatgcttgtacagctactgctaacttatctttctgattcttctctaaggccccagagctaaatctgcagttcagctgggttagtcattttattactccagaacatcctgtttccctcagcctttctggaatactctgttccctctgttcattttcttcctttcttcaaaggctagctcaaagctcagatttcttgaaaggagaaacttgtcctaatcagtccaactcagaaaagtcttttcatcttctggtctgtaagaaatagtcggttctactcatttcgtgttcatgcttggctgagctcgtcttttacatcttctaagaagcttttctagacttcgatttttctcatttctcttatattttatttatattgtttataggtgggtccttctattctttcaagcatgtaagttcttgttagataatattttccattaaggtttttttctttatcttccacagtaccttatatactactttcaacaaaaattagttaatgtttgtttgcatttgagttggaatgtcatgtgcttgatagaatgaaccttagtcttagttccttagtctaacctctggtttcttagtcttagttccttagtctaacctctggtttgagtctcaggaatatatttacatccaggtttggtcctttgaagatatcacagactagtccctttttcacatgatgtcctttaaatatttgagtaatatctgatattttaacatttactatgtgatacatcctgtgctaagcattttgtaactaaaataatgaagatttttgttatgcattataaattgttcttagtagccttcaaatacaccacaatctgtgcagttagttaaattcaacagcagttcatttttgcagaatctgtgaagtggggcaaaacgtccttcaattatcagtaagttacctacttagctcttgcaggcaggtaatgcattgcactccatttccaatcaataatatgtgatgagcatccagagaattatataaaaatgattatgaagaaattatcttgatttgatttgaggacattaaatatgaaaacacaaaagcataaaaatgatacaaatatactggcttctgcaaaaatctgaatgaggaagttcttagtaatatgtttcctgtggcagagggaagtaattttttttttaataaggtcttctctccctgaagacctgattataatttttaaaagataactcttaatgctatattaagtatagtgagtgcttttaggtaaagttgccttaaattgggttttagtagaaagatcttctacctgtactttgtccctgatcctgtgttttccttcacagttgttaaaataattatccccctcccaaattttgctaaggcctaaaacagaacagtagtgtatacaataatgaatatgccaggctaatgttggtattcattgtggctagattattttattttaatgttattatttttttttgagttttaaaataaatgcaacaaggtcagtaatcacactgtcaaggctaaagccagatcagtcagtgaataaaatagttaaaatctattatagggttatagttgattattagctttattgtgttgtaagactagataaaaaaaagactagaagactagcttcatgttataaaaattataaacaatatacttcaaatattaatatgaattgctgtctcaaaggctaattcattgatcaagaaatgcaatatattagtcacagagtttcagaatatattatggtgactttaaaaaaccatttttattgtctgtgatttcaaatttaacttctttgtaaacatctgtgatgtactatatagttaaaattaacagactgaaattattacttttttgggtgtaaaaatagcacattttaaacaccagaactacatcaaaaatgatgaaattgaagaaataaaaaaaatttgtatcttcttatttcgtgtggtcaaagctttattgtggcacagtgatgcaaaatgacctataatggcatatgggggtgctagatactaaaaattacattttaagatatatgtctgcttactgccaaaacttatttactttatagctcaggaaacacacctgtaagttgtttttttaaaaaaaaattttggagggtattttttgagaaaggatcttgctctgttgctcaggctggagtgcagtggcatgattgtagctcactgcaacctcagtctcctgggctcaggtgatactccctccttagcctcccgagtaactgaggctatgaatgtgtgccaccgtgtccagctagtttttatgataatcagtttaaactttctatgtactttaagtgtgggagtcaaatgctgttagttttcattttttattatagcattttgactataactgattgcaacttataaaatgattaatattttagtctaatatattagagaggacttcacatttccaaggttgcatttttctttcacggaggggaaagatgttcattgtagctgtggactttcttagcagtcatttctggattccttctcaatgtaacatttcaccctgtgagtctttcagaaatgaataaaccacagctctgcccttgaggagcttatagacctctgagaaaaatagatcaataagttattaacccaaatggtaatggttgtggcagcagagagagtagcacctgcctagctttaggtcgtggttaaggacaacttgaagaataatgctgggctgaggctgggaggtaagttagctgaagacagggacaacatgagcagaagcctggcctattcttcatacatgttagtttgccactgcctttttttgtagtgtggcagacaacattgcctatttgctcagtatccaagctatcagattattaagcaaaagtactaaatgcagagctttgtggcagtgactggaaatcttcctctaggttactgttccccaaacttgagaactctgaccattaaagtgttgtcacaccctacatcaaaaaattgctgcatgaaaagttaaatattattattttaggtgattatttggtgctaatatgattttagacacggaagtgaacatgggcagcaaagtcggtatagtattacatggttataaggtggtcatacatatactcatatacaaaatgaaatggtttttagcaagagctttttttaggaaccataacgtgtgtgccaatcagttaccagctatctgttaattttttggcattgagtttattcatttacaatttacaacttcttttgtctcttcacttactggaaattgaattatcgtttattattttagaaaaaaaaccaaaaagttaaaaagtgagagtataaaaagatgaatgagaagagcccttcccttatgaaactacccggaaacaagttaaagaacagatatagatgtgatgaactgtgaaagccttgcaaattcccatccttttagaacttcctgttcatcatgattttgcaagcattgatagtaattctgcagctataatcttaaaattgtcttctgacaatggaaaataaaatctgacaactataattttttgaattttagtctttctagtttgggaacttcttgaagacatacatgttgcattcctggcactttgcgtgtagttaagtaccttataaacctaattgattggttgactagtcatgaaatacttaaaatgttctttgaatgtctctcctggaagaatgcttcaaatgtggaacttctgttactgtgtgtattataagaataagatagttgcccaattcttgatcctgttagaagaaatctctgcttttcttatacgttcgacattaaatgctaaatgaagggtggggtttctgcagacattatacaatttttttcttcagacatttatcatcagattttccttttgttgttattctgatcaattattttatcctacagcatttactagaaattataaaatgtaatcttaaattctgtattttagatagcagacttttatcttgccaaaagctgattaaagtagcaataaattagtaaatcctcataaaggaaatttcttattacctaaataataagttataatcttgttgtaaactatgttatcagtttctcctttttccatgtcagatgtggtctatagaacaatgattttcagtctggatattctgaaactgccactgttgtgatttattttggtcacaatatttagtccatcttgaaattttaaattacattattgtaaaatcatgttttcctttttacttgcatttaaaatattcttaatttctttttctgatgtttcctcattactggagcgtttttttaaagtccatgtatcttatctctataattggtacctttgtaaaaagtacagtatttgaaaaattattctttgcattttctaacacaatccttttgtaattttctttctgtttattcagaggtcttctctttctgctcttattgtgctgatcatcccttaaatgttttcttacctcaggattctctaagtctcctatttgccttcagtgatctcagcagatttgcttttgctatcacttaaatgcttttggtttttaaatttgtttctagtttagatcaattgtctgctacaggatatcccaccttcaagtttacctcaaatttaatatgtgcaaaacagaattcattctctcttcttgatatcctccttttaccccagagtgtatcctcttgtgttccttgttggtcagtgacactagcatccaaccagttgtccaaactttcctgtctcttcctctttaccttctatactcagttgtttccaagtcagcttcctgcaagtttgcctaggcatttttctcatgttgcagaactttatgcttactttcaaattaaaaccacattgtttaaacctcttaagagccttaatagatgtggctccctttgcctgggaataataatcctctcctctttgcctaatttctactttttcttcaagacttaatttagtcattacttcttgcagaaaggtttgttatcccattagctattatctcatagcaacctgtgatagttgttatcacagagataattctttctgtatgtgattatcttttcccaccagactacgagctactaaatggccagggattgtggcctgtatttgtattccctacatttagtttagtgcctagggcatggtaggcttcactaaatgattgttaaaagaatacatgagattgggtattgtttttcccatttatgtatatttctgaggcacatttgttttttggttttcagagggtagcagtttcacctgtgtccctctctgagttgagaaccaactgaaatacagaaatataagagtcagtttgaagcaagtcaaaataccagttttactactagtaaagctgggttggagaatgcatcttgatctttgtccattatcagtctttctgttacttttcctccaaatctaaactttccaatgatgtatctgagggacaccccaagttagcagagcaaacacattgaccaagccttttgcaaggaaggcacattgattcaaactgccctataactccatggagatcatgtaaagatacacacttccagacccaggtatgcttataagcaggaagaatgaattgcagactgcacatctgaaggagaaactcttaagagtttgtttattcattcatttaacaaatagatattgagctcttaccatgtgctggatggacattgtgcagatggtgcagatatagatttggtgcttatgttttagagcctactaggttccttttttccagactgacgagtaaaataagtcacttttcctcttatagcagaagtcttctctagggaagataggaacagatgaatagaatagtttatccaaaggtataacctgttctctagccattgcatgtaaaataattcccaaggactgataattttaagaacacggtggaatgaaatacagagaaacatatcagcacaatcttaagagaaatttcaaaggtctggtcatgttttagaaaaacgtggaaaatttgatcatgataatttcacttttcctttactatacttgaaatacttggcttaggattttaaagaccatttagtcatgatttatttctgacatgagtctgctaagtattcatttatacaagttacttagaaaatctactccctaatgaggtctggtggcagcatttgaaaataatggggaaattctagtggtcttagccacaaataccagctccctgttgccagtgataggtctttatcacatcagcatctcctgtgaagtcttttctgaatgtcatagcattcattatttttctcactcatttggtctcctggttctttatagtgctatttatgattcagttattgtaatatataagatgatcttacgaggtgcagcctatattataacttatctattgcataacttaggtaaggacagtttcccgaatacctgaagtacacaataagaaaaagtcatatgctaaattctctacatcattatacaaggggagtggttctctagagcaatggctcccgaatgaacgtgggtgtgcatgagggccatggtgggagggggaggcttatttttagaaagaagaattctggtatgccatcccagggattgattcagaaagtcctgggttgggggcagggagtattcacttttaaaagtaatctaggagattcttcttcagagggctcataggccacccttagagaagcattgtactatggaaacatagttcgctttgattgtatttattccaaggcaaccttgtacaattaaagaataaatacaaacagtaagagaagatttttatgaatgttgattttgttagggagttagaagttgtggtaattgtttcttagagatgtgttaatgttaaacgtttgatagataaatcagtataattaggtatatatagttataccccaagactgagggtaaatccagtcattttctattgttactattttgtttgcatctagctttgtttttagtaaaagaactatatattttgttttctgtaatgttgatttcttacaatctcaatatatattagactgcttaatatcaggaaccagttgtatgaatatttgcaaatttcacaatgccttatatgtagtagacattttataaaacattttcattacaaatgttgagtaaatgagctttctataaaaattgttgcattatttgatacatggtaagtattatagttattatatatgaaaaaaaaccagctaacatcttagggtttttcatttgttttactggtcttctatgtttctttttgtcttcatctttttctgccctgactggattcttgctgcttttcttcattttgcagttgtagctgaaaatttgactatttgatacctttagacatgttccaatacgcaggagaataagtaggattatcctggctcctggtttgcctaggatggtcaaagtttatgccactggtcctggcataattaatgatagcaccccccagccactctcaaaatgccaaattatataaattcctttgaagcttgaaaccatgtaaataagtgatttgcaagttgagttcttgccttcacatattcttgccacaatcccattttttgttgtactaatgttattggttctttctgtattttgatttctaattgtgagcatttttgagaccccctaatttgaggtgtctttattttttatgagaatttttctgttttgtatgtggaatttttaatttaccttaatagtatttttaaactacagaagattttagttgtctcaaaataatttgttcttttaaaatggtttagaaatgagtgacagacagttcctgggccattagcttatgttcaagcattgatataacaaaagcagttttcaaaaagacatttaacaatgttccttggtgttccatgaatatttattcaggttgttagaagtcctttacaggaaatatttagcttataaataggctaataaaggggaagctgtaagttcagtttcttttgtcctcttggcattaaaggaagctgttaccagaaacacagatctcagtttttaaggtaaaatactcctatacatgttagctagctttgttactttgtgtatttaccaagattttctctaagacatggaagtaagttcctatagaaagctccaaagatattgattgattggttgaaatacactctataaatggaaactgtctccataatgactttaccaattgtttccctacaaatatagggaaacactttatttttgccaacaagtgcttttgttagactgcattttagcaggactcttagaacatgttagtgcttagtactattataaattcactctcagttccattataaattgtggatagtctgatttgccttatgcctttcctctgtttttctccctcttaatcacgatccctaacatttgtcttagaccactacataattactacactcctctaaaacatattaattagcaaagtaaatttcaatgtgatagtaccatggtttgcattaaagaagaaagtcactgcttacatctttttaaaaaaacagttacaacaatgaaaatgttctttttttaattctaagagtactactgatattgtagaagacattagccaatcttttatatattaaaaaagggaatcacatactgtttcagtttttatttttgcatcatttgattacttacctctgtagattgggacaccggggcggtatagtcttcttgccaagactcttccccctgagcacattgaagatggtcagtgacatgtagggtccagggacatggtcttgaaaataggaatgaaccatgcagtgttgtacagtggtggggcagaggtatgagtacttttctctcctggttgcagctttggtttctctttcatccgttgggttgtttcctattttgcaaactaagccaggatcagatgaaatgaaaagggaatgatatctgattttaatatttgtgttaattttttttcaaatgatgattctagaagcttttcgaatgaaatctctcagaataatattttccaaaagctgggattattctgtattttattgctcttgtctttgtgtaactctgctgagtaatatttaatttttttccaataaatatgataatatacagtaaagttaaattgaagtgtaagtctacaacatgattactaataagtaggataatgtctaaaattaaaactttttaaattaaaaattgtaatagtgggaaaaaatcagatataaagtataaaccagttagttgcctcaggaaaaaaaggtgctgtttttttttttctacagtttcccagaattgtttggagaagtgtacaagagttttgtctgtgttatgcctattatagagcaaagtattgcaatgtaaggagaagaccatcttttaaaacagaattggagctttaattctatttattgctttgttgtcctcttttccataaggtttatgtgcctaggaattaaaaacaagtagtgaaattgagaatgaaaggagagaaggtatacgattatatgtggaaagaatcatgtaataaaatactcctctaatggattaaaatccttttaaaaggaacacttttctgaagataagattattttgttcctttcttttgaccccatatctaattagtcaccaaactcttttcatgttttcccacttttctttcaaagctctgggacactagaatatgcattttgtttttcccatgtgccgtcctgcctagtgttgcttgcgttgttccatttgattacagttgtccttcactgtctctagtttattcctgtagttcagtcttacttgttcttcacgggagtcctcagtatccagttcgagttccatgtccttggtaaaacctcttttcactttagccgcaagttgttttctctctcctctgaacctctgtggtgcttacagctgtgcagtctatttgacattggagagcctttgtcctaaaatgtccaaggtttgttttaaaacttaatttttaaactttgtcttttaaagtatgtagtcacctttttaagtccttgtagttgtcatttgaagcatagtttgctaaaataacacctatattacaggctttatagataatacatatgtgtatgtgtgtatatatatataaaaatacagaattatatataatacgtgtgtgtgtgtgtatattgctctttgggtagctctgttgagtaattaatttttttctgataagtatgataatatgcagtacacagacatatttagctttactgctgtgtattacatatatgtgtatatacacacacatacacacatattatatgtaaattgttttggtacctggaaaggatatgtgtgagtggaactgtaatattgctaaatatttttgattgtatgaagtaaatgtcttgttctgacatcaactgaatgagtaactggacttttaattttaaccttggagggaatatatgtgaggcagactcttttaaagggttttggacaccacagagctagagttcttgaagtggttaattttaaaaatcttctaatagaaagtctgtctcttttcaccttgattactggtggactctgctagacctaaaaataaagcatgaattgttcaaagtgattcatttgacattgtcatctgtttgttggaaaaatcatatcattctggcacttatttagtgttttatggtggacagtgtactttattgatttttatagcgtataggagcagatgttaaactcactttatattttgtttccttatttatttaggaaaaagcatttttataaatgtctgctttatgcctgacatgcataacaatgagtaagatacatgggctttgcatttgaggaattcatattctggtggtgaagacagacacatatatgtaaacgagcagtagattgttacaggtgctgtgatagaaatatataatgagggcatgaaggaccaaaatccagtaatcgtaggcactgtcatttaaaagtatgaaatctagtgagccatacatatgtcagtcaatttctattatgttacatgtgagaattaaatgagagaattgctacatagaaggtgtagatactattattgtatgcttttatagattatgaaacaaacttaattcaaagccatacagtcagtttccataatatgaatacaatctaaacattcttcatctccagtgacagtgttactaacttagtatttttgttttggaggatagctttatcccaagtagccagtggcatggtggcagttagtggtggagacatcaatatttccagttaaattatcattgaatagtatagtcccttgaaagtggaagttgcttatttttaaaggggtctttttttttttaatgatccaagtccccaaatttatagagttgcataggaaagcaaatgttatctcaaaccagaagtactcagtggtcaaccaaccacttacaatattggttcccagtattcagaattctcctagtacctttgagtgcctgcgtgcctaatccatactatcagtttcaccttgagtttctctatgcagctgctcaagtccttctatgaatgcctctttgagacaggatggattggaaattagctctaatacctcattattgaaggaggaggatgtttcctcttctagaggtcaattggcatcactactgtttagggactaagaggcattgctgaatctatatgagaatgatgttaggggagcaaaggagaagaattttcttgcagtgttgagtagataaaacaaactgcttgcttcttctactatactgtcacaatacttgaacacttctgtgaacaaatgtgtgggagattttccccaagcaccgagctagcaattccccagctgggtgtcctctgacgtaattcagttcttagcaatatttacatggaggtagtgtcacaacccacaggttgagggctctgtcccacaggactgcctccctccgcccccctcccctccagcacacacacacactcacatacacacacacatgctctctctgtctctctgtctctgtctctctctcaagatgccagttggaagccccaggttgttttacctgtgcttctgccagctataaatcaggattcccacactccctccttgggctcagctaatttgctagagtggctcacagaacttagggaaatactttacttacatttaccagtttattataaaggctattaagaaggagacagatgaacagccggatggaaaagatgcataggtccaagtatgggagaaggagtgaggagcttccatatatatttgctccaggtaagtcaccctccggaaacttccatgtgtccagccacctggaagcccatccacacccagtccttttcggtttttttatagaggcttcactataaaggcgcgattgattaaatcattggccacctgtaaccaacttaactatcagcccctcccgcatccttagaggttaggggttgtggctgaaagtccccatcctctggtcatgccttggtctttactgtgactaacccacaccagaagctatccttgagcccccagccatcagtcaacttattagtatacacaatgacacttggcactttggagaacctaagactatcagaagctatttgttaggaaatgggaagaccaaatatatatttcacaatatcacagatgtctttaaagaaatgttacttcaggagtatgtaaaatttactcataaaaaaagagcttattaagtgtgtttaggtggcttctacactccaggcactttttatgtattattaatttaatacccttaactgtgagaagtaggtagtaggattttcctgttcactgactaaggctcagagagctgtattgaatagattacttctgagcttatgtgtacactactataatattcagcctggcacttttttggttataatttatccactgtgtctgaattctattttcccaaagttatcccacttgagccttcctatttcatattcttctagtgtatcataatcagagttctgaattccacatgctgtaggaggagaatagtggatagttttctcttttatgtgctggaattaatttatttttactgataatagtatttattgaatatttcctaggtgacaaacaccgcaaaggcactagacatacaattggggaaaagaactacaatatagaattaaatttaaaggaagaatttatattgcttagacttgccagttgttggagactttctgtgatatgctcatccccctcttttttttttttttttctttcttttgggaaagaggaagttgggaagaggtcaaaaatatattagttttgggacccaagtgagtttgttggaagggatcagaagctaggataaggaggaactaaaggaatgctttaaggaaagggggtgtaagtaggcttgctttcttatttaacctgtatgaaaaacctacttttattaagctagcaatataagtactttaatagtatcttatttaagctagttggctttgcttgcagaacttgatatggatattatcaagttcttgatagctttatatttgatgtcaatgacaagttaggtaagttacagtacttctgtgccctctgctaattaattagaagtaaagtgaactaggcacttgctgaacagtaggtaaaaggatctagagtcagaaagatcgactagaaaatagtctgatacaacatgaaggactatgttcaggtacctgcagctgaactcgaaaagccttatgaatttacttcaacaagggagtcacctacatttctatacttgagtaggtccaatgattttattttacttgttctgatatttataagtagaatattcatatttatttaaaagtctatatagtaatttcttttgtgattattattgccagttatttcaaccttacattgtctttgatataattttataaaaacctgaaattgtaaatgaaaaattttaacctatatgccttctttatagtgggtagttttttatttttagtaagtggtcaaaaaggtatttttgttttgtgttgggccttcctgagaaactcactgtgatcatttatttccctatatggcaatgcatccctcatctgttaggcacacacatttctgcaattatgttcattggtcatgatttatagaaagctaaaatatttaaagtaatttagaaatttgctggtacttgagtttagtgtggcagttactctttgaagtcatcaggtctgggttggaattgcagttcctcagatcctccccagctgggtgttactggacaaaattggcctctctaagctggtttcctcatttatccaatggagatgatcataaccctcagagagttacgataggagtgagtgaataatgttgtaacatccttagtacagtgctgtacacgtcatcttcagaaaatggtaattgtccctcctgctattgatatagttatggttgtgaaccatatgtaaaatttattgtgatttttaaattatgggcttacaacaaagatttttatgctattgggaatcctatcttaagggtccttgatcatcatctgcttaccctgattgtaatactcctcttactgcattactaataatagctaccattgtattgagtgcttgcttaataagagctttatatacaattttatttaattcttattattatgaagaaggcattattacatctatttttactgatggggaaacttgtgtgtagtaagacaaagtaacgcacccagcccagctggacggagggagactgattcacttcagatctgtctgttccaaagcccatgttctttaacccatggctgtccactagacacttcaccatttgcttatctgtctctcctggtaaacctaagcttcccaaaagtgggaactggacattgtttgcattccaaggttacatttatatttcaagctcttttaaactaaaagcagtgtatagtgtataacatcagaaatgttaatgtaagtgaaacttaatagcttattaagaatctttcttattgaaaataacaaaatttcccattcttacagaaaacttgaaacattaggacttgttttttagacgtgtggctagtctgtgccatgctaacaatttgaatttactatatttggctttgcattagtgttcactaagtactcacttaatcttcttttcaggttataagcttctttcatcattgcaatacaggacctggctcagtgcttgtgtgcttaatacatatttgattttaatttattttagtgtcagtattaatgttgatctaaagtatttttagattatttcagttgtttgggattcatcagtgagcaaaacaatgatccctgccttcatctgagtttgtcctggtgagggggcacagatgaggaccagtaaacacaatagaaagtttatttaatgtggtaggtgataagtgctatgggaaaaagaaggtagagcagggtaagggtggtcagagaggcgtagatgaagaattgaagaaggtgacagagttattatagctgttagtagatacttgggcatgccccaggcagagggaacagtgagagttaagatccaaaggagggggtctagctggttagaattagcagggagaccactgtggcttgagtagagtggattgcaacaggtgggtgggggtatgccggagttgcgggcagatgacatcagaaaggaggtaaagggggcacggatgatgttttcactttgtcagatgaatttggcgggatgtgtatgcatgttacctaaaaattcttagaagctgtgtgtctttggagtaaggataagaaatttaactttgtcttttcttaatcactgattacatttgtatgtctttatttgtgacagtttgaactttgtattttatatagcccattaatattcagaaacttgaatttccaggcctgtttacaatattaataatatctgtatttcttgatttttttttttttaacaggagtatgctgctgctgttccgctttgcgtcctcgctacaaacgcctggtggacaacatattccctgaagatccaaaagtaatttgatctacatctactgatccttctctttgctgacccattctgccccccgctgacctccttaaggtttccctaatttcatttctctacttttacccttacatctcatcatttatactactttttttatacttttcttttttttactcttaaatgacccatgcttgcttgtctagttttcagatccttttagtagattaggcacaaatctagaaaaatggacagttgatgttcttttatagtttatatagtgtctaagtaacactgtcgcattaatttatgttcattaatttatgaaccagtgccagattatttaaactaagtgctcatgataccactgtgaacagagagaaggttttctgctctcattatgcacatatataagtaaattggtaattacagtttcttgtaaaaaaaaaatgttgtactagacaaatgaagtatgggctgctcctggagaagataggagtgatacccaatttgggttgaggagaagaaagcctggaggaaataaaatctaagctaagatccaaagaataaatagggattgaccacacagtttttagaagagaactgagaggtaaagaaagattgtttcaggcagagtttttctttttacttaaatactatttaatttttgtataacaattattttatttgtgaagattactggtttcaaagcaactggttggggtgattttgtttcacattgcctcaacctttctaagacttctgtagtctcctgttaaatgaataggaacaaaaaaaaagttacatggcttttgacttccaaaatttgctttattttaaaatgtaacaaactgtataaagcttttgattatcttaatattaacttaatgttgatgtatcttatttttaaccaaatctgtttaaacattcagttatgtagaggaggttaatcaattaaatattattggctgccagatatcctggaaaatttgtggcatattaaaaaccctaagatatggtactgccttgaaggacctttccatccagtaactgacataaagcagaaacatactaaatatgaaattacagtgcataaatcagtaagtaaaatgctaagtaaatcaggtggaaagtttttgcctctaaagcagggaggtatcactgtgggttgggaacctccgggaagcattcacagaggaaatgagatttgctgagctttgaagtatgtataccatctggagaggtagacaagattagtctctttattgcaagtgaggggaaagagaaaagacatgggaaagcaagacatatatttgaagcctagagcaagttatccatcagacttcaagcgaaggtttatataacctaattgtagagtgtaagggtggtaatcatgttgaccatgatttctcatttgaaatttcagatgttatcaattagtagactgaatatccaaataattattttcctgagaagtctgggacatatggttactgaaggtaaggtggaggccagattttagaggattgtgaatgacaaggaaggcctctactatagtcactttaacttgtagtcagtgaaggagctttgaacacttgatcattgaaatgaccataggtaaattagagaaagaatccttatttttgccaaggatttatataagatttgtttaaatagcaatctttaaaataagattttaaaaaaggaaaagatctacatgaaccttgaatatatatggcaaacattactcaatttgccatgtttcttatttttaacttgttaaaacaaacaaatcttgtgatatgtccataatcggtcagacagtaggtacccaaatgcagaagcagatgtcatagtccctgccttgaaagagaaatctagtaagggggacagataaacagtttcttaaaattagtagccagatgatcttgggcaagtcccttgttttgtcatcatgtaatggaagtaataagtagtaccgatctcataatgttctcatgaggactaaatgagttaatgcagctctttactcactgttgctttcctaatgtctatcattgtgcctggcacatagttggcactcattatttgtttaatgaatgaaaagataatctgataaaatataatagtggagataagtactgtgaggtagaagaacatgtagttggaacatctcacccaaacttggagtgggggctgttgggagggtgcaacacagtattggaggaagctaagacctaaaggatgagtaggaattatccaggtgaactggagaagggttcctaggcaaagagatgagttgagtgaaagaagtcttgcacaaaatatatgatttgtaaactgtatgattctatttatgtcagatgcatgctgattcatagtgataaaaagcagagcagtggttgcctgaagagggagagatggcctgcaaaggacatgggaaatcttttgtaaatgatgaaaatgttcttttcctgttgaacatccctaatccaaaaacctgaaatctgaaatgctctgaaatccaaaactttttgagcactgacatgatactcaaaggaaatgctcactggagcattttggattttgaatttttggattagggatatctaagtagttaagtatctgcaaatattccaaaatctgaaaaaatagccaaagttgaaacacttctgatcccaggcattttggatgaggtatcctcaacctgtatcttatttttagcagtgtcttcacagatgtatacaactgtcacatttccaattatataccgtaagtcaatgcagttatttatatatagattattcttcaataaaattagtaagggattaaaaatataggagagacacaattttatttcaatgatgatgtggaggaactgatacagagggagaggtcaaagaaccaggaagaagagaggctaactaactgatggagccagatcatggaactgtgtgtggaagacagccagagcagaggcaaaccaattcctcctagacaggaaaactagattgcttcactttgcctagggcagggtttctcaacttaggttcatttgacattttggtccagataattacttacttttgggggctattttgtgcattgtgagatatttaggaacatccctggcctctacctactagatcccagtacccaccttcacccatctatgacaacccataatgcctttagacattgccctggaggggctcagttacacctggttaagatctactggcctagcaggcactgagaaagcagggatgttttgccagtaaatactaatgtgatggcttccaccttctctgggaaagagaagagctcatttgctgtctgagagaggagagaggcaccaaagtagcaagtttgaggaaaacggagtaggtacaaaatatgagggggtgactcaactagggaaacagcaaaatagccaaagaacattgagggaccagttgaaggtgaaaacacacatctatacaatttttgttgcagattcactgtctaacatagtttccctttctcccttctcacctattccaatattcctaagcaacacttacttgggttatatatggccaagaaacttacgtggtaactggggagaatttatgcacctgttgcacatcatcttttaaaaggcagagacaaatgaccgttttataatcccatatcagggacctgttgttgctttttaaatatgttgaataagtatagattctacagctctgaatactttcttgtttattaattacaacaaaaacttataatgatatcactgacttctgaatcattaaaaaagccatatgttgactatcgtataagtaaatgagtaaaacaggcttaataacatttcacatttttaaactgaaacaaattttgtttgaaatctttttacatctatatcccattccctatatactacagataattgagctatgtctctataaaggaagatgttagagtctaattcactgtttgtgctttgcataaatggggcattgtaaaaaattttttgaaagttctatgtatccatcatggtgaatgttagcactaaggaggttatgtgcagaagggttctacataaatatcgtttaatccccaatccagaaagggaaattgtaaagcaggcaacacttaaaaatataataagcatgaaaatatagataatctatttatcttgttattgtttttaggatggccttgtgaaaactgatatggagaaattgacattttatgcagtatctgctccagagaaactggatcgaattggttcttacctggcagaaaggttgagcagggatgttgtcagacatcgttctgggtaaggaaactaatggctgctaaaatagtatctttggaaaattctttctagacttttaaatcattctatagattattttgccatttagtgagacaaagataatatatagaggataaaacattgtaatattatacaaagaaatatataatactccaatagatgctgtggcttttattactttcctggtggtcaggttttgtgagtagactatgttagttaactgagttactttttgcttgtgtctattgatttttgagtcttttctaatgggaaatagtagaaattgactcacttagtctatcagtgcaatactgtaatttaaaaatcagtctctaaattgaaaacaaacagaaagatcctgttaaccagatcattttttttcacacagcttcagttttacctctcggaggagtaataagagagaaccgtgttaggcttagatatcaaggcccaggaaattcaagcatgctgatttggaactgtgctagctatactcttactgataaatagaagtctaccatcctactgtattctctgtgctcaaacaataataactttgcaatttggattataaatactttttcattctgtcattttatgatccaagtttattggagtattctattctccaagtgatatattagctttctgtacctttgcgttgttaccacttagaacattttagtaagtgatggcacacatagctttatggttgattgttgaaggaaaagtatccaaagactgaattttaattttgttttaaatttaccctttaaaaattgatacataatattttacatacttatggagtacctgtgagtatttgtcacatgtacagaatgtgtaaagatcaagtcagggtatctgggctatccatcacctcaatttatttatcacttctgtgtgttgggaacatttcaagtccttttctagctactctgagatatacagtacattgtcgctaactttagtcaccctactgtgctgttgaacattagaacttatttcttttatctaattttgtaagtttgtattcattaaccaacgtctcttcatccctccacaccctgccctcgcaaccgcacttacatgcccttcctatcctctggtatctgtctgaattttaagtacaagatgtaaaatctgatgaattgtaaagtaatatttatgagatttttaaaataatattatgttgctgatagtgttttatctactcatatttagacatataagtagattatattggaaattgtcacattaataattattttgggtcagatacaagtaaatatggttaaaagtctggaaaatagaaaatgtccatatttacaaagaaaaatatacacaaagttaatgttaagctcacatagttaaggagaaaatgggggaatacagtgtatattttctgtatacttcgataaaaggattattttataacctacaagatattagtgctgtgtgagaattaagattttacttaggagttactaaatttgcatttctttctttggtgtatttcaatagacttatttcagttcttccaatgtaaagcacttaggagaattaagagaggtagaaatgctttgacattctttttctcctacatgtaggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattctgtgagtaaaactattctgttactaaatgtatgcttaattagcatatctagaattaattacttcttagaatgactttacctggtaaaggcaaattccctgaatagggcatttgaacagtcaacacaaattaagataattagaatactttgcctctcagtttttctgctgtttcttgtgaaatctgtggtattaactaatcataatagaatgtctgcatgtaaatgaatgcatacttgtcatttttattttctcttggtcttttattgcaacactaactttgtgtcctacattccttttgagtttcatgccttttcattaattaaggttgtttccatttttatggctagtatgaataatgctgctatgaagatttgtgtacaggtttttgtgtggatgtatgtttttcattctcttgggtatatacttagtagtgtaattgctgagtcatgtagtaactgtgtttaactgttttccaaagtggttgcattattttacattcccaccaccaatatatgagtgttgtttctccacatcctcatcagtacttgttattgtctatctttttttattttaagcatcctagagcgtctgaagtggtatctcattgtggttttgattttcatttccctaatgattaatggtaaaactctgcacgtgctcgttgactattgggtatattttctttggagaaatgtctattcaaatcctttccctccttttttcaattgtctttttattgttgagttgtaaaagttctttatatattcttgataagagtactttatcagatatatgatttgcagatatcttctccatttctatggttttgtcttttcactttcttcatggtatgctttgagtcactaaagttttgattttgatgaagtccagttccttttttttttttccttttgttgttggtgtgtaatgtgtgtttggggggtggtggacaggtatgctttcagtttcatatctaagaaactattgcctaatccaacatcagaaaggtttactcctatagtttcttctaagagttttacagtttaagtttgtatttaataatccattttgagttagcttttgtatgtgatgtgaattcagcattcaactttatccacattttgcatgtggatatttaactatgccattactatctgttgaaaaggctattctttccctttgaatggtcttggcagtcttttaaaaataaatttaccataaaagttaagggtttatatgtttattcttttttagactgcttctgaactatttctgctcaccacattcattttcttctatcttgaaccattgtcccttaaaataagtttgggaaagcatacctactttaaaaagaaaatagtgataatattttttctcttgtctttagtttcattgtatcaccttcagtctttcagttccaacttcttctctgagaagctttaaggcattcaacctacatgaatactgtatgtttccattcagagttttaataaaaaaaatcatatattacctgctattgtttatggataattgttttctggtataggaagaggaagtatacgaggtgctgacagtgtggattccagagtctgactaccccagttttgaactacgcctgtaccgctttctagctgtataccttgagcaagttatttattctctccttgcctcggtttttcatctgtgaaatgaggagaatgagaataccaatctcacaggattgttgtgtgacatgagttgatatatatgatgctcttggaagagtgcatggcactgttagttattactggtagtaagagcgttaaataaaccctcattcaaaactcttaatatgatttttatcacttacttcagcaggaatatattgggtatttccaagtgcatttagatgatgtgacaagcttagtttcaggcaaggtagctacttaggcttctcctgttttgtttacattaggtgaggaatgttttgggaaagtggcttactagctagggggagaattttagtatacatttccggaaatttctttactttcacccagcaatgccattagattgttttagtgagtcatttgggcaaaagacaaaattctccagttacctaccttaatttgagtgaattttattaaatgaaatgccatgttatcttgaccaacattaattacctagtatttcctggtggtctaattttcttagtggtgctgagtgccttatgttgtcaaacatgaccagtgctaatttaaaatttattaatggtgttcgtacggtttaatttgttgacattttcctcttcatgctaatgccaactcaatatgacagtaatagatgcaatgtatttcggttctcctttgtttcagaaattgtgctagatactttttatttttacctcttttttattgtaaagtgtttcaaatatagaaaagtgtggagcataatatagtatagctatatacctactgattcaagaaagaaaaatactaaataatatcaataaatgataatataatttttgttataaataatacataatggtaatacatgttaatactatgcaacattggttcatgttctttaaaagaaataatacagtatatgctagatattttacatatattaattatgtcatgattctcaacccttcaagcttagaaatattattttcattttatagatgaggaattacagctaaataacttgtccaaagacacagtgaagtaatgctgtatataataggaggattcaatcttaggcctttcttaattcgaagcttgtgttctttgtacaatgataaatacactgtcattattatggattaagatttagggaaagcacagattatgtttttttcttcctcttgttttctaaaagtttattattaaaaagtttcttttgggttggtgcagtggttcatgcctataatctgggtgctttgggaggccaaggcaggaggatcatttgaggccaggagttcaagagcagcctgggcaacatagcaagacccccattgttacaaaaataaaattaaatcaaaaaattagacaggtttggtggtgcgtgcctgtagtcctgacgccttgggaagctgaggcgggaggatcacttgagcctaggaattcaaggctcagtgagctatgatcacaccactgcactgcagcctgggcaacagagcaagaccctatctcaagaaagaaagtttcttctgtattaatgttgtatttgatgttttgtttgttacttatttttatattgcttgttaatatgacagtgtatgaaattaaatgtatttggttcacacttctgaagaaggtgaagtatattatattatttgtgttttttagtttgtcaaatttgcaaatattgaagaagacacaccatcctatcacagacgttatgacttttttgtgtctcgattcagtgccatgtgccattcctgtcatagtgatccagaaatacgaacagagtatgtattattttactttatgatctatagtaagtaatttagagattaatattgtgttcatatgttacataatgattaccagaggaaacaataatatgcctgaaatacggctttccattgctgttagaagctataattgctgactgaagtagcaaaatgagaatggttttccagctcactaaaatgcggtctttactgtagcctagaatgtctcttcatgccctgcttactctgtcagatcctgtccttctatcatttcttcctaccttcactctaatcctgccatgtggatctccttgccatttcttgaatactttagtcacacctctcctcaggccctttggacacattggtctttgtgcacagaacaattccctggatgcccacatggctcgttacctaactttgttcagatttctgctcaaatgacaccttatcacaagaaccctccccagccaccctttattaaatgtcacctctctcattctacccctagctatctttatcttcttatcatgtatctccttgtttcttgctcctctatggaatataaattccaggagcgtgaggactttggtttgaggactgcagtatcgcgaatactttgaatagtgcctggtacatagtaggctctcagttagtactttttgagtgaataagtagataaattgaatgaatgtatattactgaatcactatccatctgaggttgtcatgacaactgtcttggacatttttaaacatttcttctggatatatcctactaaaaatctggaatcaaatattttataaactcaactataggttgatagaatgagacatacagaaatgagaaactttaaagttaagaaagtcaaaatgactttaggaaatatagaaagtaattggagcattactatctacacctaaaaaacaagaaatcaacccggatttagagttactgtgggcagttgataagatatagcatgctttataacttttacttttattttaagataattaaaggaatgtacagaaatataactaggttttagttaaagtatgcaagctacagtgctggtttacatgaaacaaaaacaagtataaatgttattttaacttggagaaagaaagcttaaaggtgattaaatagttattttcaggtataagatttgtttttgtctgtgatgctgctggtatgatttttgctcagtagagtataggccatttagagtcctgctattattcctttattatgaagtgtaaagccttctcagaggtaaaaaatactataattaccttacaataattagttttctatttgtctccatcaccaggaaaattaatttttctctctctaaaggatatcttaaatgtttatgagactattctctgtcttcagaggctgataataagtttttaatggggcaaaaagatacaaagattagctaaagaaaatggcaattttttcaagattttaacgtttttgctttctttcaaaatatagaaaatatctggaatgtagtacgtttttctaagtatttatcatcccctagtgaaatatcttgtcttttgaatatatttttacctgttcttcattactgcttccaaaaagaaactttgacattttctgtaaaccaatgaaaggacttatagtacaatttgctaactctaggtctttccaatattatatcatatttgaagttccataatgccaacattttatttgaattcctgtaaaacaaatgagtaaattaaaatgctatttaatataaaatacttagtttgattatttctgctttaacttaaataaaagcccttttgattctctttaagtatatttatattctattttaagttctaacttagagaaatcatcagtccctttatttttttaccaagctgttaccaaatagaactccaggggacatggacagtaggagatggggctggtaaatgttaggattttcttattttccttgaagaactggctcccacttgtagagtcatgcatcacaatctttaactctaattttctgaagaaacttcagctgtggtagaaattaccaccaccaccaccaccaccaccatcattgtcatcatcctcgtcgtggttagcaacaaacaggaacagctaacactgagtgctttctgtgtgccagttattgtttaaccactttacatgaattaactcatttaaattgttcaacatttctatgctgtagatgtgacagttgttctattttactgatgggaaactgtagaattcgttttggggggtcatggctagaatgtactgattagtctagatgttagatctgaattggatgaagctgtgtagctatagtagctattggtagttaccaccaacactgccctttaaccttgagcaagggcaccgctatctgctgctgcaccatttaggctgctgtctcacaaggcatgataaaagtttcatcttgtttgttaatgtgctccatgccaccttgtgcttggccttctcatcacccaaggtgtagcagcaggtatgtaaagcaggcaccttgtgtaggaatgttaggcttgcccactgtgatagctgcacgagaatctctcaagactctttatgttttaaaaagcagcatgtatagacacggctttgaaataggcaaaatttgcctttgtgtcttccaattcatttttctcacctgttcagtatcatattactgccacctcccattgtccatctgctactcctgaatgcctgcattattttgccatggagatgtaaagcaatgtcacctccctccccatatcttctattctttaaacctatttacagtttttagaagacaatgctaggtaaactgaataaacaactaattggtgagtattttagatagcagaaagaaaggaagtaaatagccatcatatttgaccagaaggaaaatgttttgagactcattgggccaccaagttagctctgcttgagactttgttcttttgcagtttttagaaactgttttctagtcacttttcttctcattcttgaacctatagatttttattttcttttgcttttttaaagaagtgtaaggaagagcttgaggaggtttggtgctctgatctgggatgggaggataaggcagcattctctcactattatattgatacattttaagtcacattatcagattattatatgataatgtatatgtgtttatagacatatttgtatatatattgctgaggttatctctgctccatttcgatagttcttatttgtaataccttttaaaagaaccagcttagtcttctatctaggtagtcaaagggagttgaagggctgttagggaggaacagtgagagaagtctgaagaagcatgaagggtgttcagaacagtgaaatcctgttttcactcagctcttaagacttctaggtaagaaatggagtatcattatcattttaagaaaacctatgctgttgattttttaaaattgaaaaatagatatttctgtattttatagtccttttaacgttttaaatgcggattttaagaacatgatatttgaagtaagcctttttgcagcacatctccatgtctcttaaatttttgagatttactttcttagacttgtgtgttattttaagatattttattgataagataacagtatttacttgatatccattctcttagctacgcaaacagtcttgtttaaataatttttttatggctcattttcttcctttttttttttttttataggatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacaggtatttaaaaaaatattagtgttgagacagtgttacttttatatatatgtatgtgtgtttcctaggataagaatgttttgtctttagtactctgtaaacagtagtctcgtaaagttaagtgagtttaaaaatatgtacctttctgaaaaaatttttactctgtagtgatcacattaggcttagcagactacagattattattcatacacttaagcctttattttcttttagaataagtttacagtttatttgccaccaactattgaatatccaaattgctgttttaatggatactacttaaagttgcaaatgtgagaaacagaaattatagctctacttttgttaatataaaagatccagcatacttttgcacagggagttagaactaaccaaaataataatgataatgataataatagctacccacactgtattttattttttcaacaaatggttagatactgttcatatttgatttgtcctaagatgttttggaactgaatattgttttaggatataggcttattttttctttttcctctacaacattcacttgcagttagaattctgtactttattccactttttcaaatactagaagcatgcttatcccccacatttctgttgccatacacagagataataagttaataataaataaatagtgaaatatttattataaataatattttaaatatttaatataaataataaattaatatttcagaagcagtattctccaatggcttattatcctgactttcctgattcttgcagtttgaagaggaaaattggaatcaaatttaaaagtgattcaattctatagttctaaatttaaattttatttatgattttagtgattatatgtgtaatagcagcataaaagtagtctagaaatgagatgtaattgataactctatggtaacacacgttcatgttaacttacactaattacagaaaggattcatgcttaattccttagatgtgactgtctccagctttgggaacctttcctaaaatgtgaaacttgatgtattttagcactatctgtatttttcctgttcttggcactgtagctgaggtgaaagtttccttatctaaaatatttactatttaaaggatcactagctagttgggaacccattttccataattacggctcttgaggtccaggattagcataagtaatataccagaaacaaagctcattggttatcagttcttaagaaattacattttttcatgatataatccccgtgccacatatacatttttagaattattattcataaattcattagcctaaaataatgtttcaggatatgaacagaatattgtctgctgaagacagctacgtatacagatattctagttagcttttaaattttattttttatttacaggctaggtcatagtttttcactttatttttgcccatttacagttaaattaaggatacctaaagatggtctctgggccctgtgttcttactaagattttgctataaatatagaaaagttgaatgaaagtgaaagcaagctgctgagtattttagttatacataaaagacattctgttagctagaaacaatttgcacagccaagtttatttcttcaatttgaaagagtgtatgattcattttggtggtgttaaattcatgaaattagaattaagctatatattttctggagtataaaaagaaaatgccattttaacatttctaaaaagtaaagtatattttgtttattagaactgatattaaaattcttgtgtttttctttatttctcgttcctttttagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgtaagtagttggtgttttcctggttatttgtgattttgctgtattaattctgtgttaacttatttatagaggacaactacttttttacttgcatgagtgagttattaatggaaccagtgtaacattgtgaaagtagtacaggactgagtcatgcatgatgtgtttgaccagtggttcaattacttaattagctttttccctttaagtatgaagtgtaataatgtgttaatatcatgtgcattaacttgaatatctgcttacagaccttgaaatgcctatgtgcagtgaaatatttaaacaaacagtgtctaagcatgatgtatcttgttctactaactttcatggtcagtttttcctggtccctggcttctatttattggctctctttttgccatggctgggctgccttagatcgcattcacatctctgagtgaattcatcttttacatagtgattaatcagagcaagaatattaaatatcttgttggtactttcatgctctcctccaggcaaaatatgttaatgagctttgagtttctccacatagatatggtctctcaagccttgtcaagcctttgtgtttctgactcaatcaccagatgatagatctactatataatattctgtgtaatttctggacatttttgctagtctttcttttgttaaaattcaccttgtccttttctccttctgactgtaatagtggctttatagaatatgtatgatattctaaatgtaacatccagaattctttatttaggacagatggatgttcttagcctagagttcaaagttgagccttagttacaagaatctataaatcacaaaattatattaaaaattagagaatcattagattttcaaagggatctgtgtttcctcccacctccaaaatattgagatctattgtttaaaggctccctaagcttatggaaatgctactaaaaattaatcagaattacaccaaatatactaaaggcaaatttatttttttaatatctagatgtgctgacttaacgtcagaattccattttttatcttaatactcttagaactaatctataaggccttaaaaatctagagagctagcttggaagaaagaatttaccaaataagttgtacttgagttgaataacttgaactcagttatattcttttctacatagaacttaaaatttctgatcatgtattagttaattaattaaattaatcttaagtaaatatgtgattacacattaaccatttagttaattaaatattaaatgccctctgcaagtgaggtgccagatatttggggaatatatgcatgaataacaaatttgatgggtgattgacatgcataatatttataaaataatatatggattatgagaaaagaacaaaaagtgctctagcagatcaaaacaaataattcatgtctaatttgaagatttagggccagggtcttttttttttttttttttgagacagagtttgctgttgttgcccaggctggagtgcaatggcatgatcttggctcaccacaacctctgcctcctgggttccagtgattctcctgcctcagcctcccgagtagcttggattataggcatgcgccaccatgcctggccaattttgtatttttagtagagatgagatttcgccatgttgttcaggctggtctcgagctcccaacctcaggtgatctgcctgccttggcatcccatagtgctgggattacaggcatgagccacagcaccctgccagggccagtatcttttaatgtagatgaaggtagttatcaaaaactgctctggaaattgtattttatttgtaaagaatgcttttgtttgacattgaagtaggtttttaatttcaattattatttgatcgagtaaagaaaataatagatgatttaaaagaaattttgaatatcatatttttaatcaacagtgagcacaagacactgatattgttggctggagtgttgaatatagtttaggggttacggtgagataagagggaaaatgtttaggctatactgtagagatcttaaaattttatatttaagtttatagataattagtggagaccttagctcaaaagtataaagtggctataatttccctttgagaaagttaatcagatagagctatataggacacatttgagccagggccagtatgttagcaggttactgtaataaaattcttgacaagtgcatatgcgaactataagtaattggtagcatgcttgaagcggtaaataaagtttatttttctgcctcttaggagataaatattgtattggacgatatttaacttgactattgggtaagaatccataagatcatgataatgcaggtcatattagcattaaagatttattttatatcttctgagagtgaagatggaagaatttgcctcaattataaggcaaactacccaatttatcagattcaggttaactgtgcatttgttttctgcattttgttctgtaaattctctgaatgtgtttctatcactgcttctgtccactttattttaattagtgggtttcatttctgccttctactcttcattcaggcttctttagaacaggtagccatgttcaaattcttcttcgaatgtatagagcctagagcatagtatgtaacacgtagtagaccttaataactacgatgattcaagagggatttcaggtcttttttttttttgtaccatttccatttttaatgacccaaaaagtaattattactttcaaggaaatgaaagttataagaagcagcacagatgttaatataggtcatatcaggatgtgctgtttattagttgtatgaacttgaaaaactcattcaacctctctgagctccaattttttcacctttgaagagttttgaatgcatgcattaaatggtttatttatatattaaaatagaagctaccacttatcaagtgctggctgcgccctgtgactatgctaataaccttatatactttatcttacttaatccttttaccctatgaaatggatgttattatccccattttccaggtcagagaactgacccttagagaagtcaagtaactcactcatggacaaggacatataggtagaaaatgaagtcagaattcaaattctgatcattttattcctgaacccatggtctagattaaccattaaggttgataatatatgcctagcataaagtatattttcaacaaatgatagttacaataaagctggtttcgatatggaaggacaatttttaaaatttaattttgatacagtaggtgagaagtagatctggcaatctgtgaatataatctaaggctgttcccctgttgttttccagccttgtatttgtccttcattcaccctctttcattcagatttacttgttagttaaaattaccctttgagagaagtaaattaataaatcacaacattaaaaaaatggaatcaataaatatttgttgattaaatgttcacgaaactacttctggtccacagcattgctttagaaatagctttaattgcaacatatatttcatgaagttcattacttaagaattaaattgaaatcttgcttttcttttaggtaatattctcactattaagcttttcctattgttgaggtttctagaggaagaaagtatagtaaaatagagaattttaaagtaatttttgttatttgcaggcatttagatcatcacaaactgtgggatcccaatgaatttgcagttcactgctttaaaattataatgtattccattcaggtaaggtttgattaactatttactgtatttatataagtaattttggttctctatggataagcacattatcaaacagatgtgggaagctgtaggatataaatcattgctcttaatttagctcttttgtctcattcattttcatttgctacttattttcttatttgccaagataaaaagatagatctaataaaaataactaaatcattctatcacggttcccctcagagccaaggccaacacagacaagcttcttgacagtctcctgctatcccctgattcattgagggtgttgtcttttaggggttccgaattatcacagggatttctaatctcatagccttcctttcctggatgggccctaagctttgtatctagtctcctatgtatacaaccatttaaatgagtagctttgggcactggaaagctgaagatttgcctgggactgctgctggcttcagtgtgcacttgcctttccagatgcttaccttcttgtggagtttagactaagggactttcctttcttgtcattttatgtggatatcagaaagtcttacatatagctgatccttgaataacatgagtttcaactgtgcaggtccacttatagtatagattttttttttccaacaaaatgcagatcctaaatctattatttgtcggattcaaaaccccacgtatatgggggctgatttttttcctcacagggccaactgcaggacttgaatatgtgcagattttggtatggggtggggctggaacctatccccaagtatatcaagggatagctatagtctagtattttactattgttttatgacagggtttggcaatttgggaaaacatgtataatatttctggaaatggtagtatatactagaataagaatttctgtgtattatcattgtacaattaaaactttggatagctttgagtgttttagttaccatttaccataaaattggtgcaggtatcattcttaggtaatatttcaccctctctccataaaacaaacaaactggtcttgaccaggatttatatccttaagggtttacatagtttcaaatatagtaaggcatttctggtaaagggaaagtattttacttaaagcctatcttttgtgctaaatttatttcttgagggtaataagatgtgattaagagttgtactctgggatcagacagagttcactattaggctcttccttaagagtttctgcaggcagcaacatttgctgttcacctgtattcactgttctgcagcctccgctgctgatacccaggcaaacagggtctggagtggacctctggcgaactcccaacagacctgcagctgagggtcctgactgttagaaggaaagctaacaaacagaaaggacatccacaccaaaaccccatctttacgtcaccatcataaaagaccaaaggtagataaaaccacaaagatggggaaaaacagagcagaaaaactgaaaattctaaaaatcagagcgcctctcctcctccaaaggaatgcagctcctcaccagcaatggaacaaagctggatggagaatgactttgacaagttgagagaagaaggcttcagacgatcaaacttctccgagctaaagggggaagttcgaacccatggcaaagaagttaaaaaccttgaaaaaagattagacaaatggctaactagaataaccaatgcagagaagtccttaaaggacctgatggagctgaaaaccatggcacgagaactacttgacgaatgcacaagcttcagtagccgattcgatcaactggaagaaaggttatcagtgatggaagatcaaatgaatgaaatgaagcgagaagagaagtttagagaaaaaagaataaaaagaaacacacaaagcctccaagaaatatgggactacgtgaaaagaccaaatctacgtctgattggtgtacctgaaagtgacggggagaatggaaccaagttggaaaacactgcaggatattatccaggagaacttccccaatctagcaaggcaggccagcattcagattcaggaaatacagagaatgccacaaagatactcctcgagaagagcaactccaagacacataattgtcagattcaccaaagttgaaatgaaggaaaaaatattaagggcagccagagagaaaggtcgggttacccacaaagggaagcccatcagagtaacagcggatctcttggcagaaactctacaagccagaagagagtgggggccaatattcaacattcttaaagaaaagaattttcaacccagaatttcatatccagccaaactaagcttcataagtgaaggagaaataaaatactctacagacaagcaaatgctgagagattttgtcaccaccaggcctgccttacaagagctcctgaaggaagcactaaacatggaaaggaacaaccggtaccagccactgcaaaaacatgccaaattgtaaagaccatcgaggctaggaagaaactgcatcaactaacgagcaaaatcaccagctaacatcataatgacaggatcaaattcacacataacaatattaaccttaaatgtaaatgggctaaatgctgcaattaaaagtcacagactggcaaattggattaagagtcaagacccatcagtgtgctgtattcaggaaacccatctcacgtgcagagacacacataggctcaaaataaagggatggaggaagatctaccaagcaaatggaaaacaaaaaacggcaggtgttgcaatcctagtctctgataaaacagactttaaaccaacaaagatcaaaagaaacaaagaaggctattacataatggtaaagggatcaattcaacaagaagagctgactctcctaaatatatatgcacccaatacaggagcacccagattcataaagcaagtcgttagagactagaaagagacgtagactcccacacaatagtagtgggagactttaacaccccactgtcaacattagacagatcaatgagacagaaagttaacaaggatatacaaggatatccaggaattgaactcagctctgcaccaagtggacctaatagacatctacaaaactctccaccccagatcaacagaatatacattcttctcagcaccacaccacacttattccaaaattgaccacatagttggaagtaaagcactcctcagcaaatgtaaaagaacagaaattataacaaactgtctctcagaccacaatgcaatcaaagtagaactcaggattaagaaactcactcaaaaccactcaactacatggaaactgagcaacctgctcctgaatgactactgggtatataacgaaatgaaggcagaaatgaagatgttctttgaaaccaatgagaacaaagacacaacataccagaatctctgggacacatttaaagctgtgtgtagagggaaatttatagcactaaatgcccacaagagaaagcaggaaagatctaaaaattgacaccctaacatcacaattaaaagaactagagaagcaagagcaaacacattcaaaagctagcagaaggcaagaaataactaagatcagagcagaactgaaggagatagagacacaaaaaacccttcaaaaaatcagtgaatccaggagctggttttttgaaaagatcaacaaaattgatagactgctagcaagactaatacagaagaaaagagagaagaatcaaatagatgcaataaaaaatgataaaggggatatcaccaccgatcccacagaaatacaaactaccatcagagaatactataaacacctctacacaaataaactagaaaatctagaagaaatagttaaattcctggacacacacaccctcacaagactaaaccaggaataaattgaatctctgaatagaccaataacaggctctgaaatcgaggcaataattaatagcttaccaaccaaaaaaagtccaggaccaggtggattcacagccgatttctaccagaggtacaaggaggagctggtaccatgccttttgaaactattccaatcaatagaaaaagagggaatcctccctaactcattttatgaggccagcatcatcctgataccaaagcctggcagagacacatcaaaaaaagagaattttagaccaatatccctgatgaacatcgatgcaaaaatcctcaataaaatactggcaaaccaaatccagcagcacatcagaaagcttatccaccatgatcaagtgggcttcatccctgggatgcaaggctggttcaacatacgcaaatcgataaatgtaatccagcatataaacagaaccaaagacaaaaaccgcatgattatctcaatagatgcagaaaaggcctttgacaaaattcaacaacgcttcatgctaaaaactctcaataaattaggtattgatgggacgtatctcaagataataagagctgtctatgacaaacccacagccaatatcatactgaatggggaaaaactggaagcattccctttgaaaactggcacaagacagggatgccctctctcaccactcgtattcaacatagtgttggaagttctggccagggcaatcaggcaggagaaggaaataaagggtattcaattaggaaaagaggaagtcaaattgtccctgtttgcagatgacatgattgtatatctaaaaaaccccatcatctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaggggatgtgaaggacctcttcaaggagaactacaaaccactgctcaacgaaataaaagactatataaacaaatggaagaacattccatgctcatggtagaagaatcaatatcatgaaaatgtccatactgcccaaggtaatttatagattcaatgccatccccatcaagctaccaatgactttcttcatagaattggaaaaaactaaagttcatatggaaccaaaaaaagagcccgcattgccaagtcaatgctaagccaaagaacaaagctggagtcatcacgctacctgacttcaaattgtactacaaggctacggtaaccaaaacagcatggtactggtaccaaaacagagatatagaccaatggaacagaacagagccctcagaaataatgccacatatctacaactctctgatctttggcaaacctgagaaaaacaagaaatggggaaaggattccctatttactaaatggtgctgggaaaactggctagccatatgtagaaagctgaaactggatcccttccttacaccttatacaaaaattaattcaagatggattaaagacttaaatgttagacttaaaaccataaaaaccctagaagaaaacctaggcaataccattcaggacataggcatgggcaaggacttcatgtctaaaacaccaaaagcaatggcaacaaaagccacaattgacaaatgggatctaattaaactaaagagcttctgcacagcagaagaaactaccatcagagtcaacaggcaacctacagaatgggagaaaatttttgcaatctactcatctgacgaagggctaatatgcagactccacaaagaactcaaaacaagtttgcaagaaaaaaacaacatcaacaagtgggtgaaggatatgaacagacacttctcaaaagaagacatttatgcagccaaaagacacatgagataatgctcatcatcactggccatcagataaatgcaaatcaaaaccacaatgagataccatctcacgccaattagaatggcaatcattaaaaagtcaggaaacaacaggtgctggagaggatgtagagaaataggcacacttttacactgttggtgggactgtaaactagttcaaccattgtggaaggcagtgtggcaattcctcagggatctagaactagaaataccatttgacccagccatcccattactgggtatatacccaaaggattgtaaatcatgctgctataaagacacatgcacacgtatgtttattgcggcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaattggaaaccatcattctcagcaaactatcgcaaggacaaaaaaccaaacaccgcatgttctcactcataggtgggaattgaacagtgagaacacatggacacaggaaggggaacatcacacactggggcctgttgtggggtggggtgagggggaagggatagcattaggagatatacctaacgtaaatgacgagttaatgggtgcagcacaccaacatggcacatgtatacatatgtcacaaacctgcacattgtgcacatgtaccctaaaacttaaagtttaataaaaaaataaataaataaaaagcaacaaaaaaaagagtttctgcatgaccttagacaagttactaaaacttgccttatttatactgtgaagagcatggagtaattacggtgaacctacctcctagaactgtttatgtaaataatacatatatagtacttagaagagtgccagtgcttctggtcacttctgaatgaaatgctcttttgtcgtcattattgttatgttcaatgttaatagtcatatattagctcacaagtcacaaattgaaaagtagtaataataactaatacatattaagcatttttcatacaatagacacaatttgggtgctttatacaaattaactcatttaattgccccaagaatcctatgagtaattgttattgtttaaatattgtagatgagagaaactgagttacagggagattaaataaaatgctctcttaatctgagagctatttagctattaaatgatagtcagaattcgatcttgggcgagtttggctccagggcttatgtacttcaccaccactgtattatgttgcgtcttaaagcgattcatctgttaacattgccttaaacttcagtgtaagggcaaattttaccataggtaaatgaaacctcagtacacatgacttcaacatactgtattacgtcttctcactttccttcctttcactccatattcttttgtttaatacatgatatcattcttgagttgttctttataagtagaaagaacacatgctctggtttgcttagtatagtcgtactttataattattgataatacctccttcactctctgcagtgtccccatttggacagtaaatcaaatggctaccttacctataaaggcagactaataattgcacaaggttcacacatcagaagcatgcagcttcctggacaagaagttcagtttcaggttttgtgtgtgtcttcctgcctaacattcatctattttaacataactttaaatgaaacaaagtaaagatgaaaacacaaacttagtttttaccttgggtgattttaaaagtagatgtgtattatgacaaaaatttgagaaatacctagagatgaaatctgttacttgatagagaaggaggggaactttttgcttttgagcagagtaaccattatgcatagggcactcctgcttcttatcaaaccacacattccaaaggaaagaaaggtaaccagcctgaaaacagggcagaggggacctgtctgaagacaaatacagacagggagattgagagccacaggtgctttttacagcttggtggatgatagtagaccgatcgtgactcatgggtgtaagtgtaggttttaaaaaaacaaaactttgctgttcttcaaaaaaaaaaaaaaaacctattcactggagttaagaataaacatttttttggctatcctttttttgatttaggccccaatatcattcactatggttgatcaattttatttatatgtgataaagttgcctttgttaattgcacatcttttgagatctccttgatttaaattttgtcaggtacacatggataatattttcattttgacactagctcttgattagatgagtgttttgactctttagcattgttaggtgtccatgttaaatagtatttatctagtttggctatgggaaaatactgtgaatgtcataatttatgttttttacaaaattttgtcctattataaaagtttataaatgcactttgaaattacagagaaatataaagataatgaagttttctcataaatccctttctcagaggtggccagtgttaatctttttatatataattttaatttactttttaaaaactagattgaattttattaaacatagaattgtgcagtatgctttttttcactcagagtgtcataaatattttccagcatctctgtttattctttaaaagaatggctttgtattgtggctatttattgtctcataacatgaccaccagtcactaattggtcatttacgtgtcaggtgttttttttattcttaggaattctgccaaggtacatgtactttttatacatctttgtactgttttgtctccttcaggctcagtattctcaccatgtgatccaggagattctaggacaccttgatgctcgtaaaaaagatgctccccgggttcgagcaggtattattcaggttctgttagaggctgttgccattgctgctaaaggttccataggtgagtgccaataaataaaataaaatagtgcgttgatctggttcaaagtgtcctttcagtatgcatagcagtgtatgaagaactctttaagaatatttctacacatttttcggtgtacaataattttttttgaaatttgggttcatgcaattattttcaggcttctttagcacacagttaagtattttccttcacatcaattcctcctccctttccttcttctaataaaggtttttgagtattgattatatactgaacattgagagaatgcagatataagaaactgatggtgtacttgtgattagacagctccacctaatactgtaatatgtggcaagctttgatcacatatcatttaaaaagccagggtttacagaagggagggaaaatggattaggattagcacaagcaaaattttatgtggcccattttgggtagaatgtatggtgttagtttagaagtcagagaagtggctttaaaattaagttgtagccaaattgtggacatagttcttcagctgattaatagtccttaaagatttactgtaatcttcatgagaaatgtgctataggataatttttctggcagcaaaatgtagggcacattagaaataacaagtcagtgtcattgttatatccatgtggaaaagaacttgcccttgcatggaagcagtaggaatgacaatgtcaagttgataggatttgataatgggttaatgagaaaaagggatagttcaaaaattacgatattttacttacatgtaactacaaaaatgaaatagtgcatattagaaatacagaagtttgaaggagaatctggttatggtttctttgcttgaaattcaaagtggaaatatattatctaatgatatagtcatccctcagtatctgcaggggattggttcgaggacccctgagaatacctaactctgcaggtactcaaattctgtatataaaatggcgtagtttttgcatataacctttgcacaccctccaatatacttcacatcatctttagattatttataatacctaatgcagtgtaaatgctatgtgattagttgttacactgtattgcttttttatttgtgtgtgttttttttttttatcgtgggttttttttttcccccgaatattttcaacccatagttggttgaatctgtgaatccagaactgcagatatggaggaccaactgtattcctttgttcttttattgtcaaataaaggtgggcatcttggatgtgaattttctgttttatcttgtaacttgaagagataaaactggttatttaattggaaagttatttaattgcaaataatgaaataaaacatagatgatacattgaatcatcacatcgattaatgtctactgtgtgttaggtactctgtgctaggctctatacgtttgaagaggcatttaaacacggctgcctttcctgaagaagcttaaatcaagagtaaaaggcagaaatgaaacccactaattaaaataaagtggacagaagcagtgatagaaacacatgcagaggatttatacaaaaagcgagaacaaatgcagttaacctgaatctaataaatttggtagtttctgtctcataattgaggcatattctcccttcagtctcaaaagatacaaaataaatatttgatgcttctgtgagctatattacataattttgtggattcttacctagcagttaagttaaatattgtcctagtacacattattgtgaacagataagattaaatagttagaaagtttttggtaattcttatatgcctatacacattttttaagggtggaaccagagattcaaacggtgagttgctcataaatgcccagtaaatgtttgttgttataatgagtgtctttcttaattatttctcatttactcttttttaaaaaaatgaaatagtttataaattactatggatttctgactatttagaaaattacagaaacaatctgtggagaaataaggtaattgacttcaaatatgcaatactagaaacatgtatcttctcacataagtgatcctttataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggtgagtacatttcacttttcaaaactatcatgtaaaacagtgatttacaaagctctcacataaggtcctggactattatagtacatttgtcaaagatgaatgatagcttaaatttctgaaaatttaattttcgaaaacaagcaagcatgagaatggaacaaagaacactatgttgttccattaaatctgcaggacacaaattcatctattgttgacattttatggcatttacttcttcatttgcttttactctctttttcctgcatctcttcctcccttctctctctctctgtttctttctctccctatgtgtgtctctttgtgtgtgtatgtatatgtgggaatacacacatacacatgcatatttttttctaaaccacgagatacaggaagttgcatacatcatggtctattaccactaaatactttgatgtatttttccaaaaaataaatgtactttttaatataaccagagtaaaattgtcaacatcactaaatttaggattgatccagtacttgaatcagcctttcatatttcagttttatcagttgacccaataatgtactatattgacttttttccttgaatccaagattcagtctaggatcatatattgcatttagttgtaatatttctttaggtccattagtcaggaacatttccattatgacatggacatttcttatgagtaaagtccccctcccacttttttaaaaatagaaagttcttcatttggttttgtatggtgtttccttgtgattaggccgtgcgcggtggctcacacctgtaatcccagcactttgggaggctgaggcgggcggatcacgaggtcaggagatcaagaccatcctagctaacacggtgaaaccccgtctctactaagaatacaaaaaattagccgggcgaggtggcgggcacctgtagtcccagctacgcgggaggctgaggcaggagcatggcgtgaacccgggaggcagagcttgcagtgagccgagatggcgccactgcactccagtctgggcgacagcaagactccgtctcaaaaaaaaaaaaaaaaattcaagttagatattcctgactggaatactacatacgtgatatgttcttctcagattagcacatccagaggtgcacactgtaacttgctcctttttcattatattaattttgatcacttaaggcattattatattcctccactgtatagttttagttttttccattgcaaataataagcaacctctgagaagacactttcagatcatgcggatattctgcttttcatccagacttaaggttagatctagcaatcatttataattcttgtctgaattagtctttaccatgatggctgcaaaatgatggtttttaaactctagcactccttccaaacctatcagttgcctctcaatgttctattgtaagcaggggcccccttttctacctttctatgtatgtaggaatgcatgtatttgtttattggtatgaactcaatggatttatattttaatggtttataattcattactgtagttaatcattttagtgctcagattgtccctgatttggctcatgggagctccttcaagacatccccccacctccctgaaccttttttttttttttttaaagcactgccttacttgagtaagcggttccagacgaattctgtactttctgccccagccctggaatcagtcatttctccaaaggagctgcggttgtttttagtggatagtagtattagagactaagatctggatgctaatatcttggactttaatatcatatgcttttctttcttttttaaattttcttttttttttttcctgtctgtagtcaaagtacaaacagtgaagagcttccttaagaaaacagccatgagaatttacaattttggaaatgaaataatctgactgtataaatacagattcaagcaagcaagctatttttctaatttaacttttttctttcaatattttctttaggatagccagatcatattttaatataactaactggttgctatgataatttcacaattggattgtattcctggggtctagtacctaatttctaacctaataatagtttcaattaatagtagagtcatatataaatttcttctgaaactgggcttatgccttttatctgggtaattttttcacttatgggctacttatttataataatcctttgggatacttaatacagagtttctcttggtcatcttgtttttgaagtttatggatatgcatacatgcattttgcatctccattgacaccacctatttatttattggacatatgcgtacaccagttcttgtactagggcctcatgatacatggggctctcaccttgtagaggcatttgttgatctgtgtggagtggtacctctgtttcatctagttgcagtctcatcacatgtctagaaattgtcctcattaagggaaatacccaggagtgtctcattcaacacactaacacaaagtaggcacttaagattttgagattgactgaaaagacaaaatatcataaactccaacattaccatggagtcataataaagcatagacattctagttattgcttaagacagttagtattaatatatagtgaacctcgcttctgtggtgactttcacatttatttcggttatttatagattttttgcgatattcgaggatgttaaatcagctaatcttgttttcacagaattgatttacattgctttaatgacttctaattaattcagtgttactctttcactctagaatatttaatgtattgtttcttaagtattataaaatgtatatatagcagactcaagccatatttctgtgatacagcacattcagaataacatgtaagaatttaaaaatgagaggaaagaaatgcagtgtggcacagtaagatttctcttttaaaatcaaacttttaaaaaaaatctggtttccttaatagtttcctttttaatttctcagtattctggcagttgtcagatcatggcgttattcctgtcggtgggccatggaacagggctgctatagcttttgcactttaagttatcaggctgttggccaacttctctttcttttaaaatagtgaagaacatagctacctgctgtgttcttttcttctgggctcatttctgttcactagttcaaatacaaacagtaggtatagtgaatgagatgcttttggtgactttatccttagagttaatcatgttgaagactcctacccaattttaagttaaaaaaaaatcaaagcaattctaaagcatatattagttgcatttctttcctactattattatttttaggtctttaatagtcgtttgtctaattaacatcagagatagtggactcagttgaccatatacttgggagacaaaaataagagtttttccttaggacagtggttcttaactttgttgaacgttgaaattacctcaggatcttagaaaagtactgatgcttggactcccacccccagatattctgacttaattactttggtatgtaacctatgcatcagcatgttaaaagctcccctaggtaattataatatgcagcaaagcttgggaaccactggattagaggaaactattccacgcatttgaaaagcatgaagaatgaccttgaatcagagatacaaatgttgttgaatacagggaagtatgatagtgcttgctaactccaaacttttactgtagttaggtgctgtggtaaagagaagtgcagggtactttatgtccttgtggtaataactaagttgtttgaaacagaaggtcagtgtccagttttctgcaagactaggaatgtatctagttgtatggaagaagtatagaataataatagcataagctttggaaataaataacccttacctcaggccctaatgttagctgtgtaattttttggtaagagttcttgacttctcttatcctcatttccataagaggaaactgagacaaataatagaacctagactcaaaaggttattttgcggatccaaatacaaaatagtttcttattccataaatatgtattccgtaagtgttaacaacaatatactttatggagatggagtcatgttaaggttatgagatttttgactgctaatgtacgtgattgtgggaaatgacttttacccctaagtccaatcaaaatgatgaatagaacagtttgagtttatataaacacatcattaactccagtaatagaagctcaacagttacattgaaaagtcagcttattcttaaaaaatactaaaaatgcagaaagtttctgtaatgactacattgaattttaagaaaggaacataacagccatgatttgatagtctgttccaatctttcaaagaaataagaaacttttaaagtgtgagtaattgataattaaaggttataaatcttttgtgaccaggaagtaagtatcaaaagctacagcagataaatttaaaatattctcagaaactagactgcataagaaaaatgacaagtaagttatttacttattttttacatcagttgaattatgtatgttgaattaattcacaggggtaaactataaacttggcttattacaatgacattcaaatatttgagaaatcctggaaaaccagagtagtgactaattattaacttctttaccagacaatgtgtggcctgattaccggaacaaaaatttaggcttacgatgtgtgaactagaatttcatcagaaatactaccaaaatatttttccttcttttttttttcctattttttttttttttttttttggagacagagttttgctcttgttgcccaggctggagtgcagtggcacgatcttggctcaccgcgacctccacctcccaggttcaagcaattctcctgcctcaacctcctgagtagctgggattacaggcatgtgccaccacgcccagctaattttgtatttttagtagagacgaggtttcaccatgttggtccggctggtctcgaactcccaacctcaggtgatccgcacacctcggcctcccaaagtgttgggattatgggcatgagccactacacccggccaatatttttcctttttctaaaactccagtcaactcaagtcagtcccggtttgtcactgttataattatataaaaaaagactttgatatatttatcattttatctaccagtccattatacacagtttatattgtacataactaaatgattttgtacaaatgaaattgtaatatcctttaatgttacatgtagcttacagacttgtgagggattgttttaccacatattgaaaactttggctaaaaataattttgtattatatggaaaagtagactttttcagtttctaaaatttgtcttaatactttcataggattttttggaagtaacctaccagattatcagaggtcagaaatcatgatgttcattatggggaaagtacctgtctttggaacatctacccatactttggatatcagtcaactagggtatgttctcagactgtaaatttgaacttaatcttgagttacattttatcctaacgaaatctagaaaatgttaacgttttgtttttttttaaaaatcattagtaatagcattcctatggaaagcagttagtattattatgacagtagattgctaagcaattgaattagcatttttaggcctttagaatcattttcagcttataaattctcagatatttccatctttagaaattgtttggcctggacattgtgtgtgtgcatacacatttagggtaaagcttcaagtttcctgtataaattttaaacattaatgtcaatatatcagaaatattggcttattcctagaattttagaactgaaagtaattttaaagattatgtgacccccttattttatacatttaattggattttataatatgctgaagtttttgtttgtgaatgttgttttgttaatttaataaggaagtaatagtatcttattcgacttacatttctttgaccataatttgttattttttaaaattgttcttacctgtttattcatatttgttaaagaaagattatattcatcaactatgtagtaattattttctccaatttaaggtaccttaatttgggttgtttagttgtctgtttatatgatttaattttcttgtcatcagatgcataggactgtttgagagccaataacaaattttttgtttgatatttttaaatataatagttttaattcacgtgaaattttactttggcatgtgaagtgagccatgacttaaactgttacaaaaataaaatctatttagccaataagaatagaattttaaaatcagtaattgaagtaaatgaagtaatataaatgctaattagtataataattcagccttttgtatattttagggatttgggaaccaggagaattcagataatgttgctgagatctttgcttatggtaaggcatttaagacaaataaaggacacacttaaccttaaattactgaaaacattaattgaatagcttcatgttacaaccgttctttcttaagtaagttactgtttatggttagtattttattatgttcttcattttaaagattatccaatttttttaccgtttatttctcacttcttctgtcactgtctttgatcttcataatgatgaaacatacagagggcagaaactattgctgtcttatagacgaagatacctgggcccagagactgtgagtggaaggagttgataaggtccaccaaagtcactgggctaaaaaacagaactcagacttgaaatccaaagttctttcaacatattatgctaattctttctcatactgaccaaataattgcttctgattgggaaaataattcattaaaatgaatatttgccatttaaaatttgaagtggctataagtagctgaaaaggaaaagtatacccagaatgaaaggtcctctggttattgtctagcaattgtactcatatttgattcagccattgctagcacatatgcgtcctctcaaaatcagtatctttcagatttatcctagaaatgtttactatacatgatctaattttttaaacagactctctcaagtgcagaaataccttgtgtggttgtatttttaattttttttaattctgtttatggcgcttgtcatttagaagttttgaattctaatatagccagatttatcagttttttctatatgttttgcactttttcatttgtatcttatataagaactccattcctcctctgatgatataaacacatttgtttgtattttcttatagcagttttaaaattttagctctctacatttagaactttaatctgaagtttatgtttatatgtggtatgaggcatggattttcccagatgggtagacagttgtcccaccagtttcccagctgacttataaaactatctccatcctataataaatgcccaaatgtaaatgttaagtattccatacatgtttataatcctgaaaatatgttgagatctcccacctgcaatttaatttgatcctaagcctttatttatattaaacaaattccctaagtaaattattttgccttgcctttctgattataccatatagtcaactgaatatatgttatgcttaaaatgtttaatagcatttaagtatattctctttaaaagttttatgtttagaagatattgacgtactcttaaatgtcaaatcaagtaactaagtacagctttccaaaatgaaaatgtattcctattaaccaactgcctaatttaaaatgaaagaataatttgcaaacttaaatttaaaatttgcaggtcttacttttactctttgtcacctaagctccttatatctgttttgtactaaccttaacctctctgtgcctcagtttctccttatgaatggcgattcactagtgtctaccttacagggatatggtgaggacaaagttaatacatatgcagtgcttagaatcatgcctaacacatggtaaatgtgtgctattattaactttatttttcttatgaatgatgtttttgtaaattcagcaaaatccttcattactttgcacatttcttttatgtcttttctccaggcttctgtccatattttctttcctaagtttatggttcttataaaagaatatgagaattttacaaaaaaaggactcatgacaaaaggttgtttgttttcttctcgataatcaggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcaggtaatgtgccattttgaaatggatctaatgataatgtttttaaattgctaaattagtgtatttaagtattgtgatttttaaaaatctagcatgttcaggttttattaatccataattttatttaattggtattgagataatttaatcaatatgttttaagataacaaatttttggagggcacgtatgtactcttcagaagcaattcagtagtatcattacatacaggcttatcaaactcctaagtataaatacaattttccatataagatgtgatattgtaaataagtgtgctattcattaaaaatgatatattgatcgtctctagaataataccggatgtagctgacctaaagataaaaagagaaaaaatttgcagacaagacacaagtttcatgaaaaaggtaagacatcttctaaaaaaataaatgtgtagtgtaaattacagccgtttgaattgttaggtggttttatattgatctgtgcccttgaaattaagccatagaattttgaatttgaaagacctcaagacgccatcttcagcctccctcaagtgtaacattcctgtcggtgtctcctccagcctgtatttgagcattctattgttgggctgctgtagtagttctaaatttcttctctgagtaaaatgtcttcctataattcttgccctggcagtcctctcccactaaaaacacacgtactgattcctcttttagcagctcttttatatagacagcttcaagtttctgaaaatagctatcaccatcaaataaattaactatggtgagtttttgctgtcttattagacattgttttctacactatttgggatataaagatgagttgggcaggatctctgccccaataatggttttagctggattttcatgatgataatttaaattctgtagatctactggcaaatggctgaatttagaagattatgatatttatggttatttgcatattgagtaaactttctgtgcggttattattcgtccaaagcttgggcacctaatatttgctatacactgagtcaatattaagagatacgataaccatgacactgccagctgcccttataacgaacacagtattgccagctaagggagcctgtttttagaggtgtgaggaaaaggagacagagccccgtaggaagctaggtgtagagacccgtaatccatgttcttttttgcctctttactagaccatgctttctccctgacactgtctttaatgtttctgtctttaccattactattgattgctgtgtttcaagttaactccattttaaaacttcatttaaaaaataatttacaaaatatcactcttcctaaattaatgtgattccttgaataaaatatttaaatgaggctatactgtatatcaaaaaactggttaataaataggacagatacattaattcctctcaatttttatttttgtatttctttatatcacctaactaatgaattctgcataactgaggaacctcaaacaattttttaaaatattttttattgacattataattatatacatttatgggatataatatgttttgattatatgtatataatgtggaaagtttaaatccagctaattaacatatccattttcttgcttacctatcttgttttatggtgacatacttgaaatttactctcttagttattttgaaatatacaatacactattattgactatagtcaccctgctgtgcagtagatctcaaaacttaactccttctatctgtctgaaaccttgtaacctttgatcaataatctctccataccctcctcctcgctttcaggccccagctcttgctaaccaccattctctacttctgtgagttcaactcttttaaattccacatataagtgagattatgcagtatttcttgtgactgacttgtttgacctagcataatgtcctccaggttcatccatattgtcaaaaatgaaagaattttcctctagtgtaaggctgaatagtatttcattttatatatatatatatatatatatacacacactacattttctttatccattcatctgttgatggacacttaggctgattccgtactgaggaattttaaatcattactgatataatgaattttgtaaactcaatttataactaatttttgagtttttgactttatgcaatgacattaaacagtcatgaacattgagactggatttcattttatccattataagttatagaaataatacttctgtttattttgctagtcaaccaatttgaaaagctgtaatttaacggcaagattagactattatttcatgttagattttgaatccttaaactgttctcagaattagttattcctctgttttataatttaaagtaactttccttgctaagcatttgttgtcattaatgtaaaccattcctttttgggtctttctctttagaagcaatgtgttcacactttttttcctttgtcaaaattttatttttataatttgacaccatttttcatttaccttccaatttgttttatgagtaaaaatgttgtttgattttcatatgaaaccttaactagcaactcagataagtttctgcaaagaactaaagaaaaaaaattgggttctgtaggcacaggatgatggactggcctttagttaagagaatcctagtttagcatagacagtatattttctatattaactttgttcaggcaactgtgtcttaaattactacccagcctaaaactactccatctgaatgttttaggggcatcttatatacggagtctgtttgaaaaacggttccagggctggaaccccttatacattgggaggtatcacttcacctgtaatttcctagtgaagcgtattcttccagagaaaatagctgccaccactgagtctacaactcactatatagtttctcaccatgtgaaaaagctcttgttaatgtttcacctaatcaaggaattatgtcaaaaagagtactttttattatgaaatataaaatacatgggaattattactttaattattttaaggtgaacaacagtataaccaaaagcatcccacatgttctgtcttcttcataactccatcctctcccctacaggtaatcactatcattgctctgactttgatggaaattgactctttcaaattttttttacagtttgataacctaaatatacattatgtccttgaactatattgtttagttttgccagtttttgtaatttgggtgaaaggaaccatacattgtgtattcttttaagtttaggttttttttaattcagctctattttggtaaaattcatctgcgtgtggcttcgatagtattccatgatatgaatataccacaagttttcttttgttgtcagacatttgaattctttccagttagtgagtgttatgaactgtgctcctaaaaacatgcttgtacacatgttgtgctgtatataactcccatttctccaaggcctgtaagagaggaattgctgagtaataggttatgtattcttcagattcactagataatgccataccaatttgtaaagttattatacctatttgtatttttacattacatattacaaattttttatttcatctaatatggtgactatgtagtaggtaatttttaaaaacaaacttgaattacttaaggaacttgaagtctaaattatcacgtatgtatgcaccactttaatgtttgttaatgatgtttagaaccatagaattcaagaatattctgaggttttgagaggacccaatgcatagttttttttaccccacccaagtatagaaaccttatgtgtttgagagagagaaagaacgagagagacaaactctagattcagaaaggtggaaaccaaaataacaacttcagaaataaaggaatctggtgggtagctttatgtctgtagccaaaaaaggcttactaacactgtaacacacatttaagctgacttaaccagtcagtcattgtcacagctggagaactataggcctccttacggggatgggacctcagtgcatattaaatagagaacagagcagaatgcatacttgttacagacatactggcttcagaagagtctgtgctgttctcgcccagtttcttctcctaaaatgatcagaagaaccttctgagaaacaggcttggaatattaagcctaaagtctctccacatgggaaaaaatgagtgttcttaaccctgcctgcctattataaccacatggggagctttatacttgaaaaatactgatgcttgtgctttgccactgaccagttacatcatattggaggagggtggacagtagtgagaagtggggagggcaagagcatggtggtcattccagttgtccagtgattccagcgggcagttagagttgagagctaattgagttaatgtcgccattgtgactggatgtggcattgcacctgtatccaggaatgctttagaaaggaaaggctttaataatctttattataataataaataataaatctttattataataatctttacttagatcagtctagtttaggggaaacctctgtgcaatacctggggagtttctataacctcttctctgttaataggctttagactcgccttcagggactccatgccaaaatgtaacagaacctgcagatgctcttctctgtacggctaacccacagcacagggattgttccccagtcaagagagcctcagtacatttcctctcagtacaataatctttatcattgctgaggctgtattgccaaagtgtctcaggattctgccatccatttcactttttttctcaagtcaatccataatttgcttttgttttttcaaattactattaaaaaacattttcattgttagcacaggaactattttttactggttatttttatttaaggtttgtcttcaactttaacattagtttgtagttgtatattagcatgttgtttgatatttataattgaaatttgactatctgatcaacttaaatttcatttccatgttaagctatataataacatagctacactgtaaaagtatatgcatgtgaaatctgccttttctacattttaagcaaaattacctttgtcctctgtcttttctcctcagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggtatgctttcataaccgttcactgcagaaaacattttttataaagcagacaacatctttgaaatgttgccgttatccaaggacatgaattttaaaagggaggtatctagttgtaaatctaaaatactcaagactatgactacattcttcatttattccttttacatatgttgcatgagcatcaactggtgtgctaaatatccttcaaggccatagggatatagtgtgatgaagcagacaaacatagtccctgtatccacacttcctacactgggggggatagtcattaaataagaatgacatacatgcagttgtttaattagagttgcgtaagtgttatgtaatagaaggacagtatgcaatggccatatatgcatgtccgtgtgtgtgtgtatatatatatgagaacaggaaaggctttcctagggaagagagtttaagttggaaaaattaactctcttgtaaaagaacatttgttttcctttcagaattgttttagaaaataacttctgataaagtggcatttttgttagctttccaaactacctgcagttttccagtgtaatcagagaaaatgctggtgaagtataagaacttgatctctctgatgtgtttgtttcttattaaaggacagtgcaattatcaatgaggataatttgccaatgttccatcgttgtggaatcatggcactggttgcagcatacctcaactttgtaagtcagatgatagctgtccctgcattttgccagcatgttagcaaggtaatgtatttagaaaagtccttaaacttgaattttgtacaaaattgctaattttattccagtgatgattatttttaactttggtgattacgtatcaaattaaggtaattctataaaaatctacagccagtaaactgaaactacagctaaaactgtagctactgtttttatattttcttagatgcatgttgttttattataatagtttaatgtagtggttgaatggaatatgtggttttcttctagaataccttatgtgatttattctatgacttttttcctttgaacccttatgactcttagtatgtaaattttcttaaattatactcttttgttgtttattctaaactacttgaggcagatctcaaaagttgaataattactgtgcatctcagagaattgtcttgtgtctttcaaatatatttagttgtctttagcagtaactcttacatggttatttgcatgacttaataaacatttcaatgcccccaagttacctagcagaaaaagtccacttttaaagacatctgtaagagagaactttatttttcttaaattggaagcacatcatttagtccttgctaaaatgtagacttgtagtgtactctaagaaacaaaactcatccattcattaatcagacatttgagtgaatatttgatgcccaccactagagaagtaaatactacaaaagcagagtacctctttgctcacagttcattggaggagccagtccacacaagtgcctggagaccttgtacacaggctgcaaaaggtaatgcagcaggtggaggatggtgatttgtaaagcgatttccaaaatagtgcatttgagaaaatagatattcttgctttattataataggcttaatcaaatgtaatgtgtcatcattttttgctttatatattattttattgtcacagttttatctgttaaattttaaaaataatagatgtgaaaacaaaacaaactttacatttgggctgtaaacttagcttaaattcaaaaacaaagtgatgttatttcttataaatgtttaaagttgtttttttttaagctgttttctgaatttttatagcaaggtactgaggggtagggtttttgatttttgttctgtttttgaatattttttaggttattgaaattcgaactatggaagccccttattttctaccagagcatatcttcagagataagtgcatgtatgttaattctttacattttaaggatggggtactgacttgataaacccatcagtaataattataaaggagtaaatattgttacaataattcctggtgctttatactaatcatcattttgtgtctgtcatttaattcatttaattatttcccttgttataaaagggcctgcacattatggatgttgacttatgcacaacatggagtcaatcttgaaaaaattttttaagaataagacttggccaggcgcagtggttcacgcctgtaatcctaacacttcgggacgctgaggcgggtgaatcacctgaggtcaggagttttagaccagcttggccaacatggtgaaaccccgtctctactaaaaaatactaaaattagctgggtatggtggcatgtgcctgtagtcccagctactcaggaggctgaggctggagaatcgcttgatcccaggaggtggaggttgcagtgagccaagatcacaccactgcactccagcctgggtaaaagagcagagcgagactccatctcaaaaaaaaaaaaaaaaaaagaataagaaaacttaccccactttttaaaaactgttggatatgtctcttaaatatagcatattttatgttctcatatgtaaatgatcaaacctttaagagagtacagtatcctgttgaagacgttcagtaataggtaacaatactcaaaatattgtggaagaaagaatgtattaaggaaaatccgtgttatttcctgcattatttcttgttctctaaagaaaagtatatatatgaataatattttgtttgaacttttgggctataaaagcagtttattttgaaagcatcagcataagataatatcaagcagtttgcaaggaaagtgaaaccttatgtgggtgggcaagtacttccttacacttagctggctaatgtggttttcattaacaatcagtgggctaatgattttttttttattttgtctctcagtacactttttaattaacatgacaataaaagctacatttagtgttctttattacttaacaagtaaagatcaacagagtaatacaaggctgaattcactattggaatgttactgagagaagaatcactgcagaatggttaatatatgggaccacatactgtgtgtttttaaagagctcaaattagttgcctaaaatatactgatttttctgctactacagtttacattgtgtttatatttagaatattgaggcttttgctctggaatgttttgcatagtaacttatttttgctcagtaatttaatactgaatgattgttgttttgatgaacttcgcaggcttccaaaatctttagagaagcatgaaaaagatttgtactttctgaccaacaagattgcagagtcgctaggtggaagtggatatagtgttgagagattgtcagttccgtatgtaccacaagtaacaggtaagaggaggataattagaactttcactctggtgattgcttatgttatagtaaatttttcattacccagttaacaatgaaaattaattctggtgtgtgtccttactatagcccagccattttcaaatgcttaagagtatttacttctgttttttaattttgctattgaaaaccttcagtaaatctctaacgacatagatatgattttaccaggagcaaatcaagtccttgaatatttattgttacaatacttaatattttatttaatagtatattttaaagtgagatcttttctcattaaatgatattctatttaagttatggaaattgatgaaaattgtttaatgataagtgattatttaggttaatgaattaggcaactttcgttatttgaaagagtacagacttgttatataaataaaactacaaactttttgagttaggaatttttttttctctgtgaactatatattttctctgtgaactatatattttcccattgcttgaaataattctgtttgaaggcaaaattgcatagtgtcttgtattcaacttttactgtaaaaattaaaatcaaagaatttatgtcttatgctttcattttaatttggtgactatataaatattaaattttgtaagtgaattagttctttggggatacctctgttctacaagagaaccatttgatttcacttagaaagatttctggattagtcactacaagtagtgcagtctttgtaaatggcttttttttaataacatggatccaaaatatatacatttagtacagtaatagttgttcataacagtctgagatgttaatgagtgcttttgcattttcttttaaattttatgctttaaaagattgtgttcctcaggaactccttgaggaaataaaagtgctaagaacaaaagattattagagctttataatttaaaatattaaaaaaacatttaaaatattttactcttataatttgaatttagctctctttccttcaagcaaaaaacctcttaaacccaggcacaagcacaaaggtaaatccagttgtcagtttggcctgccttttcccttacctgtcctctaggaaaatagcttaataaaatgtgccttttagaaaatggggccagtggcctgcatattttctataattagtttaattattattttcctttatcttccttatagccctagtttatttttacccctgttatttctttttaccctgttcctttaactcttaacaatttttaatgaaagctctggtactttcaaaatttttaacaaatggtctgcacttccctgattcctcccatccctaaaaaagatgtattctctcataatgcatctctaccaatgactagaagaattctgaatattttagtgtctacttaattgtataactgcactactagaaatcctactagatttttctgatttgtgaagactgatagtttagaacctatctgtggcattagtatcctaccttaatgcagaaacagaataaacagtgatattttatgggatactgaatctgtaattaaatttccttttgctgtgtaaccatcagatattcatttaaaaaattcaagggatttaagaacaatgtattaaaataaaaagcagaacatatttagtttgttgtgtgtcatgtagtacccatcatcatcacaatagtagctaccatttattatgcactgtgtgctaggcactgtgataagtgcttagtattcattttcttatgtaattctcataatggtttggtgaggaagatagcattatctttgtttacaaatgagtatagtgaggctaaaattgaattaaatgattaggtgacaccactaacagcctctccagttagttgcttaataaattatttgatttcactatttttcagggactcaaatattgttcaggcatccagaaagatccagattgatttttatcatttctttctctaatttctactgagtgcctacaatgtaatatatatcaagcactgttataactttcaaagggtagaaaggtgttaagatgcaattcttatcctcaaggaatacaatctagtgggaaaagcagatgaatgaatgaaacacagtgataactagatctagagaaagaatgatgatctacctaaagtttattgaactattgatgcctggcatcatcataatgtggttgataaatgttagctgattattgtattttacttatctcttatcaacctagaattcgaatgaatagtgtatgtttaggcctgtgccaagtactgctttgtgaggggaaaacagtagtgtcccccatctgaatcgttcagaggtaccagtggcttcagtcaactcatacagttatttaagtattaagcgagcacctccagtgtgccagctgctgtgcaagcaaaagccagaatgaacaagacgggtaggtccctactttcacaaagctcacagtctctcttaaatgtattgttcacttgaaccacaaaacacagcagctgatttggtattattctaggtgcataggaaataagttaatttcattatataatttttctctaagaagataaataaccaggcaattgtaatatgactattcagctattattagggacatttagggtcctccaatagcacatacaaatatttaatccaggtttggctggccagggatatcttccagaggaaaaagcctctaagatgagcttgaaacaggtgttaggcaagtaaactgtgcttcatatggtagtaacacatgtgtgaaggaatgaggtaggcaagaacaggatttgttccgtgaattaatatagagtaacaacagacttcagggagtggagttaggaattgtaaagcaaggtgaactagtttgaactctgttctgaaggcaatggggaagcatgagtgattttaatcagaggataacatgatcagagttgcattttagaagtagtactttggttgtaattttgcaaactggagatggggtgactatttattttgatggcatgttagtcatccttaggagaaatgacagtggcccataataaagaggcatcagtgaggatacagagtaggtagattctagaaaaatttatgagagagaatttataggcatttgattggtatggagagacaagaagaaagccagggattttgtccaggattctggcttgggcacttgagtgaatggtgtaaaactgaggggacgcataggatttacttaccatttcatttgcttgtttttttgtgtgtgttttgtttttctgggagggatgacagatatagctggtgtattagtccattttcacactgctgatagagacataccagagactgggcaatttacaaaagaaagaggtttaattagacttacagttccacgtggctggggaaggtctcacaatcatcatggcagagggtgaaagacaattcttacatggcagtggcaagaaagaatgaggaagaagcaaaagcagaaacccctgataaaccgatcagatctcatgagacttattcactatcacgagactaatgtgggaaagaccaaccctcatgattcagttacctaccactgtgtccctcccacaacaggtgggaattcttcagatgcaattcaagttgagacttgggtggggacacagccaaaccatatcagctgcgttcaagtgaagaaggaaagaagtacatatttcagctgaaactctctataagtagttttgaatctgtggtggtagaaggatagagtttttattaatagaaatgaataggaaaaagtggctggttttggagataaacctcttgttgagtatctttgacagtggaacatgcaagtaaagtagcttgtaggcagttaggagataggactgggttttgtgtgagggttaggaggttataatgaaaattttaaaaacagcaacataggggattttgctaaagccttcagggaggatgacttctcacagtgaaggcatggagagaaagaggatggaatggctttagacagttctcttttcctgaggagaggccatgttgggaaggaacgtaaagctccaaagccgaaagtctcaagaaagtgaaaggaaagtaaggtaatgttggaatgtgggtgctaggaagttggggggtgagaaggcaggtagaggagcttccacaaagggaaaggtggcacaaattgctgaagcttcagagaagtagaaaattgattaagaccttcctttggattttcctagaaggtgattattgatcacctttgagacaacactatatttcctttttgttctcaatgattttgccgctcagtgacccctttcctgcccccatacttgtcttttcttttttattattggcttcaacatgactctctttctgcaacccctcagctttcataaattaacccagaaattattttatagcctcctttgagagaagcccttattttcacttccggtgagaccttgaaagttaatttacctagatgctataagcagatcagcaggcatgaccacatactgctttgtggcaattccattgatgtctttatgtccagttatttgtatcaaagcatatgattatgaaggaaaaacaaaaaatacagggtctaggttaactcagcagtagccacatgcaggatataaaatattctcatcctgaaaattcttgcaaaacaatgtgtcctgttttgttgcagttgagtatgtactgattctgtaccttcagccttcatgcagtagaacctggatgacttttgtatgggagatacaaaacccagagtctcactgaattttgtgtatggatatataggtcagacatcagtgtacatgacggtagtacaagggtgaaggatgatggaagggaagttcattaataactggtagtaagtttttgtagctcagaagaaagagggacaagtagaaataattggagtaatatttaacactttaaggaagcgatgtgatgttcagataggccttgaaagataatctctgtagtgaagaggatgacgaagggcaggtaatgacatgattctagaaagcagatatcccacagcgtgcacagaggttagaaaacaggcatctttgagttgaacactagattaattagggaaggttgaagttactgttggtaagatctgatgagagagcctagaatgtccttttaattcacaagcagtttggggggcatggcttgggaagttatgtggttagtgttttaagaagcttagttaacatggtggtgacatacaggtaaaattgtagaaaggtctgtcaataggatggactgagttactggttctcagctaagggtgacttttgcaatcttggggaaatttttagttgtcacaactgggacagagagagatgagataggcctattggcatctagtgcatagaagctaggaatgctgctgaacatcttataatacaagggacagcttcccacaacaagaattatgtggccaaaaatgtccatagtgtcaaggttaagaaaccctagctaggttatgctatagtagcaaacaaccccaagttcttaatggtttgaaacagtaaagatttatttattgctcagactcgctgtacataactatacatcatccacattctggaatccaagctaatggagctaccactgtctggcacattactcatactgtattggccaggacttgttacagaacccctcctaaccacagagaggacagaaattgcaatcctgtcacatccccagaaaggggcaaactgtaatattgactaacagcattagttacaaccatggaaggctgtcttggagtagaggagttgtcagtaagagagaaaccagtttcttgctgattgctgttaattcttcattctttgccccttcaggaaagtaaaatcacagtatatacagaatgggattagaaagatggagcataggctgggcacagtggctcacacctgtaatcctggcactttgggaggccgaggtaggaggattgcttgaagccaagagttgagaccagcttgagaaaaaaaaaaaaataccccatctctgcaaaaagttaaaacaaaaaatttagccagttgattccatgtctttgctgttgtgagcagtgctgcaatgaacataggcgtgtgcaaaccaacacagtaacagaaaaccaaataccacatgttctcacttgtaagtgggagctgaatgatgagaacacacagacacatagaggggaacaatgcacactgggacctgttggagggtggagggtgggagaaaggagagcatccagaaaacaactaatggatactagacttaatatgtgggtgatgaaataatctgtacaacaaacccccatgacacaaatttatgtgtataacaaacctgcgcatgtacccctgaacttaaaagttaaaaaaaattaactgggcacggtggcacatgcctgtagtcctgactactcgggaggctaaaatgggagaatcacgtgagcccaagagtttgaggctgcagtgagctctgatcacaccactgtactccagccagggtgacagagaagagacactgtctcaggaagaaaaaaaaaaaagagagagaaagatgaagtgttgccacatgatacagtaactctgctgttacactgattctagacctgagcttccctactgttttgggggaacattataggtgtgtctgggtactgttctccttagctcttcaggtagctggagagggcctggggcagtctgagcctgcaatatgagcaggcccttccatttatctctgtgtaccatgcatgcattataatttaatgtgtgcagtgaggtagaaaaccttgggaactctgcattaagcagtgggctgcatttgtttaacaattataattaggactgaaaatgatctgttttagaaaactctattggtagtatagaagggagaaacatactagaagacccacttgaaagctatactaagagtttaggtaagaaaagatgaagattttgaacgatgacactcttgaaaataaataggacaatgtggagataaagatggcttatttagagatgcggaattggatttagaacatgtcaaatagaattgattaataagaaactggaaatgttgaactcagaaaaggaggtgccggaatcctgctcagtcacacaagtatttatggagtacttactaggtgccagctgcaaccctaatagtacctgggaactctttgagagagttagaagtcctgggatgtgacctgggtgagtacattctttttaggactgggagtagaacagtagccagcttggcatcattgtcaccctttctgaattctcttctgtatcataaaggaaaaattggaactatgttttttcagaatcagagactgacaatgaaaagcactcagaaaaatttgcaagtagaagaggaaaaactattatctttgaaagacagtgtagcattcaaatgggtggagatcagactagaagcttccagagcttcttgagaattaccatctccatgctgcagactgagactatccgatggctagcctaacttttactcactcagctttccaagggttgaatcagcctctaattctatatgttagaatacacaaagtgacttccttttttcgactgtaatcatgattatttgatattttcctaccatcctgtactttcatcacactttaataatttgtgtgattttattgtatatttttcctgttaaactgtaagctgcacgggatgtgtaatgtctattcagcagactgtccctaacacctaacagggtctctaatcacttcctagatttgttgagtattgaatgctaaagtagaaaaacagaagtagaaaagaaggtatgtaaggacattatgatcaacaaattcaaatgttcatgaagtggttaagcagaaaatgggctaggaatagcttttgaatttagtgatttggaagaccgtggaattttatttaaaagcgctgtcagaagagtggttggggttgggattataattacaggacttcagcatagtcagtagtgaaaaatcagagcaatttgttcagactgtacaaatgaattgggggcacaaaagtagattagctagagcactcaggtaaagacaacatctttctggagaagtggtcaaattataaagcaaaataacaacagctgatggagatgactgaatggacaatgctggaggagatattaattgaaacagcaaattctttcagcccacaaattgtaatgcactgtaaacacctttagacattgcttcccaaactgtcatcctagaaccagagttagctgacagctttcactgtttcgtgaaaatattagagatataagggcaatattgtcagttttcatttaggctaaatgtattaagtttagattatgtacttccttcatttgctgttacattgacttgctttttttaattaaactatttggtagtggttgttgatgttgctgtcctaaatgcccctttttgaaaaataaaaatccgataaccttatttcagttcacctcatcaattttactttttaatctgcttcacgaaatgtaaaagtccgagaacacgctgcttttatgtatttagaaggaacaaaaaagacaaactgtctgaattttttgacagtttttgaaatctgaaataagtagagtttataaatgaaaaccaacataacatttctagcaaataatgggaagaaaacaattttattttagatgaagatcgactttctagaagaaaaagcattgtggacaccgtatccattcaggtggatattttatccaacaatgttccttctgatgatgtggtaagttactgaaagtttatggtagagtactgtcttggtagacatcatttaaaagaattttttgccttccacactttcgaacaggaggaaatacaactctaaattatcctcaaatcaactaaattattagtagaaattaatctgatttagctttgaatttatttataatttattttactgaactcatttcagctgtctgtaaagatatataaacctaacattatatgttatgatgtcagatttcacattataatttagtgtaataaaaggaactgtaaagtataagatttttttgctaagaaactttatacaaagcctgtcattaaattagtgggccctctaggtcctacttatttttaaaaatttaggaaatgcaaattacagaaataaatagaactatacatcctcatgtgaagccaaatgctgactacctttgaaaagttttaaaactgcatctataagggaaaatgttttaattattttggatagtaaggatgttgtttaagctgtgtcagtgaactatgtactctgtaaggactgtggcttatttaaaacatcatagatttcatgctctcctcccgtttcaaaaaagcacaagagtgtaccctcctgacttataggggaaaaagcagccagtattctctaggacttattctacacaaatcaccagagaattttttcatagtcaagtaaaaatgccaaaatgccagcatgtcaagtcaacctccaccttgtggtttatccattgtttgccttcctaagtattttattatttctcattggtacaatatgcataattaaaagaatatccatatagggaaagggaaaggaagttagctgaattatgctttctcaagcctccctcctacccccttacaattcctattgatttatttgtcttcaggtactaaacctatttggtggccagagtacagccaactgacttatgttttctatgccattcaacttcccattacatagaagttatgttttattaagaacttatcagcacggcatcaagagtagttgaagaagcacttagtgttcattttgaaactcaacgcattaagtctaaagtttcttaccagtttaaggcttaataacaacttttcccaaattcacctctttcttcagagctatttaatttatacactccttaccagtaagaagagtatcttgctagttctgtcttttaatgattatgaatttgccactattacctttctagggaagaaattcatccagagtcttagattataaacttaattttgttaaggggacactatgtgttattgactggtattttcacctttctccttttgttaactattcttacttctttcaaaaatatatagagaacacttgaaactgttggaaagagtcagtctattttgataaaatcaactgaaaaaacatttgcataaagactcaatgtaggggaaagattcttgacacaaatcttacattaaaagtctgttaatatttttattaacttttacaagatcctgttgtttttcatttactataagtcctaagtcaaatatgcctcacaccaagcatctgaaaagttaagtacagtttagtgtcacatttgcttgagcacatttgagtttcagattcatttaccattgtggaatctgcttttggatattagagatgtttgttcaaataccagaagacagaataatactatcttctaggctaaaactaattaattactttcatataatggacaggagaaattcacatcagatagatattttaccagttaatggtgcagcagaatatcaaactattttcttaaaatgaatcagataagaacattgctcataaaaaataacttttttgtttgatcaaaattatttatagttttatatgtataatcctagtttatcctgagatgtatttgcttttgctttttaaacttataatttaaaaaaaaagagagagagtcagaaggttgtttagatggagaccataacaaacttctgtttccctaaactcaaattgttactctagtctattgaaatacctgatccacttgagatctgccagttctgacatttgcaattccaaccttggcctactgagaatcatttggtgaactttttctaaaagttgccatatataaaaagatgtatattattatttcttctaaataatgcattatttcttctaaaaatgtgctgatgccataaaatgtattattgatatttttatcataaagcagttgattttataccttttacatatctcaaagcaagagggagatttgagagactcaaggtaaaaggtatttttagagagtataaattggtggttgactttagacgaatgcttcccaatgcatatatatgcacactacacatatatatgcatatatgtgtgtatacacacacatttttataacgatacctaatttaaattaacgtattcaagaagataaatgactaaaatagaacagaggcatctctgtctcctgagataaaattatcagcttgactaatagaataaagcactataggcatgattttttgcttccttatatatgcataactgatatgagtaaaacctgaaatcaccacactactcttctctctaaaagcttatagtaagtgcttgattatttaagggcatgggcaggatgttatatatattaaattttgagtatatgttaaattttttgatataaaattaagtcactggttgactgtaaaagattgttgttttttctattacaaataacagatctttgttttatatccatctactcctgccttttttccccaaatgcaactggagaaacttgtgtgtatgctagcatctagtcaatattagtcacactctgtggtgctagatgctatcaaattactatattagtagtagtgacatagcaactactataattagaaaaagatgaatggcagattttatgtaggcccaagggcattatatagtctaggttagtgttgtagatcatagataaagcaaaagtcatagattataaagggaatgttgaaattcctttaggatggtgcctttgcaccacttctctataactccaacataaccagttttccctctatagagttggaacagattatagtttagtagctcaccaaataaagtacgtagcttgtatttaccagctatggtatataaaaatatgaatcattaaatgctagtataaagcagttagtcttaaaaaaaaaaaaagatccacaaaagggatgagtgggagataagattgaagcaaaattatagaaagttgtataccaggctgagggctttctgtgtcacttcacaggaagtaggtaaacaccgaaatttagtcagtgtcattattagagttgtgctttcataaaaagaatctctcaagtgtgacaaggctaaattagaaagaagagactggaggtagaggccagttaggagatccttgtaataatccacagttgatggaatgaggatctagagtagccaggctggaggtaacaaagagggacaggagggcaggagtactctactttaaagtagaatgaataggaccaacaaatgacttaaagggatttaaagaaaggagacattaaaaaaaagaaaaaatgtagacactgatggcatgacttaggggttctttttttgtttgttttttgagacggagtcttgttctgtcacccaggctggagtgcagtggcgcgatttcggctcactgcaagctccgcctcccgggttcacgccattctcctgcctcagcctcctgagtagctgggactacaggcgcctgccaccatgcccagctaattttttgtatttttagtagagacggggtttcaccatgtttgccaggatggtctcgatctcctgacctcatgatccacccgcctccgcctcccaaagtgctgggattacaggcgtgagccactgtgcctggccgacttgggggttcttgatgctaggaagctgcatcataattatctgaattaaggcaaacagggacaaaaagtgaagagttagtagggtaaggtattttagctctttacttacctgagattgacaggtgataagtaaaaattatatgtatcaagaatgctggccttctaacttctcccatgttctttttcctctactgtagttgtgtctcaaaagtcagaagctcctagccagttctaagaacaaaagcaatttctttttttcactgaagtactagaatgcttataagtacaaataattgaccagccagagcctaatcttacatgtctgctccgaatatctagaacaaaacaacagaagattcccaagtttaatctgacttcaactagaactatgaagctcagtagcaaaactgagggagtggaactcttgctgcttgatttccagctaaagcctttgtattgcagagaagctaaggtgcagagaatgacgtcttttgctttcattagtcttgctgccttagacttagcaaaagaagctcatgagctaaaattagggatgaccagattcccaggcaagtactcatgtatcgtttcttaatttttattcagagatactataggaactggatatattatttatcctaagaatgtgctgatgccataaaatgtattactgacttttatcataaagcggttgatttcatacctttttatgtatctcaaagcaagagagacttgaaagacataagttaaaaggatagtttcagagattataaattggtggttaactttagagaaatacttcccaaagtagtggttctaacttttaaatcatttaaaatcttagttttccttttgatttgtaaactgtgtgtggtaccaaaatcatagaggctgtaaagtacttagttgttttttatcacatggctaaaaatgtatttatgtataatctcagccttcactctctcagagcattgtttacttacaacacagtgttcagtcagtgggactcaaatcttcttgtacatcacagtactgggactgagttctgtaattcaagggtggttttgttgcctagggtatgttaattattgcagtctaatgctaatctatagacttgttttggggaaccactgcagtaagccattgttagaaccaatgaaaaagtggagattatttggtactgtggagtataatcacagctcacagctcagacccaacacaaagaagaaaacaaatctgaaaaacttcttagatgacttgtaactaggtaaaggtgttatttatattgaccctttttaactctcgatttcacttatcacttttctctaggttagtaacactgaagaaatcacttttgaagcattgaagaaagcaattggtgagatattttgcacttgttagtactaccaatatttaacttatctttatctgctgcttttttcgatgacagaatacgtagaggggacattacaaaaataaaccaaagaaacttgttggcttctatagacatgtatcatttatttagctacatgttttaggcttcagaattgtcttgtcccttcagggtcatattcctgaacaaacagacacaattatggcagtgatataaaagaagacatttattaatttactttctcacaaactttggccagaccatacgtcatcataagaccaagaaaattcctttccaaattgtggtaaataaatggaaaaggctacaacaacatggttccaaatgaccccattcttatttcagttattccactcagtaccaagattcaatttagcaaatattttatgtagtacctcgtatgtgcaagaacgtagttgtataaaagaatcatccttcaggaaggactgtgaagtagttcgacttgtaggaagctcccattcccttgccattttttggtaagagagacaaaggcattctgtgaaagagaatcttgtgatgtgtagttttaacccttagatttttttgggtttttgtgtgtgtgtgctttctagccttaaacaagacatttcatggatgttaggcctttttatttttttcttatagaagccctgtaaattgcccttaattttggatgatatatcattaactcttaacggtcattgactgggttctgtgaaattatgtattccctttaataagtctttataaatatttgtatagataccagtggaatggaagaacaggaaaaggaaaagaggcgtcttgtgatagagaaatttcagaaagcaccttttgaagaaatagcagcacagtgtgaatccaaagtaagtgaagaaacggtgaagggcttgtgggtggactgttgttttgtggaaactcttccttggtgattagttgataagttccaagctttagtcaaatcaacggaacacaggaaaatatatcagataaggactgaaactctgaaggcatatctatgagacctaaataatttctttgtatgatgtaagctgatggaaatagtggaactgttttcccaaattaagtattagtgattgttattgttttgatagttttttgcagtggttttccatgattttgctgcaggtattttgttttatgtgtttgttgatatgtttttaacattgagacgaggaaagggaaaaaaagacaacccttacattaaattctaatagataagacagatcaaaccaaaactttaaagcattgtgtacttaataattaatcagcttaatagtcacaattatactttgtctcttaagttacattgatattattatatatagatacctagaaaataaaccattcttaacatttttttcttttttgcaggcaaatttgcttcatgatagacttgcccaaatattggaactcaccatacggtaagggttttgttatcacaatagcaataacacacacacacgaatagaaactgacagacccctatgaatttgtggttcattatgtttaagttatcatgttaaagtaatgcttttcatttaggattaacataagatcatataggtgatcctttgcttaatagtgattctgttttttaggcagagtctgataccctttcttgactagttgtcctctagctttttagcttcttttttagattattcattccttcctgatgatctcttaagtacatctgggtaatttaaaaaagacccatattctaatattatgcttaattaggaaattgctcatattgaatcgttttgtcctgcagaaactgcattttaatatgtcagcctcatggttcttttcagggcagtaataagtctacttatgcagatagctcatttgaattattgaactttcctttagtttttgtacatcatattcatttgagttctgttgtgaattattatgctctttgattatcctatgtctatacattaataagaaatgtagcacctgaaggaaggagaggcaaactctaggttccatctaaagaaggaacttccacatagtcttacattgacttcagtgtggaaacctgcctttgtgagaggtggccagtagagatgtctatgcttctggaaattttttctatatctggcatatctttcatatttttaacttgattaattaagtctgtttttcttcaaccctgtattatattaatattagagacaggtaaatgctctaggccacttgcttttttgtttcagtcttttttctgctttcataagcaaggcacatttttgtcattatatatcttactctagacatttccctcccattcctgctatactctcttaagttgagaatcactcatttacaaaatttaagaacagaaaatcagactaaaatattcaatatgtgctagacaaggggtccccaaccctcagtccagagacctgtactggcccatggcctattaggaaccaggctccacagcaggaggtgagcagtgggcaagtgaacattattgtctgagctccgcttcctgtcagatcagcgcggcattagattctcataggagcaggaaccctattgtgaactgctcatgcaagggatctaggttgcatgcgccttatgggaatctaatgcctgatgatctgaggtggatcaatttcatcctgaaatcatccccccagtccccatccttggaaaaactgtcttccacaaaactggtccctggtgccaaaaaggtcggcgactgttgtgctagacttaggattcaattaaaattgctgggtgtgggcatttacttctttgatgactaaatgtcaaacatttaatagtaaatgtctactgtgtacttgatcttatgctacatggtttatatctattatttctgctaatcctcaccatagccctgaaaggtaggtagacactatttttttgatttttcaggtgaagacaccaaggcttagagaaaagtaaaataatttgctgaagggcatacagctaatgagtggcaaagtcaaaattcaaatccataactgatgttcttaaaaggaatgttgctagagatcaccatatcacatttagtcaaactaacataactatatgaatttaatattttagaataagtattataactaattctgtttcattggtaccacaactactactaatacttacattcattgaacagttactactaataattaacatttttaaacacctatgttgttctaagcactgtgctaaatgtattattttatttaatatctgcaacagactctaacaaacagatagtgattattctcattttacatgtttgtaaacagacatacatggaagttaggtaacttatacagggtcacctatttaggaagcagtagctctggaatagcttatggagaaactaaatagactttatagaaatgtgtcttcagagttttcaggtcctgtctggtacattttctcttgttaatttgcctcaccctaaccatcagacagtggaaagagtttgtatcctccataaaagaaacagaacaacacaatattatacttcgctcccactgttctttcatttacattttaaccatacctgagtatggttaaaaaaaaaaacaagaaaggcaaagaagcagtaaaatacagtgagaataagcagcctcacagataacccagttattggaattagtagaaaaggcccttagaacaccacacacccacaccccccacccaggccccacacacacacgtcaaagaatttaaaggacaagatacatatagtttggagagaaatgtgtgtgacattgcttattctcacgatcgtctcctgtttctttgcattataattgcaaattttaatgttcctctcataagagtactaaaacataactaacaagaagacaaaaatgcagaaaggatataagatttgaaccatttcagtcaatttaagtggcctttagaaaacacaatgctaggcaaatacagaatatagattcttttgaagtgcacatacaacattcacaaaatagacagatgtgggactatagcaagtgtaagtaaatgtcaggaaactgacatgttaagacatcatattgagtatgttctcttgccacaaaaaaaagtataatgcattaacacatatctagaaaaatttcaaatatctggaaattaaaagacacccatacctcaaagaagaaatgacaggacgaattagaaaacattttaaactgaaaatacctatcaaagttttgtaagatgaaactaaaatcgtgctcaggagcaattttatatctttagatgcttttgcttgcaaagaagagagatctgaaagcagtgaattaatgacttttggtgagacattagagaaagaagaacaacataagctaaactaagtatatcagaagtcaatgaaacagaaaataggcaaacaatagaaaatattaacaaacctaaaagtttgttctttgaaatggttgataaaattggtaaacctctggtcagtgttaaggaagaaaaagagagaaaacacagattaccaatattacaaataaaaaagaattatagataataaaggaatgttatacacaattttatgacaataaattcaacactttagatgaaatgagcaaaaattattgaaagtcaaaactaactaaaattgacacaaaaagtagtaaaacatccaaataaccctataactgttgaaatagatttgcagtttaaaagcatcctacaagaaaatgcatttaacttcactgcttacttttatcatacatttaggtaagaaataataccagtttcatacatattcaggaaacaaaggaggtagaaacattttctaactcatgaggccagtataacttcaacacttaaatgagacaaggatattttaagaaaaatgaaattatagacaagtacccctcctgaatatagtcacagaaatctttatcaaaatgttagcaaatgtataaaactgatgatatggcctaaataaatggggttactatgaggaaagcaagatcagttttacattagaaaattgatcagtcagcaaaattcaccacattaacatagtaagaaagcaaagttgcatgatcacaccagtaggaaaaaaagcatttgaaaaagctcaatgttcatttaagacaaaaattatcagaaaatttggaatagaagggaacttaatctgataaagagtaattataaaaaaatctattgctgatgttatgtataatggtgaaagtctgatgcctttcacctaaaactgggtcaaggatgtctactctcaccatgtcaacattgtattgaaagtcttaggtaagtaaagtgaaaaaaggaaaaatataaagatgagaaaggaagaaataaaactatcttttcacagatgacatggttgtgtatgtggaaaatcgtaagtaatcaagaaaaaaaaccctactagagttaatacatgaattaaatgaattttagtaaggtcacaggattcagggtattcaaggtcagtattcaaaattcagttgtatatctatatattaacaacaaacaattgcaagagtaaatttttaaacatagcattaaaaaaattagccataatttaacagtatgtaagatttctgttatgaatataaaacatgaatgagagaaattaacacctaaacaaaggagagatataccatgttcatggactgaaggattaaatattgtttatatgctgtttctttcaagttgatctgtagcttcaataaaatcccaatcaaaaccccaacagacttttttgtaaaaacgtataaattgattttaaaattcagatgaaagtacaaaggacctggagtagctaaacagttttgaaaaggaaaaataaagttgaagaatttacactgcctaatttcaatacttgatttataaagccagagtagtcaagacattattggtataagagtacacaaagagatcaagataacagaatggagagtcctatcaaaaacttaagtgatttttgataaaggaatcaaaacaatttaatgaggaaaagaaaatattttcaacaaatgtcctggaacaactagataagctaaaagaaaaatactaatctcaatccctaccttccaccaaacacaaacattaattattaagttgggtaatcaatgtctatgtaaaagctaaaatcaaaatttctaaaagaaaacataggaaagagtcctctcagtcttaaaatgagcaaaaagatttcttaggacacacaaagtactaaacaaaattggtaaattggtcttcatccaaattaaaaacttaccattaaaagactccagtaagaaaatgaaaaggcagaccacaaactcagaaaatacagtatacacaataccaatatctgataaagaacccctacaactgaaaaataaaaagacaattttcagtggccaagacagtagttgttttacaaaaggaatgtttgaatcgccaataagcatgtgtaaaagtgtttaaaatcattcgttaacaaggaaatgcaaatttaagataccattttgtgcccaataaaatgagagaattgaatatattcacagaaagatatatgtgaatgtttatgacagttttattcatagttgccaaatgtccattagcacgagaacagacaaatggtgataatataatgaaatactattcagcaataaaaaggaacacaatttttggggtaaatctgaaaaacatattaagtaacagaaatcagacataaaagaagacagtttgttggactgttcatagagcctgtatagaccatttacgtgaagtttaagaacaagcaccactaatcttcagtgatggagatcagaacatagttgttgcatgtggatgtatgtgtatgggtatgtcagagtggggagaaattgactggttagggacatgaaacattttgggggtgattgaaagtgttcagtatctcttgaacccaggaggtggaggttacagtgagccaagatcacacaattgcactccagcctgggtgacaagagtaaaactccatctcaaaaaaaaaaaaaaaaaaaaaaaaaaaagaaagtgttcattatctctattgggctgtgatttacatgggtgtgatttacatgagtgtatacatttgtcaatttttgtcaaacagtacccttaagatcagtttatttcattctgtgaaaattatcccttaataaaaaatttaagtgtattgtaaatactggaacaattgcaaaattgttagttaccaaaaatagatataccaggaaaatataagaaaaccaactgaataacttaacaattgaggacagtttgcagttaaaaataattatatgaaattaatatctgtgcatttattaattaaaatgaaaacactcttaaccatgagctaataaattcaaagaagtatataagacttacatgaagaaactatatatctctgaaatatgcttaagaatatttatataaatggaaacatcttattcttgaataggaagttaacatagatgtcagttttctgtagattaagctatcattttagtaagataattttttttaagtatttgaacaaatgatgctaaggtcaatgtgaaagaatccacatgcaagagcagtcaggaaaatgctgtagaaagaaacaagggagtatttgccttgcttggtagaaaaacatatgacagatctttggtacttacaccagattggacctgcatatgggtaagtggaagagaggaaaattcaagtatagaaggtatctgtggtaaagataagatttcagattttcaaagaaaagggcaactgttgagttgatctcatttggacaactgctgaacactactgaccagcgaggaagggtcgggggaagttttccacttcacttcttttgccaaggtagacagcttcactcattgtttagaaaaatacataaaaacactagaattaatacaggagtatttcttgtaatcttgatgtagagggaaagtttttcttagcataactaaaaaactaaaaattataaggaaataattgattttttttggtaaggcttttaagcatttggcaacaaaaaaagttgagaattaaataatgaattggaggaaagcatctgtatcatatgacaaaaggttagtttcccaaattgataagagaaaaatatctgagtaggattagaggcagtggacttaaataggcagtttacattttcaaagaaatgtaaaatggatactacaaagatacttaccattaatagtaacatagaatttaaaaatgaaaataagaatgaattatctcctacctctcagattggcaaagctgttttaaaaagactgactatatctaatatttgtaacagtgtaaaaggcacagtgaaatgctgaaagtgtaaattgctggtattccggcaatatgtatgtaccaaagtcaacattttgagtacactttgatgcagaaattctacttgtaagactataaaccaaggtgacaatcagtcggaataaaattatgtatgtataagaacagactttttaacattatttatcatgatgaaaaaatgaaaatgaacctgcatttgttctctggattaaatcaagtatgagatatatatatatatatatatatatatatatatatatatatataatgaaataccattctgtcatcaaaaaagataatatctgtatacatgaaataattttttactaatgaaacaaagctcacaagaatgggtagagtataatcgcatttaaaattgtatatacatattttccaaggaaaatgtctgctttagacttaaaaacagtttgacactactgcagtctgtttcccatgcagccttgtagctggccagtaactacaatggcattgatcactgcaattaaggagtctgactttgatattcgcagatagtagatagaatactcggtgaaatgaacagcttgtaagtacacctgctgacaatgtatttttgttcttttatagtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgt

SEQ ID NO: 37636 - DNA, 109402 bp, Homo sapiens; identical to SEQ ID NO: 37635

SEQ ID NO: 37637 - DNA, 290518 bp, Homo sapiens; identical to SEQ ID NO: 37634

SEQ ID NO: 37638 - DNA, 118156 bp, Homo sapiens
agtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaagcttgagcaccccagatttcgtctgcagcctcagtgccctctggggtctcagggagtgcggctgtttctggcccttctggttccccacgtcctctccctttgccatttaataacgtgtcaatttctaattaattgaatggtcttttcaaagacaaattatatcatcttaaggtcttttaggtagttttatgagtttgagtctccctcccccccttttttgtgctgaggctaatttaggactgggaaacctctttggcatcgagcggcagatggacatttttaatcagtgtgggagcctctgtgtgtgctagcagatccccatacgttctttgtggttggagagcatgtagaattggaaactgtacagactacatgagtattttgggtgctcaggttgtaaaatagaactcccagccttatcagtgtttccctttggcaaatgatggtttaatccgttggtattagttatctcccagccagttaggatgaactttggctctttgtacaccaaaaggcagcagttctcttgtttatttcagatgagcgttgttgctcctcttgttgcaaaacagggcaaagggacttcatctaataaatttcaagagcctgcctaaaaaactgcacatggttaaggaggccctttttttttgctgagtcttattcatggatttgctaggaaatgttactgttttgggattctggagaaagaatgtttctgtcttctgctcctctgggtttttgcataaatctaccagtgctccttaaggaagttttttggccgaactatatacctgtcctccccggtgacagctttcccctgaactgtgtatctttggggttctaatatttctcaatttgaaccagaactggatgctttccgagtgaactgcttcattgtgatagacactgttttcagtaattggaaaatcatccaaaaagggtgattagatatttataaaatgtcaacttagagactagcagagaatctttgttaggcagtgagtcagtctttctaaatagaagctgtttcaaggcccagaatggctaacagtccatttaaattacttttcagtctccgtttgtttcatgtatagcagcaaaaatataaatgaagtcaaaagactgaatttaaaaaaaaattagcaattacagaatattatttccaggactttgcattttaatttgaaaactgcaactgtttcctgggatttagaagtagtgatttgggtttaaagtctccctttaaaggaagaaaggaaaactgcctacagttagtgaattcttaagttttatacttagctctgggggtaaaaaagaggttctcaggaactaaggctcaaaactgcctatgaaaaggaactggtagctgttcctttatggatcctggaggcagctgggaaagcctgttcctagtgatccattcatactttccactggcaggttaggactttggctgcggagcaccaggcaaggggaaaatctgactgagtgtggcagtagtgatatgctgctggttttctgtccattttgtacatgactgtttatctttagaaataatatattgcagactgctataaacacataatttgaactggaaatatgtttaagaaaaggaagtgttttgaactagaggaattttataaacattcttagatgtctgtaaattaaaagaaactgtcaagtcatttgggcccatgcattatctctcggtgtattatgaaaggcaggctctggaaagtttgcattagaagggtaactaaaatcgaaatcatgtaactttgcagttctttagaaaatatagtttggctgttttatgagtgaaacaaattgcttttgctagggaattttataaaaacaagggctctttctctcttagttgggtattagcagaaggaggatgtcatttaagaaggaaagatcttgaaagatcaggcttgcagaaaatggatgtctgagaagcaatttgagcatgcccttcagcttctgcttttaggacctgatatgtctagttttgatggtaaccacccttcgaggggtagcctaccctgtgtaatatgatcacttaaatggcgccttggataatcattagtttggaaaggatttcaaaaggtgaactggtttgttccctgggtggaactagttttcaagtctccaaaagcccccagagacctgactggccagctagaggtggcttggagtctccttaggttggcaaggcccctgaagctgacccagtcacacagagccccaccagccctgtcattaaggtttatagcaagtccagtcaagccactgtgctgttggcatacctgctggtggggatccagttgtcctgtgaggaatgccatctgggtttagattctcactagattgtccttcttccattgccaaaaatcaaactaaaagattttgcccatccttttcttcttcccaaggcagaagggtgcattgcagaatctccaaaccactgaattcttttcgtggactagaggccaaaataaagtcttagagaaaagccagaagtaatgaagaagaatctttgctaaaaccaatctactcttatttaacttttttagtcaactgtgacagtactatcattttcattctaatcatttggatttaaatcttgaagaagccctggactcattcatctttgttggtttccacgtccagtctgcctctaagtccagctgtgcattcattctgcagatatttatttcatacctactaggtgcttgaggtaaagcagtgagcaaaccaggcagatatccccctgccttcttggagcttgcattctagtgatctttccgttcattttttcatgccttcagtggccagcgtggaacttcctcaggagtgccaaccggccccagaatgccctggcccatgggaacctgcacttaaagatgcagcaccaacaggtgtttacccagctcctgacctgagctcagcactgcaaagaagtcggggtttggaaatgtggtcccttcctgcagcgctaatcttttttttttttcctcttgagatggagtctcactctgtcacccaggctggagtacaatggcactctgcaaccaccacctcactgcagccacctcactgcaaccaccacctcccaggttcaagcgattctcctgcctcagcctcccgagtagctgggactacaggcacatgccactgcacctggctaaattttgtatttttagtagggatggggtttcaacgtgttggccaggctggtctccaactcctgacctcagctgatccaccgcctcggccacccaaagtgctgggattatagacgtgagccactatgcctggccattggtctcttcctgcagcactaatcttgatgggacagaaaatttcaaatgaagagctttccctctttttttcttccttgggggcatgccagcttgtgcttctatgtcagtagccttgtagttgccattcctggcccagacacttgcatgcagtttggtttgtcctccaccactttgatcatgttgcccatggtctagacacctccgtgtccttgttatcatggcatatagtctgtatgcctctgctggatttataagcggccccataatagccttcctttctggttacccccttgatcactttccaccacatctcccagccctggcccattgatatcactatcatgaacactccctggacattgctactttttcagtgtttctccttttaaatgctattgattaaatgcaagctccaaataccttttcatggctgatccagccctgttgtttttaatccttctgtaaatagcaaggcatactgatgatcagaatcattgaaagtatgtgaaaatacagatttcaggcctcctctcagacttacacaatcagaaacctgaatgggggtgggagtgtgggggaaactgtatttttataaagcgactgagatgattctaatgaatcagactaatttgggaatcgctggtctagatcacagcattaccccttaattatgtgctattctatgttactactagagttttcagcagtagctgggcttagaatacaaagggcttgggcttgggaggtggacaagtctgggttcagatgctggtaccttgccacttaatgtgtcagaacttggacagtatattaaagctctgagtcacttaaaaaagtgtgtgtgtgtaaattggacctaagaatgcctttataacatgactgttgtgaagatgaaatgaagggagcatatgaatggtgcttgaggcacggaagataggacatttttttttcttcctttcctctcttggcctttttttttttggcaatgaaatgaatgaaatgagggagccatgtcagatgttcttacctctctgacattctaaataggtgaattttctctcccatcaaggttagtgctataggaagaaaccatgtttccaaatctcctactcctgtgcagtgctgagctgggtaaacatctgttgacactgcatgctgaagtgcagatacccgtgggcctggacattttggggttggttggcactcctgaagaagtttcacgctggccactgaaggcattatggttcagggtcaactgaatacaccagcccccagtggacctgggctagttgtccagttttgatgcctctgcactcagtgtcatcagcattgcagggttggtgtcaagaataaagaagacattgatgtaacgtcttgacacatcagctgtgcacagtcacacctcctcctcttccctgaggctgtgctgagattccagcacatgggaaggagagagttagaatttagtctgtatcatgcgttggtatgccgttggtcatttagaatgaggtggcaggggtagtgagtatattttggggatctgggggcagaaaagggattatttttattttttaagtgtggaaatgtggcctggcgcgatatctcatgcctgtaatcccagcactttgggaggccgaggtgggccaatcacctgaggtcaggaattcgagaccagcctggccaacatggtgaaaccccgtctctactaaaaatataaaaattagccgggcgtggtgatgggcacctataatcccagctacttgggaggctgaggcaggagaattgcttgaacacaggagacggaggttgcaatgagccgagatcatgccatggcactgcagcctgggcgacagagtgagactccatctcaaaaaaaaaaaaaaaaaaaagagtggaaatgcattaaatttcttcttttagccattgggctttaggtcttactattaaaaatctcaactgcattttgataagtctgtttctaggcagcattagctttagcaacaaggatggaggggtgaatgcctctgaatgggagaggacactgttgaaatagaattgtgaatgtctgtttttctcaagtatctcaaagaattggtaggagtgggagaagagagaagccttgaaatctttggagattttccatttgcatttcacatcagcagagtgaagccaatgagtatgcagctggtggcgtgatagccaatgcatagtcttggaaaaatggaaaaatgttattaaagacatgttttcacagtttttttctctactattcagtctattttgtgaaaaatgtcacaaagactcagtaagtatgctctctacaaagcattttggtgtttttttttatgattacacaggtatattaaatacaagtaaccgtgatgtttaaggagtgtgtgcaattaatagaatttagtctcatggtataagaatgacacacgggacaagatacgcaattattaaaggaaaattttttttaagggaaaagttaaatacgtatttctttttttttttttttttttttttttttttgagacagagtctcactccgtcgcccaggctggagtgcagtggcataaatgaggctcactgcaacctcctccccccgttcaagtgaatctcctgcctcaacctcccgagtagctgggattacagtgcacaccaccacgcctggctattctttttttgtatttttagtagagacgggatttcaccatgttggccaggctggtcttgaactcttgacctcaactgatccgcctgcctcagcctcccaaagtgctgggattgcagacgtgagccactgcaaccagctgagttaagtatgtatttatgtgtaatttgttattaaatataaatacagtagactaaatatacaacattttaagtcaaggcaaaagcaaggttttatacacatgtaattaactgtcttaatccctgtgagacctcagttttctcatctctaaaatgatggagttgaacgagaaaaactctctctccttaatatttactttttctgcactttagggtgtggtaggagaaatgtgaagattaacttaataagtaattattaatcccctgtcaaatacttctaattttattattgaaacatggaatttattcaccttacagaaaggcaagtaatttctaatagctcatggtaacctgttaccttgaactgagtgttcattgtttactaggagtggtatacattgtcctgcgtattcgtgatctaatgtctatttgtattagtctgttctcactctgctaataaagacatacccaagactaggtaatttataaaggaaagatgtttgatggactcacagttccacatggctggggagacctcacaatcatggtggaaggcaaaggagaagcaaaggcacgtcctacatggtggcaggcaagagagcttgtacaggggaactcccatttatgaaaccaccagatcttgtgagacttactaccacaagaaaagtataggggaaaccgcccccatgtttcagttatctccacctggccccgcccttgaaatatggggattattacagttcaaggtgagatttgggtgaacacacagccaaaccatatcactagtatttttttatatattttctgatacaagccagtgtaacataaagaacagctgcgtggtaaaaataactttcattctagatagaagactacatgacttgatatactgggggtctttttaaactataaatctcataaagtgttttagtctcctcatatggtttctggcctggatctccatttccagagtggggcttttaactggtgccttccgtttggtccctctctagagcacttgagcctggtctgagtactgtgcagaccacaagcaagaatctaaatgagcagactatggtagtgttgcctgggtttggatacacttattatgtaaccttgggcaagttttttaaccttctgggctcagttttctcatctgtaaaactgaatatcctaaaataagtttttaggattatgtgagacacaataagtagggactttttagcataagggaatgtccatgcgttgtgtcacatgctagttataattcctggctttctgcttctctgaagaataagggcttggcacacacattagttgggctcatctgataagctctagcccagagggtggctcagcatatgcatgctaaggcctactttttcataacaggggctttcttcttgtcttggggtagactagttctacgctgagatattgggaatatgtttgtagtcagcttttctctaaaagtggatgatgtgagaaaatatgccatttattatttctggctgatgaaaggttccttacagggacaggacaaatccgtgttaagatgtgaaaagctcatctttcccagtaattttacctccacaaatctgtccaaaggaaatcattaccaggtaaatagtatttaatgtctttgttgaagtctcttacttataatagttaaaaaaatggaaacaacccaagtgtacaataatagagtaattgttaaataagattctaatttagacactgaatatcatgtggccattaaagatttatttgaagggtatttataacttagaaactatagtacacaaaaagttagatataaacctatgtatagtgagaccttggttatattttaaaaggtgtgtgtgtgtataaagataatgtatatatacaaatccatacatgtcatagaactgtgtagatacacatacacaaacatacacagcatgaatacaggtaaaactaggaaaatcagaataagattggtagattgtatcaatatcaatatcattgttgtgatgtttactgtagttttataaatgttaccattggcggaaactaggaaggggcacaagagatctttgtattatttcttacactgtgtgtgagtctatagttatctcaacaaaaatttcaatcaaaaaatggcaccagagctagattgttgtttaagtaagttctgctgatccttcagagaaagatatgttataaagctcagagaatgatagaaggctgttctttctcattttaggaggttagcatcactctatgtcaaaaccagacaagaagagcagaaaaaacaaacctataggccaatgtcatctatattagatgtcaaaattttaaatagagtattattaaattgaatacagcagtttattaaaagaataatgatgagcccaattgggatttttccaaggacagtttcaacatcagaaaagcaatgcaggtattaacagtttaagggagataacaatatgatcatctcaacagatgcagaaaaagcatctgaccaaagtacatgtgaaagtattaatataaaggttcccaaattctggttaactgaaggcatattatatttggctagtacatctgtgcttcggactcaattcacttgacatgtttaggaaccaaaaggcctctgtttacaaagttgttaggcaacagtctctagttgcatgagtgacaggtgtgtgacaacccaataaaggatgggccatgacatatatagattctaattcatatggagttgttctagcattgcccaggttcactgtgtactctcccaaattaagaaaatgcaagagatggttttgaatgttttagaatcagataaattggggttcagtttctggtattaccacttaaaagccatgagaagtctcttatcatctccatgcttgtttcttcagtgtgaaactgggattagaatattttgctttttggttattttgaagattagcctcaataatgactaaaatcttctaacacaaagcttgacccatagtaggtgatttaaacctgttggtttctcttttcttccatctttaagttttgtgattctgcagtatattatatgtttatgtataaatatatacgcatatgttttgtgtttctcacttgcatcctgactcttaacactatgggacatatattttcacaaatttagaactggtttttatttttattttgtattttttttgtgtgtgtgagcaacaaggctgtttatttcacctgagtgcaggcaggctgagtccgaaaagagagtcagcgaagggagataggggtggggccgttttataagatttgggtaggtaaaggaaaattacagttaaaggggggctgttctctggcagacaggtgtgggggtcacaaggtgctcagtaggggagcttttgagccaggatgagccaggagaaggaatttcacaagataatgtcatcagttaaagcaggaacaggccattttcacttcttttgtggtggaatgtcatcataaaactggtttatttttagtcacgcaagttatgatgcttaattatattttgtatttcccctgtcacccatatttcctgaataatacttagctaaaacttgcatacaagttggaaatttagttaagactggaaaatctttggtagtacttggattataattaaaatacttaaagaaggtcagcatcggaaccctaattatttttattatttttatttttttttgagacagggtctcgctctgtcgcccaggctggagtgcagtggtgcgatctcggctcactgcagcctctgcctcccaggttcaagccattctcctgcctcagccttctgagtagctgggactacaggtgcaccaccacacgcagctactttttgtatttttagtagagacagggtttcaccatgttggccaggatggtctcaatctcctgacctcgtgatctccctgccttggcctcccaaagtgctgggattacaggcataagccaccgcgcccggcctggaaccctacattttaaacactgttttatataaatttactaatgaattaaaatcttaactttatttatgtcccacttctgaactcgcttaaataagaatggtgttttgatttgattattagatttgattaggtattgtgattatgctgattagttattgaattaagttttgtactcgataaatcagtttaacaatggacacacgttactataagccaacaaaggacaaagctctatgttggtcctgcaagttaaaaagaaattatgacatggtactcaccttcaagtaactactgtctaccttatgattatttagagaattgaaaatgagttgggccagcacttaaaatatgtgttatatgtaaaatatgcatcagtttatgttgaatctagttcggcatttgtacaatcaaaattgccaaaaaaccacaatggagaataagaagaaccccttgtagaagagaagtcactggtctcctggaaaagcaaaactttcctaaaaccttccttgaagtggcacagtatgttggagaaaaaggagaattctgttgatgacttggagacacttgattttcatatgtttctctttttcccaatcttctcttcaaagaaagacttccaagtggtaaaatgtacaaaaggtagaaagagtaagaaattgtttagaacctgaatgatctgttgatatttctatcaggggagaaagtaaccttatatttcaaccagtcttgattctccatattctataatctttggggtcttaaaagtgagagctgggcctttgtatatatcatatgtaatcgggtaaaaagtatacatttataatatatacttatatattatacacatcatatattatatacattacatatatgtatccggtgaaaacttataagagacggagtctcattctgttgcccaggctgcagtgcagtggtgtgattatggctcactgcaacctcgatctcctgggctcaaggcattttactacctcagcctcctgagtagctaggactacaggcaccagtcctggctgagtttttgttgttgttgttcacatggggtttcactatgtggcccaggctgtggaccttatagtaggtgttcagttagatcaaatagccttagctggccgggcacggtggctcacgcctgtaatcccagcactttgggaggctgaggtaggtggatcatgaggtcaggagatccagaccatcctggataacaaaatgaaactgtctctactaaaaatacaaaaaattagctgggtgtggtggcgggcgcctgtagtcccagctactcgggaggctgaggtgggagtatggcgtgaacccgagaggtggagattgcggtgagccgagatcacgccaccgcactccagcctgggcaacagagcgagactctgtctcaggaaaaaaaaaaaaaaaaaaaagatagctaagtaatcaaagaggtataaaagtgttgggataattctcactgtattcttttggattttgcttttttagtttttgtaacaacggattttagagctggaatggacttttaaaaggaaacacatccagagaggttaagtgatttatccaagattacctaggtaattagtggcagagttgtaaatttagcctacgctgttttattagtgtattttcttataaaacattccttttctggctgcttctactccctcattccccacattaatgattagcacctaatgcacttatttctggcacatgtttgacaaataaatgaaataccatgaaacatacattttacgttatacatttagcatcagtgtggttagtgggttttgtgcagaatcctttggtgtttagatactttttctatttccagcaaaactgtgctccaactaattcctttacttgctggtgaaacttcaggctaattatgggaagacagttgagaggactgagatttggaagacccagagactgaaatagagttgatttgtaagtcttaggaagattgtggagatttatagatagaaaaggagataaaagcttcctggagataagaatcgggaccagaagcaaaatcctcatgaattaatactgcattttctgggggaaagaaggctgctattgtagttaagagaaaacgaacattccttggatttttatgctaaaaatatgtcagtgccttccaggagagagtctgatgcacttacagcccaggtagaagtgcttttttacccaattccttttgccaatcttagatgtaggctcctcttttctcccaagagtttcctcttgaatattggccggctgtggtggctcacgcctgtaatcccagcactttgggaggcagaggcgggtggatcacgaggtcaggagttcaagaccagcctggccaacatggtgaaaccctgtctctactaaaaatacaaaaataggccaggcgcggtggctcatgcctgtaatcccagcactttgggaggccgaggcgggtggatcacgaggccaggagatcaagaccatcttggctaacacagtgaaacgccatctctactaaaaatacaaaaaattagccgggcatgggggcgggcgcctgtggtcccagctacttgggaggttgaggcaggagaatggcatgaacccgggaggcggagcttgcagtgagcagagatcgcgccactgcactccagcctgggcaacagagtgagactccgtctcaaataataataataataataataataataataataataataataataattagccgggtgtggtcgcgggcacctgtactcccagctcctcaggaggctgaggcggcagaatggctttaacacaggaggcggaggtcgcagtgagcagagattgagccactgcactccagcctgggtgacagagcaagactccatctcaaaaaaaagaaaaaaaaagattattggtttataaattttatcataacacaaatgtatttgagtcaagctttttcagaaaaataagtctgtgagatatttttaaggaaagaattttattaaaaggcagtaacattaaaaattaccattaccacagccttctcctactatagataggcattttccattcattgtctataactgtctcacaactgctaggcggtattacttgccaaggctgcattttatgtggcccagcacaagttagagcctcagtttttctagctttaaatagtctttctatgatactgtaatctttcaagagagcagtgaaagtgtctaactgtatcaccaactgtttaatgtagtccaatgggtacaaccctggatcatgaagtgtctaatggttgcagcctcaaatcatgaagtatctaatggatggttgcagccccgaatcatgaagtgtcagaatcttccttttcattggttggcctaatcttccaggtcactgatattctgatttctttaccaacttttagcatattgctttaatggcttctctctgcaaacttcagtctggtaatgggagaactaagaggtagaattaatggaacctctctaaatctcagctctgccaatttctggacttgggcaggtgatttaacctctctatgcttccattttcacatctgtataaaggagattagtcatagtagccacctcatagaggtgttgtgagggctaatgccttaattaatgggtgtcaagcagtaataagagtgcgcaggatagagcctgcgctagactctcagtgttgatgatgattgaaatggacagctaattggatgtactgaccaaagaagacagtgtcaatagtcttttgaggttttgaacatgaggcagagaagactgatggtgccactgaccagatcaggaggacagaccgatttttttcctcttctttttgtggctcttgtgttttggtgaaaggaggaggcattttggtttctctaggttttccatctgggtagtggagggcatattctccatcacgggttttcagcccttgctgccgattacataaacttggggagcttttaaaaactattcatgccttggccccactccagacaattaaatcaaaatctatgtggttggggtccagctccctgtgaaagcttattctcacttccagaaggcttgagaaccttgctctagaggacttcttagtctccagtttagagagcagcctagcaggtaagattttgtattcttaacgtatgctttctactgctgtgattaagccccatgtaatgaggtggctttccaggactcatctgctgcctgtcacagtctaagcagtgtggaattgggaaatccttgctcccttccagctttttccttttctccagtgtcttttctgctggatcatacttttttcttttgactattattttggtggatttggaaacattcgagaggtctttagacagaagactgcatagctataaagtaagtttatctgaggatgtcttttaaaaaaatgcacacattgcccttcctgaaggaaaacttttcctagtggagcaagggacactcgtcctcttggtctggttacagaaaagcatgtttggccagcttattagatttgcctgagttcatactttgaacagaaaaattgcatgttttactgattggaaatacattctgggacttgattgaatatactgatcatgtataggtcctacataggtgtcttaataatggtcttcttaccgtacctgcacttaagttcagcaatttggacctggttcaagtcgcttcaattccatggagctgtattgtttgcagctgaaataggaagagagagtgctttaggctgtcttgtgagcaagacatctgagttgtctttagttcatgcttaagcacaaaagcagcagcccatcatctaatctattcatagtttactttgttcgggtatctaatttgggagcatgcttgccctcactcacttctaaaacacacaatttgaataaaagggtctatctttaattgactcagggaacaaaaccttgttgaagaattctggatttctcaaagcttttaaaaattgctctgcaggataacattacaatgctgaccctactgccactcaacatgtatctgtcctacaatggagttggaggagggattattctgagaaggctattaaaatgaaccatttactatgattcataggcttttaaacccagtaagtctgtaatatctagagtaaaattcaacatcagtttattattttggtgatgatggggttaaagtgtctttacaaagtattaagcatgcacagagaaaatgcaaatgtgaattctcttcgttctccccgttaggagtgtatgcctgatagataaatgttccagagcattcatgtaatacaattagtagatataagtgctttttctcagtggaaattgaggtctgttacaaggagtaacagattaggccagtggttctcgaagtagggactaatcagcagcatctacagctcctcggaccttgttagaaatggagattctgggcctctctgcagactaagcaatcagaaactttgcaggtagggcccagcagtcttgagctttaaaaagcccttcaggggatccttctgcatgctaacgttcgagaacctctgagctacggttctcaccttgacagcacagacactattgagagtccctggttgtggggcacgggtgtcagtatttttgtttcttaagctgccttggtgattccagtgttcagtcaggattagaggctgctgctctaggaccttgctacccaaaatgagggtcccagaccagcagtgtgggcatcacctgggagctctttagaaatccaggctatcaaaccccacctgagacttactgaatcgtatttaagtttaacaagattcccagtgactcataagcacattaaagtttgtgaaacactgatttatagaaatagtgagtttcctttgtagaagccagcccttagaacgcccttaatttaaaagttttgtgaggaggtagaacagctgttttggcttctgcctggcagtgactcagggaagcaatcactgggggcaaggcaaggctccgaaagctgtgaaggacccaggaccatttcatcgagtgagtgctggtgcaagtaatgaaaatcccaactcagattggcttaagcaatggaaactttttggttcagataatggaagagttcaggagtagttctgttttcagatctggctgcatcaagaggcttatgtgattttttttttttttttttaatcagcctcaaggcttacgtaactctcagctcaaccttactttgttagattcactttcaggttttacagaattagagtaacagctaagctgttgttaaaaagagattcctaaacatagtggcttaaagtagatttatttctgtttgacacaacagtcccaagacaggtctggtgggatagctctgctgtgctcacacgcagttcttacctgctggtccaaggtggccagtccatccatactgtctcccagccaggagacagagtcaagggggagaacatacccattccttttaatgccacagcctggaggggtaacatgtcacttacacttatatcccactatttgcagcatagtcacgtggtcacacaaggtactatgcgggctgggaaatgtagtctctacatgggtggccacgtgcccaactaaaatctggggatgttttgttactaaaaagggaagactttaggtattgatgacaaccaggagcgacttctcctctggtggtggcaagatggagtctggcaacttcaagttaacagcctgtcctgtcagcagtttcagtagaaagcactactctttcctagttcttccagtaagaatcccagaatagcttcctagttccttaatttctgggaactacacatgaagaagtgtccccagaatcccgtggactgtgatagaaaaggattggttcccccaaagagaactgtttaatagcaggcttagaacagagagacctttacctcactcctttgtgaattggcatttagacccagacaagaaaggaaagtggagaacatgggggtgctcaagccagatgtgggggcattgggggctatttactgtcgagttagtcaagcatggaatatttgaagattattagcacgtgacataaagggtatttaggaataaatgtgtttgctgagtttaataaacataggagactgtaacagtgtacttttgatcttctgatctcttattttagtggttggtaaataagagtaaaagaaaatataaactttgacaaatgcttttaagaatgttttaaattatttaatctttaattgctaaagattatgtaaatagaagcctttagtgcatcaaacgatgagtgttggagagatgatgaattgaacttgtgtttaccgtctccttctcaaggttttgttttcttagtatgttttttatactttatacttagtacttttttatactttattcattacacaaaggatttgaggtaatttccaagactaaggcctttctcgcaagctttagaagaaaattctaaaagcatactacatcctgcttttaaaaaaagttgtgacagtcttacatgatagaaaaataatatatcatattcaaaataacatggtatttccaaggttctcaactgcttattgtccttttaatgaaaatgtggattgtaggcacatctgctataaatgaattaaaatttcatttgcccagaactttgtgtattccattaataagatttacccaaaacactattgttggtttaataaatattaagagagtctttgggatgtgcctcctggcgtttgttgtttctctcctttgagcattaactacccttctgagccttcacaggctgcttttgttgttttgtgccttgagatataaatagaggcagaaaacccagaagatgcaaacagatttaatactataaactatttacagatgtgtttagtattcattcaatagaaccttttagtttattgaatataaaccagctttagcattctacatgtgccaggggttctgttttttcttttattggaaattttaaaaacgacaaaaacatcttttggtagtatcatcatctaataagcatgagaaagatgtaacgtcatgacttgcacctgaccctttgtcttcttggatcttacatacttttggacaaccaagagtgaaaagggtggaaacttccgatctcgactgagtaaaaggaaagcctttctaagaggcagtcaaagatggaacaggctacttaagcaggaggcaggacccatacctggagctaagctggtgtttgtttggatggctgtttactgaggatctttagaggagattcaagccatcaactggctggggagagtcgctgacctttatagcttccttctaaccttagaagattctgtacgacattttaaaggtgagtgctgagcaacttaaactatattttatttcctttcctgataacttggtctgactgagactagacatcttttgttgcctatagttgaaggagtctggcattctaggaccaacttgctgttaaactgatggcaagatctctatttgccaaagttaggggactgtgtatgtaaccattgaaatctaacattacctcaaacttcaagggactctgacaggtactttaaccagttagaatggcacacttgactatctggtttgagtcagagcagtgagtgcctgggagaaaacagcaaactcaagacaccatgagtggactttagggagagggaagagagacagagggcccacaggccagcacgaagaatgtaaagggaaagtagccactgtcccaacctgccaggggtttgggaggcactgttaatttcccaagcattcacttatccgcactttgaccaggcaacccttcttcggctggacagggacactcatgctggaccttgatcacccatgacccatgtgtcatagtgcagagctttccttctgaggcttaagtgaccagtgtgacaagaaccctgaaacacctaatgtacagaaggactctaggtccatggtccccaacctttctggcaccagggactggtttcatgggagacagtttttccacaggtgttaggggggatggttttgggatgaaactgttccatcttggatcatcaggcatcagactcctttcacaaggagtgtgcaaactagattcctcgcctgtgtaattcacaggggtttgcattcctaggggaatctaatgctgccactgatctgacaggaggcggagtgcaggcggtaatgagattggatggctactcacctgctgtggggctgggttcctaacaggccatggaccagtactggtctgtggccccgggggtcggggaatccctgctctagtcatgaaccatttgtctccctcttgatttttcctgtgctagcgctcacttccatgtttccttctttattctgggtaaagcaagagaatgctggacaggtagccagaagacttgggttcttataggctggcctttctctgccagttaccagctgtgacctctggcaaatcactcaacctcttttacctcagtttccctttttgtaaaaccagctagtctctgcagtcaaaccttcaatagttctataatggctatgcttttcttaaggagtcgctttttccccctactttctacttactgccttgcaatgaagtttttaaaattccagtccagactttaacactgtgttctattctcctctcttctcctttggcagccaactaaattggttacagttgtcatttagaatgcggtaatctttcatgactaaccatttcctctcttagagatgccacttcatctagctgctgtagctcggatttcttcctcacagataagaggatggaggttgctcttgatatgggaaatagaaggatggaggttgctcttgatatgggaaatagaagtcggagtaggaggtaaagttccactgtagagggaaaatgtccacctgttagagacaggaaacaactggggtgcgaagggccagctgtccgtgttctgtggatgaaaattcccagcagattttttctgtatttttggctctgaatattatacactgaacatagagtcttgtcctggaatctgatagttttcttaaacactggacaagtgaatatactccaaaaagatcatgaggccacgggtattgtattctgaggtcccgagaagttgatgaatcttctctcccaaaggcggatatttttaccagtgtgagctacccagaaaattttaaatttgaaaatctcccaaatgcccatgattttgatggcaagaattattagaggcaggtggaaaatactgcccaactgtgatcatgacactttcaccaacttacggctccctagccctgggactggccaaagaacccagtgttgggctggaaggggagcccttccaggctgatggatctctttgccccaagtactgttgtcacactgccggtgttcgaatcaccttggggattggggttatttgttaaaaatgcacattcttgcatcccatctcagaccctgcatttgaatgtagctgaaacatactgaagttacagaatcattgcttttggctgaaaacctagaaagcttgcaatggctttctgtggaccccacctctctgcttaacctttttgggtttttagttcgggatctaaggccctcccctctctaaaatgcaaaatgtgacactgagctaaagatcaaaacatagcaagcgttatctagaaattattcctttaaaaatagtttatttagccatgcaataggataactgtcaaacaatattttatgctacttagagttgtacatataggtacataacattgaatagctttgttgaagtataatgtacctgccacaaaaattcacccatttaaagcgtagtttttagtgtattcacacaattgtgcaacagtgaccacaatctaacttgagaatattttaatcacccccccacctcaaaaaaaaaaacctgtacccatttgcagtcacttttcattccactcacttcaaggcctaggcaaccactagtctcccttctgtctctgtagatttgcctattgtggacattttatgtaagtggaatcatgtaatatatggccttttgtgattaacttctttcagttagcatgttttcaaggttcattcatgttgtagcactagtacttcatctctctttattgccaaataaatatttattgtgcattgcatatagtcatacccccttttccatttgttagttggtggacatttgggttgtttcaaccttttggctattaggagtaatgccgccataagcatttgtgtccaagtgtacaagtttcatggggctatatgttcatatatttccatttctcctgagtatatatacctacgagtggaatttctgggtgatatggtaactctgtataacatttcaagaaactgccacactgttttgcaaggtagctgtaccattttacattcccaccagcagtgcacagggttccagtttttccacatcctcatcaatatttattattgtctgtccttttgattacaatccctattgggtatgaagtggtatcttattgtggttctggttttcattttcttactgactgatgatgttgagcaagatgtgtttttgtgttcttagccatttgtatttactctgtgaagaaatgtctattcagatgtctattctgtgggttgtcttttcattctcttaatagtgtcctttgaagcacacaagttttagatgtttatgaagtcaaacttatcagtttttttcttttgttgcttatgtttttggtatcatatataagaaacactgcctaactgaaaattggaaacatctattcctattttcttccaagagttttatggttttagttcttacatttagatctaaaatctattttgaattagtttttgcatatgttgtggggttggggtacagtttattttcttctttatgcatgtggtatccagttgtcccaacactttcttagaaagtcttattctttccccgttgaattcttggcacacttgttgaaaatatattgaccataaatgtaggggtttatttctgcactctcaattctgttccttttatctgtatgatttatatgaagtactatatgtacatatttttgtatgtatatatgtgtgtgcataaatacacacgtttgtgtgtgtgcatgtgtgtgtgtgtgtgtgtgtgtgtgtgtgtatatatatatgcacacatgaatcttaaaattgtttttcctgtggccttaatttaggtgattagggaaatggacaagtcaataggtaggaattaaagacgttaactacaccaggagacttgaccatgaagtccctcctgcctcagctgagctaatttaacagggatacaaagagccgcagaacgattggtttgctgttggtttttttctttttctctccctccctgaaatggaatgcctttcagaatgttttggagtggggtgcattttagatatctctagtccttggcctagccctgacagtgaggtcttggctaagatacttaatgagttctgaatgcccctgtcctcacccttaagcagctgatttttcgaagttttgtttcgcttcatggtataaaaagcctagtcatgtgatctttgtaatgtttcttggttattttaatttttaatggtaaaaaatgcctgacagaaaaaaaaagaaaaacccaagactttcctgtgacacggtgcacttctgccttgtggacctagttggagagactgccttaccttgagaggtttttttttttttttttgagacagagtctctctctgtcacgcaggctggagtgcagtggcgcgatctcggcccactgcaagctccgcctcccaggttcacgtcattctcctgcctcagcctcccaagtagctgggactacagacgcccgccaccaggcccggctaatttttgtatttttagtagagacaggtttcaccatgttggccagatggtcttgatttcttgacctcgtgatccgcccgcctcggcctcccaaagtggtgggattacaggcgtgagccaccgtgcctggcctaccttgagagcttttaactacagataaagagctgaaacttcttgtgaaaatgtcttaattttattcttgggtccgtgggaatttagaactataggcttttaattgttcacagctggtgcatgaatagagtggtaataataattaggaataatatggttcacctcctaagctgttagttttaatccgttaaatttttttgaactgacgtctggcacagtcttcaagtgagaccatttggaggaggtccatcctaggtttcagtcaagaagtgtgcatgtctgtcttgtcctgctaatttgttacagtgatttctatggtttgattttaatgtttttcatctaaaaacacacatgcaaatccagcctacgctcaacaaaatccatccagacactcccactacagagcccttgcgtgacaattttctgtatctaagttagagggagcttgcagcctctcctacatccctctgcggtgggaggagccttgctaggggagagagggggtttgctctaagtctcttgtaaatggaggccgacccagagtgcccagagtgcagtgcttcctgtaattccccagagagcagtttggaaatcataaagctgatttacagttatttattccctgcccctccccccacactattttttgtaaaatcctcaaatttcaaagtattagtacaattgattagtgatgtttacttttcgtcatttcttaatgctccacgttacagaaatttttcaaaatgtttcaaaatgacatatttagtagagaataaggattaaagaaggaatgtgttcttgaagagtgatctggttggaggttgttttctgggaaggtttaacaaaatagttgtcttaggagaacacatcataatatcacattatttaatgaaacctcttttatcttagataatctaggggggaaaaatcctaaatttacacttaagtggtgaaaaaaattaaatcgcaatttaattattttttagaagtagtataaatttttttttttcttttgagacagagtctagctctgtcacccaggctggagtgtagtggtgcaatctctcctcccgggttcaagcgattcttgtgcctcaacctcctgtagctgggattacaggcgcgcacctccacgcatggctcggtttttatatttcagtagagacagggtttgttggccaagctggtcttgaactcctgacctcaagtgatcggcctgcctcagcctcccaaagtgctgggattacaggtgcgagccaccacgctcggcgttagaagtagtagtataaaattgatgatatcaacaagttgatagcttctcataatttatgctgcccactaatttggctaatttagtaaatagttgttacctggaactaaatgatttctcataacatgccttcttggcctttctcacgggacttcctggaacaagatgacttttgttgggtagagctgatataagaatccagccaatgaaactgtagtgacaactttttacttttaaaagtatatattgtaaaaagctctcttgaatctacaaatagaatccattttactaaagctagggtgttagtcacattatatttccaagaaaacacagtataattgtcactttcaagggccatcgaactgaagtagagaaaggtggtgactttatgggaacaccagattagtattagaaattagcgtgagatctatacatttagcagtttctaaaggtgatttctgctgcttcactcactcttactgtttcttgaagtattgattgtcaaagtgattagaggagcagtaataattcatttacagggagtcttactgccttttcctttccagagcctctcctcacattcccaagctgtttatatgtgatgttcagcttgtggacagggtgtgtgcttatgttttaagtatttgcttctggagagctagctagaaaaagcaaaacagagaaacccattggcgtgttgagagttgaatccacaagaagatgttgtttgcaatgtgccgaaaacataaggtccaaacagccggaacaggcctggtgccaggcaatttcactgtgagagaaagaggaggtctgatgcagttctctaaggattagctgcaactcagcagctgctgtctgagtttgattatgcacatcctgagacctgcattaacccttgtgcccctgggggaacctcagggctgtcttctaaacaaaggacttttcccctggacacccaggggcaaaagccaaaacaatatggaggttaaaagaaggcggagctctgggagactggatttgagagaacaatctaggaaggaaacggattgtagaattttggaactgcaagtgccttttaagaccctttcattttattgatcaagaagcagaggctcagagaagttaggtgacttgcccaaggagaatcagtcaaaacttaagtccaggtgtcttcattcccagctaagctgtttcatgcagcaccacatccctaatgggatgattttcacattcgtataaataatatgttgtgtatttttgaaaactgcgctgagaggaaaccaaaagcatttttgaattatgtgttaatcacttcttatagactgtccagggatattcagatttttctttcaaataacattttattagtgtgtaagtcttaataagtgacaggtaaatagatcattccagtagctaccatgtatgattcataaaggcagaacaggcgtcctgggaaggtgttaggagggaaagctcggatctagggagactgctctgaaaacaaggaaggatgtttatggaatgaactcttttgttcaaccatggcgatgtctggatcagggcagccttggaggatttatggcctccagtctggagaaggtaggtgggctcgcattatctgtgttgtaagaaaagtgtgtgaggtctttgagcctaaggctgtccaggtaacaaaagactctgtcaaaaaaatatgtctatttagagttctttgagagtaatatgttgctatttatttcacatctgtgtcgggtattgagcattttccttgctttgcggttgtaacaagatcctcagctttcttccttttaaaggttggggagctaatttcttgtaggaaataacacattaaatccaagcgtatcactaaaacatgtgtgccttctctttttgctcaattaaaagattgagctgttcgtgttttgtttgatatgggggtacttattgaacattgtcaacctaaagcattttgagtaaccaagagaaaaatcaggatggcctaattcactaaaattccaagtacatttgggatgtatttttatacttcttaattatgagattttaaattgctttatttttaaaggttgagtgtgagctgagtgtgtgtctttttctgtagtcctaccatcctttctgcaaaactcaagtgaaaattatttatttaggatgccctattgagatatagtggaatgtctttgtttgcatttattctttttctgggattttggttatatctatagctgtaaataaaggggaaaggaaggcttggagtgcatgttaggacaagaggtcccaagtaggaaaaaaagtcttgccttagagctatgccttgggaagtgctttttatttagtaacctaatcaggacatgcctgtgtctatttattgttggatgagcttttgaagtacatattgcctgaaagagaatttttcaagtggttacctatttttttttttttctcctctggctggagaaaagttagaacagaagggaacgccgtgtattatttttgttgttcttcactaaagacatagtcttggctacttcggaaaaagaaggaaggtatgaaatggtggttaatcctttcctccattttgtccccaattgcttgcagtgtctcttcaccctatcgagaaacactttctcaaagctgtctctgtactgtgctgatatcagaggagtcaactaaaagtgattttctctgtagacagttattctagtttatgggatgtattataaaactattggggaaaatcactgaactactaaggtaagggaaatagcttaaggatctatgatccatatttgaaatagtcattaagttatataattggatttttagagaacaagatagagcagtttcaggatgtaaggtgtaaaataaatctggtccatgaactgcttccaaattgtcaccctgaccagaagaagtaacattcctcaggttgtggctttatctagaaaggggaaatggctatttctggattagctttatacaaatgagtgtatttcccacctgctgcttttgcctagggttggaatttttccttttcactgcttgttacttggcgtttggatggaaacgtatcctccctttcagagccagaagattctgtgtgagtcatcaagaaaaatttctccgaggagttattaattcagttagttgctccatagtaaatggttcatgcaacagtgataaacctctgaatttgaaatctttctttaaaatcttttttccttcaaaaaatgcatacagtggattgctgagcatctaaaatcccgcactgttcagcactgtcattcttggtaattgctttttagaggatttggtggtgttttgctgcttaagctaaaccacgaagttaaacttttgtactgtggaagtagttcatgaatcctttagatttcttggaagaggaaagatgagtgtgtggtgaatatatatgaatatcgcatatttgaatgtgttacttactagttttggttgagcattaaggttgcccctaatggatgggatctctgccaggggtaactcttggagtcctaggtgctattggggaggaacctttcattctcggcattctgggggagatttacatctgtaagccggataaaaatatgtggaaaggtgattagtttaattggcccactattataattattcagtaggaggtggctgtgggactgctattatagcccaaaatgcctggtaggaagaggcggagactcattgaaaacagcagcaaggttataaaacgttggtttaaacgtgcatttaataacagattaccctggtgctttaaagacagaggaatgcttaagtatttggtacaagaatccatccaaaaaaagacgcggattttttttcaaagataattgtgggaaattctgctaatgatttcttttcccttaaaatatcatacaggggagtaggatttaggtaggtgtaaagttgctcaacgtgttggtaactttaagattatttcttctctggttgttgccacagacactcagggtggccacaatggtggtgttgttttaggcttctttcaaaaaagaagtccagtccaggataatgttgtaaagtggagtatttttctttcacatcaaagggcaaggaatgttttacagacagtgagctaagaagtagggcacagatatttcagtacttgcgttgggaaactatgtgtggaatgtcatagttcatataccagagaccccgaagtgaatccaggtgcctgcacggtgctgacttttcctggagtgagatgactgtaggcagaaattgcagccagatgaacctaaaataaaattgatggctttattggacattcttttcatgagatttaacttcttaacgtgcacatacatcactctggggatgtcattatcatggctgacctttcgtttgggggagctgctgctcgctgtctgtgcagctccgatcagcttggctttgattaccacccacatctgttgagcatgtgagagagagattttgaaaaatctcaagcacactgacaactggctacaaagatttaattaagaccggtcagaactaatttcagttatatattccagtttagggtatcaactcctctggtttcagaagggggagttatgacttcctaaaagttgttgttgaaggcagcatgaggaaatctccttgggcaagcagtgggtttctttgtcctagctcccccactgctacctggggttaatgattgcagggtggctggcgtaatgaaccagtgccggaaagcttattatcaacatgctgaagtcatatttagaaatcattcctcctccttttttctcctttccaatacaagtcagagcactgctgtggttccacctaataaatactgcaggcttcattgggctgttcaatgagacctaatatagtatcatttgtgcactttagtgggtggttcctatttatatttttgtgtggtttactgctcaatcttgggaagatgtggggtttgagggtttatcagttgcagttttttgtggaaccagtttgagtgagacaagactttggccattatttgtcgggttacatggatctccatatgagctatgaagatactggaataattgggtcacaataatgtaaaatcgtagtctgtactttcagctcattccagaggaatgattggaagccctgctctccctctcttctgcatgcaaacctcaggtgtgatttcggcctgtgcccaagtgttcttgaaatgttcaaggctgtccgttcccactctgtgatgaggcttccggttgatgtgtgacatcacttagggcaggaactggcactgtcttgatcctggctgtcctagagaagcttctgtgcttggccttgggaagccaccccatttggtgctgctgtagtctcctttctgctcctcttttaacagctgcctcccacctgtgctcacttccacctgcaggccttgttttccagtggcactggagtgccatgctgaggtcactggacaagttccttatcagagcccccttcccattagagtgaggctgcaccccatcctgcctgggcttactttgtgcgttgcttgggggcatggagaaggttcttgcccttgctgctttatatgaggtccaattcctccagtgtttgccatctcctttagagctctctggtgacaaaaccttcttcagcttgtctaccctccaggctggtgagttgaactcagactggtgctcggaaaggttaaaggacttgtccaagatgttaccttactggcaaactgcattcccaagtctttattgatctccgagggcatctcttaatttgttggagttttcttttcctggaaaaaatactgcttgggtctcagtttctccacatataaaatcagaataagaccataaattcatgtagttgaaaggggcggtttcaggaagaaaactaagataatgaaagcctccggaaaagggtctgggacgacattatttacagagtactttccacacattgtcagggtggggccgcacaggaaccttgtggggtaggcatcattgacctgtttcaaaaatgaacaaagtcagtcccagagaccttgaatggaggcttatcaaagctaagcatacggcttcaagtttaaccgtcaaatggtagagttagtcatggcttttggatgtgcgggccaggcatggtgcagggccaggtatgttttagccttgtggttcttttcctgatatttcggtcctgtgggcctccccaaagtggctttgcacctatgtttgttatgggcataaggaagttagaattctatgaatatgtactgattttttgtgattctgaatttaaataggcctctataaagctaatacttgaagttttgttgtaatgaagcatcacaaatacttttacataggaaaaaggaccaagctgatctccttaaagcggttgcaaaaaccacccagttgttatacgattgtttgtttcatgtttcttgttatgtggcatatttccagtaagtggagggaccaaatattttatagttacagaaacttcttctctccctccttgaagtttaaaaaagtggatcaaatgtctgcctattttcaaggaggcagggagacagaagatcttttccagattgcaggaaggccaacgcaggttgcacccagagaactatggaaaccactgttgaggaggaaggaattgggtgaaaattaaagaatcaagctagtaaaagtgaaaagaggcctttggtttttttttttggacagtttttaagggccttcataaatacttggtgtactcctcaaagaccaagcgttgaagggttaagtcagggaactaaaacttggattgtgtgttgacccctgtgtagctgtggccagggctcctgattttcccctgacgatccattggtagaacaaggccagtggtactgttttctggtgcaggggaggctcggacctgcaggggagttacggaggctggccactggtttggagcagacaggtaagtagcctctagggaggtggtagctctgtacaacagtctgttcccaatgtctgggtgactcttgttcccaatacttggctctctttttggatgtcagagtcatattcttcattctccatgtctcctgctaatttttggcattgacccatccaggatttatttcagcagctagcatggtgcctgacctatccatagtaggtgcttagtaaatactgcactccacagggggaagagggcaggcacgttctgcctattgacgtggtgggaagagagaccgtgcttagggacaggtttgggagcttcattatttctgccttgggactgtttgaatgcaccctattttgctataggggaaacactgcaataacataaatcccacttgaatcattctttgttctatcacccctgcccttatcactgctcttgtaagacagacatcataggagactcctaatcctctccctgcctctggtgggtgcatgacactgatctagcttccacttgcacagttctctctctctctgcccctaaaacagaaatatgatcatgttattctcctacttacatgcccgtcagtggctccccagtgccgtactgctgtggcacacagaaccctacgtgatctggtcctgcgtgctctgtaagtggcaagtcccagggcctcttcgtgcaggctgttcaagggggtctcataacctaccagtccgagttagacttgttgagtcttaaaaccaagctgctttgagttgggtcttcagatgaactgggaatcaacatatttgggatggatctgtagggtgcatttaaaaggcactgaatgtttggaatggagtgcaagaattaatgttaagttaccagagaaaattgaggtattaagggatctgcgcatatagttttcaaaaatcaattaaacaaaaagcctgttttttaactgattctatagttcatttggaagactatgtatattacattatatcatatatctacatgtgtgatatatttataatagaaaaatgaagcagaaacttctactaccaaatattaaaacacattataaagtgctgataaaagatgatgatgtgggcataaaaacatgcaaataatccaacaaaatagcacttttcaaaactttttttagcgtatggaataacttaattataagtcgttggggaaggaacagattatttgatgaagggggttgtgaaattgggtattttaaaaaatctatttatatctttgctttggtgacacaccaaaatatctttcatacggattggatttaagtatatatatttaaagctctaagcgagaaaaaaaatgtggagaaaatttgatctctgagaaagaggattttttttaagcctaaaagccaaaaactctaagtgattgctcaacttaagtacataacagtattcattttactgaagaattacaaataactaataatgatcactagaacagaaaaatgtcaaaagaaaaaacacacggtattcattgtcctctcataaaattaagaaagatttagaaaatgcaaatactcagtgctcataacaatatggttagattttcaacactttctaaaaggaaaaatgttaaaataaattccaaagaaaaaattttttaaatggtttggtttttacatatactggggaaacttactatttaaagactagagttaattatttcaaaataaaaatagtctttctaattttagtttcataatgttgttttttaatctttgtttgattttaaacaaccttttagtctttgggctgtccaaaattataaattatatgtctgtaatttactattgttaatcatacagttctccatataaaaaatggcagagagaaaaactggaaaaatatgccctgtgaaggggatttatgatccttaatatcccagaagaagaccataatgaggcatcttatgtaacagagaagtcatatagggcttcagtttctaaagtgctcaaattttaattcatagtgtgactttgaacaggctactttacctctcttggtctcagtgtcttcatctgtgaaatgggagggttgggttagatcagtttcccagctgagatgccccggcacagctgtgccaaaattctgatgcccctcggccctaaagacagctggacagagctggggtggaggccctaggtcagttacttccacccaagggcagccatttgtttttcccaaggaaaatagtaccacaaatcactctcaatgcactcttagataatgagttgtcttacttttaaattcaagaggtgagagctacatggaagaggagataattttggacatcacagtgaaccattcgtccttcccagtcaatattcaataggtatgttaaaaaatgaatggaagaaaacacatcaaaatgttattagtaattatctctggtgattgacttacaggtaatttttatttgcttatttataatattccgcctcattcaaatttactgttaagaatttgttaaatttaaataagaaaagttatttaaaacaaatcccaacctgtacccatttttacatttaaaaactccatgagtacgagtgacggctatggctgtcagagttaagaatctaacaaaaataaaacggcaaacatggacccatttcacattatggaaatatcctgggatattttcattccaaggtttcttgctcagtgcttactttcaaggctggtttcaggtgtgaggaagaagctttgagcagaaggcctgtttgtagagtgagtgagtagccttcttacttggggcagctgaccccaaaggtcttcctctccatctccctccttcagtgctttcttcccttatttttccccttccctgtgacccctgaattgctgataattcctttccttctttgttcttctcaatccctggtgtgtatatggttagaagttccggtgcccacttagctgagccacagagattccatttttaactggtccctcatatgccagcccatctagttcctcaggcattaccgccttccctctcccagctttattctgcttatttacatctttctgggaatgatgtgcttcaaactttccaacctattagtttaaaccagatttagtggcaggggcggggggaagtagactttctctgccctttggttttgctttactttgagataaacactatatacattaaaggtgcttaaatgatgttttctctgacttcctaaaggggttacttttcattgactcctaacattttaattctctgattgtgattgttttgtctaaatcatggggtggagtgcatgtggggaattagaaaactaattgtcattataacctttcagcagaattttggaatgattaatagctatgttaatatgccataacataattacttataaaaatcagaatataccaccaccttgttagtattaaaatggtgctaggctgggcgcggtggctcacgcctgtaatcccagcactttgggaggcccaggcaggtgcatcacctgagatcaggagttcgagatcagcctggccaacatggtgaaaccccgtctctactaaaaatataaaaattagctggacgtgttagcgggtgcctgtaatcccagctacttgggaggctgaggcaggagaatttctggaacccaggaggcagaggttgcagtgagctgtgatcgtaccattgcactctggcctgggagacagagtaaaactctgtctaaaacaaaacaaaacgaaacaaaaaaacctgctaaaatataagttactttctttatataacattttaggaccttacagtgtaccttaactttctgagcatagataacaaatgaagataataagaaatattgttttatattgtttataaagcactgtgccctacattgcagtttatagaaccacataacagttggccatgggcagtatctcaggaagccttaaaatctcgggaagactgacagaatggcggagctaagatggacctcagggtcatctaatccagtgtttcccaaccattttcacatcatggcacacattgaaaaggtgcacagcacaccctggggaaataaatgactgctcttggctggaggtagtggatctgaggactccagcctaggctgtgtccagctcccctgagggctgatgggcatcagaaccttggcgcagctgtcctggggcattccagttgggaactgtgatctaacccaaccctgccattttacagatgagacacatctgcatttacatatcgagacccagagaggtaaagtagattgttcaaggttacacagtgaattagtgacattatgataaatagaatttgagcatttcagaaactggagtttaatataacttctcttttacattgcatgcctcattatgttgttcttacagtacattagaacttttatagggcacgtttttccaaaaggtttacctctgccatattgtatatggagaagtatgattaatattagtaaattatagatatatctcttttggacaacctaaagaataaaaggctcttttaaaccccaaattcaagttaaaaattaagattacgatgctaaaaatagtctaacatatgtaaaaatgatttaaaaaattttatttacacaaagaatgtactcaggctatgaaacttgtatgctggcagttgcctcactttaaaaaataaaagagagaaaagtaagatggaaaagaaaattaaaattgtaaacattttaatgactcaccactacctccatccttagatttctttgccatcaactatttaaaccctttaagaatattaggaaaccgtggttacttggcgtggttttataaatctgttctggtaatctctaaattctccttcaaccccatgatgattcactgattctagtgtaatgagggcttggttcagccttacatatatttatgtgtgtgtcaaccaagatgtacatgggaacatggcatctcatcttcagttctttgtctgaaccacaaaatttatgtgccaattcaggacagtttatggcgctaggtttgtaacatcagagtgacttgttccaccatgacctcaagatggtagctgtagactagcgacaccttccattaacagctggttgaccttggagaagttctataatctctttttttgcctctgttttttcatctgtgaagtgaaggacaggctgcctacctgctaggattgttatatggattaaatgcattagttagtgcaaagtcttgaacaacacccagtgcacacagaaataaatatgataaataagtacagtgaatgtgggccgttttcatcaccattattagtaatagctgccatgagttgtcattgaacagggagcagtaagggggcctccaggtataaacaagacccaccctgctttgtcagtctcaggttttataaaaatagtcgctgcctaactgagttcttggggcactaaggaataggattattattaccagatgcccctgagtctctctgcttattgaggcgtttttttttttttttttttttttggtagggctttgtttgggaaaaaaaagaaagaaaatctacctccagggacatgggtaaaatattttttcccttagttaacgttaaattccagtcattcttttgcagaagtgttgtggaacagaagggaggggtaaagattccaactttagacattagactaagaatgcatgtaatgagtacccagacagcatgacactttttcagttatcactgccacccccatccccccaaaaaaacacactgtgagggaaagagcaagagctgtgaactcagacaggctgagtgcagcccctagcccgcacttaatggctgagtacatccgggctatgcattcaccttctctgatgggtcttctaggttggagtcatcttctagaggtgctgtaagctggtgtaagagactagcaaagtgccagcagcataggccctgtgccctaaatgggcccacatttttctgagttcatctttgctaaagggattttttttcttaagtacatactgtatccagaattggtgggttcttggtctcaccaacttcaagaatgaagccgcagacccttgcggtgaatgttgtagttcttaaaggcagcgtgtccagagtttgttccttctgatgtttagatgtgtttggagttttttccttctggtgggtgcttggtctcgctggcttcaggagtgaagctgcagaccttcgtggtgagtgttacagctcataaaggtggtgtggacccaaagagtgagcagtagcaagatttactgcaaagagcaaaagaacaaagcttccacagtgtggaagggggacccgagcaggttcccactgctggcttgggcagcttgcttttattctcttatctggccccacccacatcctgttgattggtccattttacagaaagctgattggtctgttttatagagagctgattggtctgttttgacagggtgctgattggtgcgtttacaatccctgagctagacacaaaaattctctatgtcctcactagattagctagacacagagcactgattggtgcatttgcaaaccttgagctagacacagggtgctgattggtgtatttacaatctcttagctagacgtaaaggttctccaagtccccaccagattagctagacacagagtgctgattggtgcattcacagactctgagctagacacagagtgctgattggggcatttacaaaccttgagctagacacagagtgctgattggggcatttacaaaccttgagctagacacagagtgctgattggtgtatctgcaatcccttagctagacataaaggttctccaagtccccactagactcaggagcccagctggcttcacccaatggatcctgcactggggccacaggtggagctgcctgccagtcctgctcggtgtgcccgcactcctcagcccttgggcagtagatgggaccaggtgccatggagcagggggcggcgctcgttggggaggcttgggcatggcgggctgcaggtcctgagccctgccccgcggggaggcagctgaggtccggtgagaattcgagtgcagtgccggcgggccagcactgctgggggacccagtgcaccctccgctgctgctggcccgggtgttaagcccctcactgcccggggccggcggtgcccactggccgctcagagtgcggggcctgccgagcccacgcccacctggaactcactctgacctgcaagcgccgtgcgcagccccggttcctgcctgtgtttctccctccacacctccctgcaagctgagggagctggccccagcctcggctagcccagaagggggcccccacagtgcagtggtgggctgaagggcccacctctcgaacgtggccagagcggacgctgaggctgaggaggtgctgagagcaagtgagggatgcgagggctgccagcacgctgtcacctctcaatactttaggcaatttcttgtggtggcacatttgagactgtttcatgccagtggcttttccattttcctttctttttttgagactcttgctctgttgcctaggctggagtacagtgatgcgatgataactcactgtaacttcaaactccagggctcaagcgatcctcccacctcagcctcctgagtagccaagactataggcgcataccaccatacctggctattttttttttattttttgtagagacgagggctcgtcatgttgcccaggctgatctcaaactcctggactcagccagtcttcctacctcggcctccaagagtgctgggattccaggcatgagccactgtgcctggctggccttttcactttctattaatggttctcggggtcatctcccgctgcccttctcccccaggaatattttagcagcattctaagttatttcagctccttcagttttgttgctcatatctttgctacccttgctcaccattacaattcaaagcctcactgttcttgctttctcactgatgggttaacctttttttcttctatcacaaatagggttgctagataaaatattgggcacccagttaagatggaatttcagataaatgccaaacaattttttttttttttcgagtcagagtctccctctctagcccaggctggagtgcaatggtgcgatcttggctcactgcaacctccgcctcccaggtcccagttcaagcaattctcctgcgtcagcctccgagtagctgggattacaggcatgtgccaccacgcccagctaatttttgtatttttagtagagatggggtttcaccatgttggccaggctggtcttagacttctgacatcatgattcgcccgccttggcctcccaaagtgccgggattacaggtgtgagccactgtgcccggccccaaataattttttagcctaagtgtggcccatccactatttgggacatacttaaactaaaaattatttgtttatctggaattcagatttaacagagcatcctgtatttttaagtctggccactctacaaatatctgtaccaattctcccattacaactttttacccacacggcagcatgttttggccaagaggaataaaagaggcttctcagatatttcctaaggccctgttttgacgaacttaaagagaaaatgccgacaggttaataggagattctgacaacgaagaggaattcctgtgattttaggggtagagatatatatcgacttcgatttgggagatcacttggtaaatgtgaggtgtctgtattttgggctgaatgtcaactctggaagtaggtaaaagttaagttttatatccacatgctattccacctccgttcaaaacttagaaaaatattgtcttccatacctaattcacagtcctaatgatcaggtattagctgaacagaacaaagaagcctgccttagaggatgttgtgaatgggttttggggatggagacttgagacacaatataaaaagatggtcagaccagttaagtatgacatgaggcagttttatgaaacgtaaaaatggctttttcatgcagctcagaggcatggatatagaaagggaaaaaccaaaaagaaatgatttgtgtatgtcagcccactaacatttttggaaatgtgcctgaggactaccgaagtaatcagatgacatggacttgccccttgaggaatttaatttatgggtgagaaatttgaaaagaaagtggcttatcctagcttttctttttttttttttccttttgtttcttccaaaaattttctcccaagggacagaagtgggtctgccacagctatggataggaataaccaagtgaagggaggcagtgacgtgggtacttccacatagaggctgcactctgatgattcaggaatatttcttgagtacccttttattttattttattttattttattattttgagacagggtcttgctctgttgcccaggctggactgcagtagtgcgacctttgctcactgtagcctcaacctctatggcccaagggatcctcccacctcagcctcaacaagtagctgagactacaggtgtgtgccaccatgcctggctaatttttctaatttttgtagatacggggtttcaccatgttgcctaggccaatctccaactcctggactcaagcagtccccctcccttggcctcccaaagtgctgggattacaggcatgagccactgagttgagtaccttttaggtggattgtcatcatatttgagtgcctagcatggtgttaggtgctggggatgtagcaacagtcagcaagggcagagtctcagtcagctctgtagagcttgtgtgctgtcatcataggtactttgagaaatgcaaaggtagaccaggtaggatagggaattctggcctctaggagcttccttagggttgattacctatgcttttccttctgtggcaattggagactcagtctgctgttggccagaatactggataactggcaggtaactctgcattgttaggaaggctgatcagacttcaggtcccccattgaggagttttacatctgaatcttcagcagctggtctaaactgacaatggcaggcttcagtaaaatcagccattcaatttatctatattataaaatgatgaaggcatgctccatctggtatcagatagagtaccttctaatattggtgcattatcagtacctttgtgtgtagggggtctgctgtaatgaaaaacagtagagctcgattcatcctaattacattttgagcaattttagggggctgaaaagattgtactgtgacaataaggtttttccttcttaccaaaagaatttataaatggtacagaaaatgaaagatggctagtggttttagcagttctaatgttttttctttttttagataaggaaaaaaaccccactctgattctaaaacccgctggaatttgaactgttgcctgtgttctgaaagtgtcttgaattgcttgggatcccaagcctgaagtttacagcatctcatggtgtccaggtatccaagaggagtcataaagttctccgaaaattgtgaaaaccatatacttaagggaccacacgcatgcagtggagtattcttcgatggcagcattttcttttgcgggaaatagcaaatcaggcagtaatgaggtgtaaggtcagaaaaactgcatagaaatcaatgactaggtgttcagagaagttaaaagaaattaataatttttcttctgtatgatttttgctttgggatattttggttattttttactggtttcggatgctattttaatgagtattttgtttatattttgtaggcccatgaatatgaaggataacttagattttaaaagttctttcttctattccccaagggctgatggacttaaaaatacctgtcagttgagccttcaaaatctttttattgacaagtgactcctgacttcaggcctaattggttcctgaatgtttagtcttggggcatggtcataacacaaactcttacttcctgcaggctgtgttatctgtaaagcttatgttttgttttttgtttgtttgtttgtttgtttgtttttgagacggagtctcgctctgtcgccaggctggagtgcagtagtgcaatctcggctcactgcaacctccacatcccaggttcaagctattctcctgcctcagcctcctgagtagctgggattacaggcgcacaccaccacgcccggctaattttttatttttagtagagacggggtttcaccatgttggtcaggctggtcttgaactcctgaccttgtgatccaccctccttagcctcccaaagttctgggattacagacgtgagccactgcgcccagccaaagcttgtgttatatattgggcttccattcctgaaagctggttttatactatacaaataacaaagtcaatatgaaaatgtgtcaaaaatatgaatgtacctcttaaatacacatattaactatttcaaacaaaagtactaaagataaaaaaaagttatactgtaaatgttactttcagggaatttttttctgctgaggttgagttgactgaagcttttaaagtccaatgttaagtctttctaaagcatatagaggtatttttttttccagtgtttcaaggtcttttaaattgtgttaaaaaacagagttatctgcttccaattctattgcatatgaaaagtgtagaaatgctgggaagtttgttaattgctaaaagttgaaggagggacagtttccatggcaacttcttcagtaacccatgctctgatatttcagaaggatattctttgctgagctgtgaatgcagtattaagaattcaatcaaatcttcagaatgtgaagagcaattgctaaagaaaatcattagccctgtgcacagttagaccaaacagctggctgggtctgggctgtcccgtattgagtcagccttacctgtccactaatcaaggcgttgccttctggacgtagtccttggtgagtctgctagccgtctggttttggtcatccctatgaaagtcttaggaaaggcagtaacaggttgagctgtctttgattgagttagattcatgactgaatatcattagggtgtattcctttaatctgtatgtgttgggaaatgatttgtgtgtctgaagaaagtaagcaacatataaattttgtctaaaaggccgcatttatgctgtaataattttctcgtttttcttttaaataaggggacaaaccagggcctgacattatcttgtaataacgagtactgagcatagaattttatgtgtccatgtctgtgccttcatgaattgtcagattctacagacatgacctgaaagggagatcttttatctcccatgttttcaaagatgaaacccatctacatgtgaatgagatgatataaaattattttcttcaaacatttttgggtacttacattttcttactgatcttctcgactagattttgtgctttgtagggttgtgcacgtataaagtactgaagtatttatggattttataatatgttgactcattttctggttgaatttatattttcaaaaattattaaattatattaaaggaagagaaacaatcatcttgcattattgctaatagtcaagtaaacatcaatctctaaatgagcgtgttaagtatagtacatatttgcttgcctagcactatgccatagggatcaaaaggaaatgtaggaaatgatgcctgcatcgtttaagttgcccagtctgattttataacctcttattcatagttgaaaagcaatatgacgtgaatttaattaggttttcatttaacaaggcagtctactccgtttttttcattcattctgttttctcgtgttagatggcatttctgatatttatagtctttggtcattcccctacccaggttttccaattttataaggtgtcatttctggagcaaggtataatttaacccttacctacccttaggacaccatatgatataaattaacttatcctgacttccataaccacagaagggaacctgcttggaggcagggtctcactgtcacccaggctagttctgaccagttaacttggttgggaaaatggggacatattgacggaagaaatccttttaaaaccagtcaagcctccagtaagtttcaagaaataggaagaaaaatgtagtgttcattacatgaatatgaaaatcatctatgattatgcctttctgatgtctgttcagaatctcaaggaggggagaagaaagaaaaaaaaaagcccccccgccccgccagctacagccttgacaactatcagaattgcacaggaggccaggcgtgtaatcccagtactttgggaggccgaggtgggtggattgcttgagcttgggtgttcaagaccagcttgggcaacatagcaaaaccctgtctctactatatatatgtgtatatatatatatataaaaattagtcgggtgtggcagtgtttgcctgtggtcccaactattcagaaggctgagatgggaggatcgcttgagcctgggaggtggaggttgcagtgagccaagatccgagctactgcactccaacctgggtgacagtgagaccccgcctccaaaaaaaaaaaaaatctgtatggtaacttcagttgggcctgcctctgctcacccgcccatctttaggaagccagtcttagaaagacagtggctggccagaggcctccctccccaacactcctttcccccaacactcctttttcaaacttctgtggttatggaagtcaggatttgaaaagagatttagcaatgtttttctcattctgtagtggttttctttttccggttgaagaggctatcctcttggccttcatgaagtaggttttaccacagcgttgaaagtgaagtattaaaatataagctgataagagcaaggaagtttaccagaaaaatttcagttcacatagggccaagtaggttattgagtcgtgcattctttttgagtggtaggaaatagaagagagccttggagaagcattttcttacctgactttagttcatctctgtttatctaagaaatttcaaatattccagtctaagagatttgaaattctgtcaaatttaaggagactgtctttcagtctctgaagtatagttatttaattgattaaaaggtattatagataaacaaaaatattttttatggatatgtgtatacatacagtggaatattattcagccttaaagaaggaaattgtagactgggcacggtggctcacacctataatcccagcactttgggaggctgaggcaggcagatcacgaggtcaagagattgagaccatcctggccaacatggtgaaaccccatctctacctaaatatgaaaattagctgggtgtggtggtgtgcgtctgtagtcccagctactcaggaggctgtaccccgtctctcctaaaaatacaaaaattagctggacatggcggtgtgcacctgtgttcccagctactcaggaggctgaggcaggagaatcccttgaacccgggaggcggaggttgcagtgagccgagatcgcaccacaatactccagcccggtgacagagcaagcccatctcaaaaaaaaaaaaaaaaaaaagaaggaaataatgctacaacacggatgaactttgaggacgttatactaagtgaaagaagccagccagaaacagaaagacaaatatttcatgattccatttatatgaggtacctagagtagtcaaattcatagaggcagaaagtacaatggcggctgccaggggctgagggagggggcaatagggagttagtgtttaatggacacagatttttagttttttgagatgaaaagagttctggagatgaatgtggtgatgattgcagaacaatgagtatatttaatgcaattgaactataggcttaaaaatggttaagagggcaaattttattttgtgtgtattttaccacagtttttaaaaatgtttattgagcacctgttctttggttccagttgagctccaatgactgaaacaaaggccctcagccttgagggagctgacaggtgagttagaggtgagcatgtgatgctgctggaatagggaacacaaggtcattgtcatggattaggatgctctggtcctcagtgcaggtgaacttgaacctagccatgaaaaagcaccagaaatggctctctttgtaattttcacttctccccagcttcccctcccaatatgtagtgctgccccactgctgcatcccaaagccaatgccgtggatcattttaaccggctgctgctttaactggtttgtcttctgctcttttcctaaatccagctctgctcctcctccttggtctgcacttgtaaggcctttatttgatgtgcatgtatctcccattttatagcccacatcatttttcatcttggactataaattcagagaagatgtgggctatgcactttgaccttcacagcacccagcacagtaaaccataatgaatgttttggatgaggatgaggctctgaagttggaagctgacatggctaatgcctatttaattgaaggttattaatgcctctttagcagtgaaggctagatagtcttctgtttacagcagagaaggaacaagccctcaagctttttccagtggtctcaaagaattctctgtcaggtgttgccccagtacacactgacctgaacttagcatcccggagaatgaaagggacagttggggcagtggggcagcttccccccgagaagacaagcgtcttctcctctgggttcatggttcccaggtgggaattcagggcgggggtaagtcagaatatttatgttctagttcagcttattaaatatgagattttccatctcttagtgaatagagtttgccttctgtccagcatgatagttctaagtagggcgaccatatgtcccagttttaatacctatttgcctggattaattattaatagctccccctttaagagtgccctggtttggatgataaatattattgctatccttgttacaagggggaacatatagagaggatagttatacaggggaaggtggggagaaagagggaggggaacttaggcaggctgctggagattcagaagataaggaatgtgagaaatagctgtgtagtcaaacatttagatgttttttggatggaaaaaattatttggcttttaaatgataagctagtctaataagttaggatttgaaagtcttgatcaaagggagattttattttatcagtcatagtataggatcttttagtgcaggttaacaggttaatgtgtatactcagagcttcaggtattttatggctaaagacaaaagactttaatgtacaaatatgtgtatatatctcacatttgtttctttaactatgaaaatgaacttagtctgtttaaaatcctgtttttatttgcatatgtatttaacttagataatggtgtaatggatattcaatattgattaaccttaggtatgaggaaaagccacattggtaatgaaggaaattaggtaggaccatattaattccttcatatttgttaagggaacatcatgtaatctgaacaaaataagtgttttataatcaggtgttattttggaatttttatattcaaagtttttgtttaaatcagtttgagctggttttcggtgaaggagttgtatcaatatcactttaaatcaatggaaagtctaaacatagggtgctctagggttgctccatcaagcagcccggcagtcttagccgcatcctgtgtctttccatttctctttggcgtccctggtgtgtgcttcagcctgagccaaatgctcaccttgctctggggaagccatcatatttgagtttttaaaaatcataacagtatgtgtatatgagtgtgtattataagtgcgtgttccttgtgtacttacaaataaatttataatttttcaaagttatctggcggtattgctttacattttgaaagagcattacagttttagaaatgactatttatgtcattggatcagcaaacaattttacaggatgcagaaattatcgattgtattctgtatgttagtgacttactcgagatgctagagctgtcagaatgaacttagactaaaacccaggtcttctgactctatgtccatcaccctacccatgatattgacttgtagatgtcttgcccagtaagtatatttcagaaagaatttttcttttacaattgcttttctgttttggtttaatttgatgttgtcctacagtattccttgttaggaaaaaaaaataacctcggtgcctttgggctaattggatgtgtacttacctatctgcaaagtgtacttactgatgcaaaattatcaccatcctaccggtataccttgatggtggtctcagttcaaacatccttttgacaactctgcctcagttgccgtctcagtacatttgtaccataggagcttttctgtctgtattctttacctcttgtccttcctgcttgctgactgtcttttctattctaacctccacttaaaagacttatgctcatccttcaagaactacctgaaatgctgccgcctcaatgatgttttctctgttcgttctagcgatcgctcttttctctcttgagttcctgtagtgccttgaatttctcttctggcccttatcataccctgctttacaccacagccatttgtctttattatattcctccctacaagattgtggtgagcttctcaagggcactggccatttctcattcatcttggtgtccccacagcactttgcacagtgccacatcccttggaaactctgcagttcattttgttttaaataaatgaatgggtttagacatggttacacccactcataagatatgaggtgattgtagatttttacagcatatggagattacagagaaccttatattggtataattatcacctggtttgtgcataattaaaaatgtaattgtatatttttatgcaataggttatcatgtactgttttaagtgtgtacagttttttatgggcctaccatttagttaaattgcatagatgctttttagaatgctactgtgaagaagtgcagagttgaggtcgtttttagaagctcagtgagttggccccttttgctctctgtattatccttttaggctaagctgcagcacagctgtcccacctgactagctttcctcctgtggctcttattgtcattgcattagctgagagaacaggttttaagatttttaactcttctctgcctagcctaggtttcagaaatattttagagggtttttagaaagtcgaaattcagtggataagacttttgatagttttcaggttctctttgttttatgtaaccttcggtttttaaaaatgtttacatttcactccattttcttctaatcctgtagatatgggactggcctaggatctggcgttttaaataatcttttcacttccccttcccccaacaaggtaattctgatgtcagggagacagggaaaaattcacctcgagaaacaccatgacaggtcagtattggggaatgaggacttgagatttgcctttcaaaatgagtaaggtttaagtggatggagaggagatgatttccttgtggaggtaagaaatggagcaaagtctaaggtgagaatgagcacgtaatattaggagagaaggagggcaaggaggatgctaaccagctttcagtggaagattattttagagcaatgttctcaaactgtgggtacattagaagtgtaccatgggcttgttaaatagccacattcctgccttccaccccgaccctgaaattgcttgtttgggcattctgtgggcttagggtggtggcctgggcgtcggcatttctaacagacatccagctgaacttggtgtgatggaatccctgctttatggaataaaagagggtctgctgacaaggcagcagggactgcattttggcagtccttactgtgttagatgaggtttcggagttaagatggggacactagaactctagctgggaaatcaggtgcagggatgctgcataatcccctgaggtgatgcgtgcagcgaggcaacagcagtcaggctctacagggtagaatttattctcagaagaaggtatagaccgctgacaaaggagttcactcctctgtaaactgttaaggaattgcaaagaaattttccatttgtaatctgctgacatattttagaaaggtagcctccttaatccacccctctaaagacctgatggtggtccctcacaggtatccaaagtagccttaaatcagagactggtctagttggaggatgtgacttggaatctatgaaccctggatgtacttgagggcaactcacttgaaactttggaatttcatgtggatgcatgttttctggagagaggtcctagagtcttgaccatattctcagacatgcccttacttggatttaggataagatgatttagtacttggctcattgggtggctggctttctctctcctctcttttttaaaaacccagaacaaattcctattagtgaaaaagaaacaatagcttgaagaacaaagaaggccccagaccataagatagaatgatagaagagccctagattttccaacagatgaccctccctttatttttgcttgggtgggtgtgccattattaataataagccaggggaataggggattgagaagctcttcgtagaatgtgtaatgaatttttctgttccttgtggagcagtttcagtggtttcagctgaagtacacagagagggctatgttaacagtaaggaggtgaattactagttattgctatcaagtttggagctggggagaaagcgggtgtatgaaacaggaccatgtgtgaatggatttctcaagtgtttcattaaagatccgtcagaacggttagcactctaaccatgcttcagtctctggcttctgattcctttgtggaattaaaaatgcttttgggaagaggggctaaacaagccttttgtctgaatttccatgtattgattaatggacccagcagagcatcctgctgtgaattctgtctgctgatggtaactcttacaatgagcaaagcttttctgaactggcattttccactcagcctgtaggctgctgtattgggtgtgacaattttttaaaagccatcatgctagaatgaaaatgagccatttctaaatggcctattgatttgcaaaacctttttgtgttggattgaatggtttcatatctcagctgagggaaaaagatgcaggctatttttaatttattgttattttatcttaaagatttgagttgacaacgttttggtcatgatgtttacctactgttgaaaggtctacttgcatgtcatgacttgataataaatgtaaaactctggttcattagcttacactataaaagagttctacagctccacttacagtgtgagccacagtcagtaaatatggatccagaagtcctaattatgactcaagctcacccataaacttggggaccaccttcgcaccaacgctgtccactgggctatttatggaagaagccactaggaactgttaggcggctccatgtgtctggctaacagggtctttattcattcacctcatcacggtattcagtcttgatgctagtgtgcacgcttcctaagaattacagatgggaataaaaggtgtctgggtatacctggggagtatatgtttttgcctgctgatataggatactagggtagcttgtatgcaaaagcatgagcgtctaggtttaaaggattctttttgttaatatctgagttgacttggtatggatccttgtttgatttttttttttttaaatttttatgtatgtatgtatttgcttttgagacagggtcttgctctgttgcccaggctggcatgcagtggcatgatcacagttcactgcagcctcgacctcctgctgctcaagtgatcctcccacctgagcctcccaagtagctggaactacaggcgcacaccaccacacctggctaattttgtttaattttttgtagagatggttttgctatgttgcccaggctggtctcaaactcctgggctcaggccatcctgcctgcctcagctttccaaagtgctgggattacaggcgtgagccaccacgccaagtccttgattgattttcttaaccccttgatggcagcttttgtagatgtttcttacttccaacaataataataatgataaataataaacatagttgaaatatctactatttgctaggtggagcaatttcagtggtctcaactgaagtagctgatttttgtaaaatgcagaaattaaaatcaaaatgaaaaacaggatggttttcccagcctctctgtacaattttgattagggtacagttacaggttgggcatcccaaacccaaaaatctgaaatgctccaaaattcaaaacttcttgagcactgacataatgcacaaaggaaatgctcacgggagcattttggatctcagattttcagatttgggattctcaactggtaagaataatgcatacatttcaaaatgtttccccagacatgaagggtcaaagagaaagttcattctaagagtcacagatgctttttgctgcagatagatgatatgattcatcttgacagagggattcttctctaatctgcagacaggagtgagcaaagtgccaccttttcacttgttttaaacctgtactttactccaacacttcagtatctcctttttctcttcttgaagtggcatgaatcttagggaaaggtgaggagctcctagaagtagctgtcaccagaaacgggccaatgaacttcctggtccaagtcttctgtttaaactcccagttttaacattgagcgtctgctttgcaatgaacatgaaacaaggaatttgcagcattgagggtcgtacgcttcactgacttgaggtcagtgttgctggtaagtaggcctatggcagtgaaaaagctttgaccccaattccgtgggggacagaacttcctagagcattctagaaaacagggtacacgtggagtagatgccatattcagtgcgattttgcagcataatgttgtgttgtggaaacttccctcttaccactgtgccccagtaaattgaactcgaaggtgcctctgtaccttttgtctcttgtataggaaattatatctgtcagaaacatttcttaggtaatctgagtataggaatctaaaaactgagtactcttgtactaaaatgagacaccagtttctcaggaaaacttaaggaaagcatgttatttaaaaacaattttgaatatttctaaactttctcctttgcatttttttctccaaccagaggccttggcttagataaaataaactaataaaatctttttttcttttcttgtttcctgttgttgaatgacaacctccctgagcagcctggtggcttggaggctctgatgtgaagtatagaataggtggagggcgaataacaaaagccttatcatgtagatagccctgaaatgggaccacagtctttatctttgagaactgtccagtgactgctgcaaactgggcagctcttttggaaatgagcagtctctgatacagctggtaggtagaaccaatttggcccctaataggctaactggagccagtagtttaagggggtgattattaatttgccttgtgtttgtcttcatttagagtaagttcatcaggctatgttttcatggtaccttgcatcaaggaaaatgtggttctgtaagtcttcatatcagtttctcttcgagagtaggagtaataatgcatatatgtttgcatatttccaaatgcctttgtttagggactcaataagtatttactattaaatttgattttttagttgaataaacatgttttaaacaaaaattatttcctaattttgactcagagcctagaaactgttataatgtgtggcatatacacttcttttttggctaagagtagagttagaatctactttctaattcatccattttgaacgttgaacctgaaatccagctcatctttaagattgttgtatctgctaggtttggaattttaaacttggaattttggggtctccttggtggtgtatagtacttccagatatagacagcatagatgggtctcttagctcatctgaaaatgggagctcaaaattttttcaaagatctcatatttacaaatgaataagtataatgtaaaatgcaaaaatgaaaatcaaaatgaaaacagggtggttttcctagcctctcactaggattttgattaaaatacagttacaggttggggttccaaaaatccaaaaatctgaaatgctccagaattcaaaactttttgagcactgacgtgacacacaaagaaatgctcacgggagcattttgggtcttggattttcagatttgagattctcagctggtgaggataatgcaaatattggaaaatgtgaaaaaatatgaaatccaacacacttcttgtccaaagcattttggataagggacactcaacccgtttaatccaagcacttggtggagaatgttgacagtcactttcagaggtagacaaattccactggcaagtttaatgactgatggtattattattgttaactcacacttgtgtcaaaggtgcttgtgacatagggagttttgctctctccagcatgtccattgacttgagctggttcccgctcaacacacagacctcagggccctggggaaataacttaggcagcccaaacaagacccctgacctctgctgtataggcagatttcattagcaaatcagaaatgttctatttaaagtatattacagtgattcattgtagattaactcacaaatcaagacagaccagtgcccttttgtgattatttttcatcagcctcaggagcctctagaagcctcctgtggaggtctcacgcatggggtgacaggagtcaaagtgcttcctgctgatgggtgtcctgatttttttctaggtctaatagtatcagctgtgggttccttcctgtagtctttgtgatcatctgactggcaaggtctccaggtatccacagctcacaagttactattggcgagggcttggaacttgcctcctgcccagccagtgatagcatgttcatgcaagtccccactggccagcagggctgctggaatagtagatggctctccctggggagttctgcctggttcaagcatcattaccgtggggaggatttctttgacccacacctagtctaggcaggtggtgcaagtgcagagacacctgtcacagccttgctgtgggttgcatcacattcctcctaaaagctccaagaagttcacttctcactcactaagtgggattgagagaaaacctgcctgtagttacaattttcctaatcgaaactcacctcttttcagtaggacagtacaaaacaggctactttctcagtaaataattactaataactaacactgatatactgcctgtttactatgtgccaagtacctattccaagcattctgtgtattttaagtcattgaatcctcccagcaatctcatgagacaggtatactattattagccctagtttacaggcgaagaaaccggagacagagcagttcagtaacttgtccaaggtctccagtccagtggaacctggaataactcatccagctccaaggcccacctcctcacctgtcatgcctctcatcaccaaatgcaagctagtttcagggtggttaattttggagctgatgagctttacaggtgattgaatttaatcatttatgagagtaggcaggtaggatatgccaagaaagagatcttactcagtaagtttggcaggcctccatattttgggcctttctttgcttccccctgtgatcccaatgaacttgggtaccaagtcttcttgttcccattacccttttcttggaatagattttctcagataatctccatctttctcccaatctcctcttccttcttcctttttcttaaacaggatgagcctgtttactgctgggggcagggtatgtatccccatgagtcaggggcttgattggtaggggaggtgagtgttcatgctgcgtccctagacatcttgaatgtcccccaatttgagcaagtaacacatcacttagttctgcaacagaaccagccacacattggtgtgtgtttggcttgcctctgatttgatgttgctcttttctcacgaggcttggacaaaactcctgctttactcaaatcttgtttgagttaatatctcagcctccaggtgaaatgaggaatgaaatacagattttagtatctaatataaaaccataacttgtttttactctgagctccatcttgggactatattctatccagaggccctgaggaacttctctccctcctttgttttgatttattaaagttcttgaattatatcccatgttattgatctcagcaaatgtgggtttcaaaattgagagagaagtaaatcgtgctgtgttgttactgtgcgtttggctgaattctgttcaacctctaaaggaaaggaaatatatcatgctgcagtcttttaacataaaatcagtttacactttgccattctaaaaaattgatcagttcaatacatttgataagtgccgcaagtaaggatttactctgattcagtatcattgtcaagtcctaaattttacttaaatttttttaacttacaagctgtcttcctctaaatttaggatggaaggggacaaagaagtttttagatttttgtcactgatttatagcatgtaattaaggtcattttgtactattttgaagctccattttgtttcttggttatgttgttcttagaaggaatactttaaaattgttgagtgtatttagttaatgtttcatataaaatggtatctacttcccctcccccaggttaggagactctgaatgatgaaattcctctgaattatcttgaagtatcttcttagaaagtaatgtttctccaattcattaagctactaagagttttctggtattgaatgaaaaagaattgtaggtatttcaggaattcctgaatagctgttttataaccagactgatgaaaagaaagccattttagatgtggggttgtatgtaataaaagtttcaaattttaaaaataacacagaaatctgacatttattttagaaagtgccttttttacattgagggagaaattaccgaaaggcataaaataagttttatctgataaatatttaaaatagaaatgtgtctgtgaggtataactttttaaaagactcaacccccacaaaccagtatttctgttgatattaattttagaaaagattaattacaagtattcaattttgatgctgatctataaaatatatattctaattatgcaggctctatgtgaaaatgcattcttattggattttaatattgttttattttgattttaaaaataattttgaagatacctacagcatattgtaagtataaatggctcagaagttaatacattttaagatacattttcagaaaattacaggttttttttttttttcttttaagtccacaactaagtttgattgctttaatatcttcctcttaggaagagataagggtaatgggaagttgtagagataagctaaacttataccaacactagtttgagagccattcgattttttttttcttgctattttttggcaacaagaaccgcacacaccagtagcagagtagataatacaaccatttatcaaccttaaagaaccacaagtgttattctttatgctttattactttgcttcagaatattgcctttagactgtgaaattgtacccctgtttatttacgatttttatttaaagatttttttttttgttttggagacaggatctcactccagttgcccaggctggagtacactggcacaatctcggctcactgcagcctttacctcctgggctcaggtgattctcccacctcagcctcccaagtaactgggactttaggcatgccatgcccaaccagtttttttgttgtttgctttttgttttggtatttttagtagagacggggtttcaccatgttgcccaggctagtcttgaactcctggaatcaaacaatctgccttgcttcagcctcccaaagtgttggggttacaggtgtgagctactgtacccggcctaattttatataaagattcttaatctgtctgtctggtttggacttaagctctctgtataataaagtaattgataagatgatatgcagttctggatttatgccagatacatgttttataagaaattttacatggtaattacttaaaatataagattctggtgtattgaaatacgtatttgagtagcctgccattttaaagttataatgcaagttaacttctaaattttaataaaattttgagttttgtgaataccgttttcttcagcaaagctcaagtattaggctattcgtgtaaaactattatatctttgggcacatgtttcttaatatgattttaaaaggaaaaaaagtaggttttaagcaggtcatggtttatgttccagcatttagttaaaaaaaaaagacctctaatcttataatgctgttaatttgctgaacactttatctttgcagatcaatttcacatacttttatctggttcatttttcacagccttgctccgagtgaggtgttcttatcatcagttgacaatgatgggacagagatggctcaaggatgttgggcacccaggggtggttgaactggcagttacgacttgatccaggttatctgatttgggatccagtctgctttctcctaggtcacagaagccttttgattttgtttttcttcttttttaatgttaagacaggtaactgactagggctgcaggtctggcggctgcttgttttgggttggtcttcaaaccctgttgttccctgacatcctgccttcagcacaggttgctgtacagcttttcctgtgggcccagctcctccctccaggggcctttctttgcagaagctgctctttctgcctggaactctgttccctttccttgtttctcttcctttccttcttcgaatttaagcctaattaccctccacgtcagcgcttcctcccaccttccccactgtatactctccaaactccatccacttccctctgcttggaactctttttctgcagtgtatttttgtggcacttgagtggctttgtccttagactaagttctgggaggatgggatcttttgccagttttttacccattgtattctcagccttagcaggatgcctcatacttaagaggtacccacatatttaggtggatggatggatggatgaaagaatgaataatgccgattctttcattatatggactttgtttcctttcttagaccattggaatcagctgatcgtctagcacttggctagatttgaacaaattaggaatcctatgttctgtttagttccaactccaatcaattaaccaatatttattgagtgagaggcagaatgtgaagcgctgtatctctgttgtcttctctgtttctctctcttagcattttttcatgtttacagagcatcaagcatgattcaagtagttgctggaagccgccaggtcaaagtgtgcagagaacaaataccagtatgaggggagctacataaacatatgcacacatattaaacataagctatgtcatctgtagaatttaataaactaggctagatttaaaatctttccctttgatgtgtaatacgtcatggttttgaacattttcagaaaatggggccacttctcagttactccagataaaacttactcttcaaatatgacagcattttcttcaccaatgtattttcttcactcatttttcaaaatccctttattgaccctgggtgccagatgagtgcaagttggggcacccatacaaacccacattttaaacttctttgtttgtttcagggaaggtttgaaatagtgtaaattttctcttagtccaagaataggctatttccagcctgagctatagtaccttgttaaactcagtgaaagctacacctttcaacttcgtaagcttggttgccaaaatgtagttcgtttggaatgaattattagaatatcacacacacacacacacacacatacacacacacacacacacattcaaatgtgattatctactggaaagtcagtagataaatcagttgactagaaagtttatggtttggattatttttgtaatgttatttcatatttcccacccttatattcccctctttgggaatgataatttgagaagttagctatgtattagccttagtaagaaactgtattatgtttatcagagaatgaaacgaaacaaattattcctcctcttttagctactcccctcccccgccccacacacttttaaccagttttaggattttattaattaaatactttgccacatgtctggtcagttggtgtctttgtataagaatggtaccacttcctggtaccaaaacagagatatagatcaatggaacagaacagagccctcagaaataacgccgcatatctacaactatctgatctttgacaaacctgacaaaaacaagaaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattgaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaaggcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatgcccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccttaaaaaatgatgagttcatgtcctttgtagggacatggatgaaattggaaatcatcattctcagtaaactatcgcaagaacaaaaaaccaaacaccgcatattctcactcataggtgggaactgaacaatgagatcacatggtcacaggaaggggaatatcacactctggggactgtggtggggtggggggagtggggagggttagcactgggagatatacctaatggtagatgacgagttagtgggtgcagcgcaccagcatggcacatgtatacatatgtaactaacctgcacaatatgcacatggaccctaaaacttaaagtataataataaaaaaaaaagaatggtaccacttcttgctgaacagtatttttatctctttgatgactttcccttgaaccaagaacacactgttttgtagcaggaagatcctataactctatgctgagtatttttgttttttaaaagaagatacataagtactggaggaacacagtgcgttaaacttatcctgaggatagatgttagggtgtgtctaacccatgtctacatttagggtactttgtaaataaagcccataattggtacacatgagtagttagagcagttctaattgcatgaaacctgtctgagagaaggattcattctgttcttggtggttgagaagattataagtgtagggtagagctgtgtgtcatttagaaatgttttgctagggttcagacatgctgcttttctggtgagtggatatagggtgagaggaaaggagctggatttgccctgattcttgggaaaggagagggggttggggattctggctcagggtcgggggttctggctcagagtttgggcattgggagcaatgattaagcagaggagttggcttatggtgttttgtggcgtgcagctgataggccttcatggataggtatgtttcctgtgtagatggtggtcttcagttacagccttgccatggaggaaatctttttaaggtaaacatacaacacagaatttctgaatttcaccgtctgagatagtcttaaggttctcataactaaatgtctatacctagtaagtgcttagaaatatttgttgaataaatgaatggatgtgatttttaaatgaaatgtctctataaattgatatctgtttctgaagcatcttaatgaatcaaagctttggagcaccaattctttccattgtaatcccaacactttgggaggctgaggtgggcagatcatgaggtcagccccaaagaggggaatataagggtgggaaatattaaataacattacaaaaataatccaaaccataaactttctagtcaactgacttatctactgactttccagtagataatcacatttgaatatgtgtgtgtgtgtgtgtctaataattcattccaaacaaactcacagatcatgaatgtaatagtaaactaagtgatgcacggtagtaaagaacctcaatgaaaaatcttaatgcaaatattattttaaaagtcacatttaatttccagattatttcatggattgccagtggaggagctggcttatttttagactgtttttacatgacttaatgtaattggtgagtaattttctgcacagtaatttaatgagtaagtcatctactttatgctcagtctgggctgggtgcttgctctctgggatctccctaaggagtactggtggaaatgaggttgccatatttgacacaagggccgatggtggctgtgtggggtgtgatgacatgagacaagagtgtcaaggcttgaatgtccaaggaggtaaaacttgaggtgaggcttgaaagatttcagattttaacagtgagaggagaaaggaaggaattgctagataatcttcactaacttggagattgaatagtgaagagggtgaccgaccttgttggaggttgtctgttgttaaaaggtggaaatgacatgatgttgtggggccaggcagaggaattgggatttactaaagtaagtagtaataggaaatcactgcagatttctgaagagaagagtgaaactgcagtttaaagaagcttgacttgctatgttcatgagtacttctcatgacactggtataatttgctgcttatatagccatataccagatactgcctccagtaggttttgcttccttccctttttagtggattaccagtgacgatttagtgattcaacctttgtaaatatcaagttttgttttgagttttatacctctgtgagttatagagtgcaagtaggtcttgtagtctccattctctaagaagggaaatgaaactcaagaattcttcagcagaattctaaccaagtgtggaatccatccaggaatagtaagccagcttttctcttccacttactactgaacttcctaatgtgaaatgaattgtctgttttggaacaaaacacctaggctaaatttacatttttgagtttgtattcttgataatttgatcttaaaatgacaaaatatcaataattcatttgcctccttaattgtcaactgattttttaatagctgtaaaatgtaatttacataccattcatccatttaaaaagtgtccaattcaatggtttttagcatatttagagttgtggaaccatcactacaatcaattttagaactttttcatcacctccctgaaaaacctgtgtccattagcagtcacccctacccctaccctgtcattctcaaccctttccagtcctaggctatcactaatctaatttttgtctctatagttcaattggtatctttctaaactagtattttacaaaatgttactctggattttgttatcagaagatggtttcagcctcagcttgctagtactatgaccttgagaaaatttcttaactttgtgaaatttatccccatatctgtagaacatgaatagtcatatcttcacagattattttgacgattaaaggatatttatgtgaaagtgtattaagtgctatatgagttaactgttctaccaaagatatgtaactgaattattttattaaatggtctcattttaatcttttaaaatagttggtggaacataataaaacacataataaatgtttggataggaaaggatggagttttatgtttttaaggcgatggttttattatgtatgtgattttatggtttgacttttaagatggaaggagtttttctgaatttccctggagaacttaatatagttgtacttatattatttttggatcattaaaccctttgagaatctaaggaaagctatgtacatatacttgattttccaaaaaaaaaaaatcaagaggttcatggatctttaaaactatttacacagtccctaataccaggttaagagcccctttatctaaaaagagagatatgccgggcgtgatggctcacgcttgtaatcccaacactttgggaggctgaggtggacgggtcacttgaggtcaggagttcgagaccagcctggccaacatggtgaaaccccatctctactaaaaatacaaaaattagctgggcatagtggcacgcctgtaatcccagctgctcaggaggctgaggcatgagaatcacttgaacccaggaggcggaggttgcaatgagccgagatggcaccactgcactccagcctgggcaacaaagcaagatgctgtctcaaaataataataataatcataataataattaaaagagagacaaaataattcttcaaagccgggccaagtgattccacacattgggaggaagacacagccaatcagcccaaggtatgtttatttactgtccaattttcagtatgttctgttgttcatataaaagtatactcagtatatgcttgctcaagcaagggggattttcttctagctatgagattgtaaatacactatacatagagaagacatgaagacagctcttgaagacaaagctgaggggaggaagaacaggcagccagagtgcctttcatactgtagcaatactctttgggctgcacattttagagcgcttgtataaacaagcattggattcccaaaggccctaggggaatgctgtacaggttgtgtggggcggcctgattgagtttattctccagatggctattactcacaggccacttaataaccactgttgtttatttcattgttgttagatggcccaacagtacagcatccctcagtccatgtaacaaaaatgttcttaccatgtctaaaaagcaaatttcttccttaccaagtctattcccagttgcttcccttaatttgagatgtattattgtggaagaatttggataccagtagtgaaagaatccagctgagaacaaaactcagaggtgctggaaaggggagaaaagaaatgccagttaatggaatggctggatggtcctatcaggtaagagggcagaccacttgccacacaacctttggataacagtcctttgtcaggcatggggtttttgtttgtttgttttgtttttccaaatattttttcctagtctgtgacttgtcttctcatcctcttgacagtgtctttcccagagaagtttttaattataatgcagtctagcttatcaattatttctcctgtggatcatgtgtttggtgttgcatttcaaaagtcatcgccatactcaaggtcattttgatttcccccccattgatcttctaggcattttgtagtttgcctgttacatgtaggtctgtgatccattttgagttaatttttgtgaagagtttttaagatctatgtctagattcattttgtttttgcatgtggatgtcccattgttccagctctatttgttgaaaagacagtcctttctccattgtattgcctttgctcctttgtcaaagatcagtttcctgtatttatgtgggtcttttcaggtccacagcctttcagtgacttaatgctgaaaagaggtggcatctttccctggggctgcctcccctgcttgcccatggcaggatttctgaaggccacagtcagcctgggaagttaggatgccagggagttggcatggagtccctgtgggacttggtagctctggggggcttctgaggaagagactcattgttactggagtgaacgtcagaagctctgcattggtggattagtgagtcctttcctcattttctcctcttgtgcaggcttcttgttcctaatgcactcattctaactgatgagataattacagcaaaattttgtatagctactagaaccaggaattccgtcgacacaattagaattggtaatccttaccttcaaatcttcattctagtgaaacctaaaataaaattagcattgctttcaagcagagcttttgtgcttaaattgccccatttctgttccatatcttaaggctgacctccattccagatttcccatttggggacttggatggttctcctgtggagccaaggtgaatttagtgacaggttagtgactctggtgggggacatgtttgcagtagagctccactcttttttttttcctttcctgacaatatttcctaacttttcgccttcagactatcattttgacgcacatcacccctaatttgttttcgtggctctgtactcctttctctccaattactgttccattgttacagctacctgaaagacattttcccttgacacacgctgtccgtatctcagacacctcagcgaggtgactgtgttgccaagtcttgtcaaaggttccaattttgaaaccttataaatctctcccttgcctgtattcagccttgctgggatcagctgtcttgacagccttccatctggctttcctagcccttcctagcccaccattctaacggccttacttcctgcctccaaaattttcaagagctcccaattttcagggagagtgcgggcttcctaggctagcactcagtgtcttgaatttcctggcttttacataactgtcatctttaattctagcacatcctctcatgctctttgctacctaactaagctgagtgctctcccttccttccatttcctataaatatcttgtacttttccacttttatgtctttgttctcagacttctaagccagtggtcctcaaacttaggaatgtatcagactccacatggaggccttgttatagcagggaacacggggcccaactcccagagtttctgattcattaggtctggggtggggcctgagaatttgagatgctgccggccccagggactgcaccttgagaaccactcttctaaacagttctctaattctaatacgttttggttaaaagaaacatcgaattcattggaggccattggttattcagatctgtgcattggattttacatccaacagtgctaaaattgtgttttgaacataaatgcattttgagctcctgcttggtgccagctgacaggccctttgtccataaaactactgatgaattgaaggttatacttctgtttcctctctgcatgttgggtgaggacacttacatatttagctgtgagccactggcggctacactctgtcattacagaccaacaggccctacagccagtcagctgccaattaacaaactacaggcttgtattctgcaggcagtttagccaagggatgccagcatctctgttgttcctgccgttaccaggcctaggcattgtcttgcagcttggtaactccacctttctaaagactcaggtgtccccagttgtactggtaaaaggttttgcattttagtgttatggttaaatttgggaattaaaaaaatgtaggaatcattcctttgtctcattcacagtgtaattgtcaaccacctgtatcattagtgttggcggggaaaggaggggtgaggagtcactgtggccatggatacatgtcatctgtccaggcctatagcctattaaaggcacttgatttgagtactttcaactttgcagggggatgggatgtccaagggtgaatgtgatttgagtagggcatctggaactttttagaagataatcagtacctaatagattttttaccgcatagatttttcacttctcattgcacttgcattttgctggtgtagaatgcaggccttgaccgtagagttgtgtgggttgcacgtggattagcctcacacagagaggtaaagggtctctaatttaatggacctttgtgaaggattctaaagtaaaagtgtacagagtgctttctgattggcgaatgtacctatgatacgttttatttgggcgtattttcttgttttccttacacacctgtagacttctgatatctgacatgaaataaaactttccaagaaaatacctcaagattccaggttttttcctacagttcagcttacacgtgttatcacatcccataggtaagtgatgaagtctgccgtgccagtgctttgggaaagcaccctgcccaccgttttgggagttgaactttgtgattgtttagaataccagcttttaattgtttgttgttaaattttagtcaatctctgtacattcttcactttgcttcataaactttgataagttagcaatgggatatccctttctgcctaggtatatttattctttaaaaaatgtacattgaggaagggaaagtaatttttaggaaaattacagtgtggtaagcatactgatcactgagaccatcctaaatttgatttttttttttttttgttgagatggggagtgttgctctgtcgccaggctggagtgcagtgtacgatctcggctcactgcaacctccgcctcccgggttcaagcaattcccctgcctcagcctcccgagtagctgggactacaggcgtgcgccaccacacccagctaattttgtttgtattttagtagagacagggtttcaccatgttggccgggatggtctcgatctcctgacctcgtgatctgcccgcctcagcctcccaaagtgctgagattacaggcgtgagccaccgcacccaacccctaaatctgatttaatctttgattcagaagatatctcagagtcttacaggatccatgtacatcttcattttttttcctccatgttgaaatgaatttagtttgagttttaacttaatagggttttggatagaataaatctatatgtatatgtattaggatagagacataataggaagtgtggtgttgggagacagagaattgaaaatctgggaccctagcaacagttgcttcaataactatagtactgaatgtgtggcctttatatctgtgtctcagttttccccgactccagtcatacctgcattacacatagtttgggaaagactgccttccctctgcaaagtccatctgattggaaaggctgggtagataactgcaataaagagattgaatgtaacggcgttcctcctggggatgggaggtgaaggattcagggataggcagtagagtgatcaaagacctggaagttgtagaattcagagttctgcagccagttgacatagctgccttgttaccccacagaagattcatattgttagtgaaaaatatgccaccgagaagacctgggcttgagtcttgcttctttcctgccctgtacaccacgtaccagctgtgtgatcttggggaggaccttagatgaagtccttttcccatctgtaaaatgttggtgatgaccaccatctggtcttcctcacatgggcacagtgagcactcactggaatagtgttcttcctgtcatagatgtaaagcagcaaactgaaagttctggtggtttatcatgattattatacttgttggctgactttctcatgggcttcttagatgtttctcttaaaggcagaattttaatttaaaaatgcatattatgtaagaatattgtagttgactttgagaattcatgaactgaaacacttaaactctctcaggacctctaaatatttcttgactatttcagagcatttgatttgtcctaatgctatggagttataaaaccattaatggtatgatagctctggaaacaaacattaattcatttgaattcattagaatgataaagcatattgtgcaggggttttcaggcattcagttcataactatcgaaatgtggatcataacaaattttgtttgggtgtgttttcatgtctaaagaggatcttatcataactctcatacttattagttttatgtgaaatacaactagcaagcatatatacataacaaaggaaattgcagattgtagtttctctgagattgatctattttattaaattatttttattaaataattttttattttatttttatatttattttattattattaattttttgttataattaagtcattctgaccttataatttgagaagcatgtgccctgttttcatgctttagttttattgtaagcatctatatttagggaggggggtgtggttatgtgtttgtatatgtatgttcaagtatatctttatttttattttatttttgagacagagtcacactctgttgcccaggctggagtgcattggcatgatctcggctcgttgcaacctttgcctctcaagttcaagcgattctctttcctcagcctcccaggtagctgggattacaggcagcaatcaccacgcccggctaatttttgtatttttagtagagatggggtttcgccatgttggccaggctggcctggaactcctcacctcaagtgatccacctgcctcggcttcccaaagtgttgggattacaggcgtgagccactgcgtctggcctatatctttattttttaaagtttacaaggtgatagtttattagtaagcgttcatgccaataacagtttctgttcaaatgtagttaaagcctgacttgaagaattctggtagcgaaaggggaagatttcatacctcttaattgcaatttgaacagaaagtggcatcttatagaagtcttaattttggcatgttttgccattaaaaattttttgaatttcaatagctttagggatacatggtttttggttatatgaattaatcgtgtgtgacgaagtctaggattttagtgcatttgtcacctgaatagtgtccattgtacccaataggtagtttttcatccctcaccctcttctcttccccactctgagtctccagtgtccaccttaccattcagtatgcctttgcacacccgtagcttagctcccacttaagagtaagaacatgtggtatttggtttttgatttctgagttacttcattagaatagtggcccccagttccatccaagttgctgcaaaagacattattttgctcttgttctgccatttttaatctgattaagaatcataagaataatttcgttgtcatagatatttttttgctaaacttatttttatcataaacacctaattattcacccatagtctgagaggtggagtggagtaacacctccgttgagcacctccgttgagcacagtgccaggcactcttagacaatgtgcaggcagttattataactcctgtagaatgcaatggctttatcctcactttttggaagaggaaactccttcaaagtgttgctgtcatttgaacccaggtctgctgcacactagaaggtccgtattttctcccatgcttttgtatagaggcataattactggctctttaccctagtgtatggcagtaaaacaaattcttgcgttttagcatcagtaaacttaaaggagaattgcctcaattttctttgccttctgttacaaagttataggagggttaagctaagtacaccctctttctccagcaaagcctgcgggttttcctctcttcctcagaagttcttaattactgttggcacatcttgtggtgaaagaatataccttgtgggggtggaaaatgaaatgttatctgtaatgagtaagattgttggccaacccaaagagttggtttaaacaaaagtggggaacagcttgaatgaatctgcttttcataggtacttttaacacataaccataacctgtcagacataccaatcgactgtcagttgcttacatgattgttttagtgtctggtggtggagccccaaagctctgtctgtatttgccagacaggcatggtagttggagcgatgtatgtggtcaaagaggtccaaaaacttgcctaagtgaaaacctggaaatggagctcttggttggagttcttgatttataggtagaaataaataccacagaaacagtgccaccctttcttgtatctgcaggtttggagattgtgaactgattaaataactgtaaattgagcatgggtgtgctgaacccagagctggttagtgcagccctgtctaggacataattcaggccaccattttagaagtatgggtctttagtcctaagagaaactaggggaaaagtgaattcattcaataaacatgtattgcttcatggtagggaaacaggtaaatggggaactgttcatctatttgggataggcagatgtaacccagagtgcaatgcaggtgagcagtgtgaagagtaaggaaaagtcactgggtgtcagggaagggaaattacacatggctgctgcttggataagaatggtagataagatagaatgtagaatgctcactgcttcctcctccttgtttttgtgtttgtttttgaaacaaggtcttgctgttttccccaggctagagtacagtggcacaattatggctcactgcagccttgaactcctaggctcaagtgatcctcctctcagcctcccgagtagctaggactgcaggtgcacaccaacacgtccggataatttttaaaatgttttgtagagacagggtctcactacgttgctcaggctggtgttgaactcccggcctcgagccatccttccaccttggccttccaaagtgttgggattacaggcatgagccaccactctcagcctcttcctttttcttatactctcagcctagatatcctttcctccatgaaatgccttccctgactttcaccccagttctaggttaggttctcttactgggccagtgtagagtacagtacaccacacttagcagagtatctacctcctggattaccacagctcttatctctctcctacctgactctaagctcctgtaagagcaagagccttatagagacagtccccagtacatagtaggtacttaaatatttgctaaatgaactaaaatgaagctgtaaaagttggagtccaattgtggagagccttgtaataatactagatgatatttattgagtgcttactatgttttaggcactgtaaaggtacgtggcatatattaactcatttaatttttcagtaacctataaagtaggtaccattgttaatccattttctagttgaagaacctgaggcatgggaagttgggtgtcttctcaaaggtcgttcactttgctccctgcttctggctcctcctgtactgctgggaaatttagagtggctcctggaggcggtggggactgttagtgctataaggggcccggaggtgtgagcacatgtgctctctgggaaaggagtcctgacattgtatgtagatggactacaggaaggggagtcgcttgaagcagtccagagtcacctctgaaatggcaatgcaaaatatattcgtgtgatttgttgatctaacacgcaggatgctaagtgctaggcattgttgaaagtgccttaaatgttaactgatttaatgcttttggcagctgcttgaggtaggcactatcactatcctctccattttatagatgatgagcctgaggtgcagagagatcccgcagctggtaagtggcagagccaggcaagtctggtgccagggtttcagcgactatcccaagctctgcttagtcttcctgtacaaagggaacgataactagtagtctccagtgatgtttttgttccagatagtacaggatcaaagtgatattttggagacagatccttccattttcaaaagcatctgccttaaagacatttgtctagaaatatttatatgattgtatcacacttaatatgtgcttggcttagagcaggcaaaaacaaaaaacaaaaaacccaaagacacaggtcctgcccttggggaactcatactctgctaaggggagatagagaagtatgtagacttacaaagaaaaaaataatttcggctgagaaaggcaaatgaagaaaataaaacaagccaatgaaagagacctgtgcattccactgtgatagccacgaggtgcatgtgtccattgagtacttgaaacatggtcagtcaaaattgagaaatgctctaagggtgaagtacacactggaattcaaacttagtatgaaaaaaatatataaaatatctcaataatttttacattgattatattttaagtgttcatacgttgggttaaatagagcatgttattaaaatgaatgctaagtgaaataagctaggcataaaaggacacttttattgcacttatgaggtaactggaatagtcaagttcatggaggcagaaattagaacagtggttaccgggggaagggagaatagggagttactgtttaatgggtagagtttcagtttgggatgatgaaaggtctagagatggatgtggtaatggttgcacaacggtgtgacgatactgaatgccgctgaactatacacttgaaactagttcaaatggcaaattttaggtatattttactacaactttaaaaagccaaaaaatatgtgtcacacttttaaaaaatgtgactactagaaaattttaaattgcacacgtggcttgcgtcatacttctgttggagtgtgctgggtagagagtaatgggtaagatggtcaggaaaggcctctttggagagggtcacatttgtgtcctatgaaatgagagggaactgaccacacaaaaggcttgagggaagcatttcaggcagaggcagagcggctgcaaaggccctggagtggggaaagtgtgtatgcttagggaggtgggatgaagttaggatggaaaggggcaggtccccgatcaccggggtcttatgggcttgaataccactgctctgcataaaacttgaaaatagaaacaaagcaataaaaaactcaaatttccatacagattaaaccatgcgaaattgctggtattctgacctatttatatgattcagcctaatcttgtgtttgtggttctggggtttgattctttccctagtgatgtacttgtttggctagcagagaaggcactgccttgctttctaattatttgctaattggtgggtaccctaaagacagcaccccctcttgctggcttacataccactttgcctgacaacaaatttgtgttgaaacggaaggaaacccagctgctcacaaactaaaactgtcacaagtaataaaaaatcctgaagacagtaccttgaacattttctatttcataaactttgtctttgtcagcttggtggcttttggaacccagagggagcaataatagtatcattagcgcctttggatcctggcgctgtgaagtcactgggagcatttattattattgcacaggtagacttttctttctggaaaggtcttggctcaggacaagtaaattgaagggttggctttctcagtagggaagggttgttaggaaggtaaattggggtttgtttatccttctgttaaaggccatcagtgctggctcaagcagtctcgtggaggctgctgccaccctgttttttttcccaagtccaccttggtggcctcattgtgtgttactactgcttttcctggagcagggggtctgggacaatgagaggcaaccctacaggaggtgctgcagaatgaattgttttcttagtggtttttgactccagaacccctggtggaaaatgtttgttcatattaaaggagaagatggttaatacctaaaatctttcatcttatggaaagtttttttgggctttgaaacatctctggccacctgctgaggaccagtgagtctggcaagtggtaatgcccactgcctgtgcactggtcttttgtggaggagttctgtgccacatttgaactccccagtcaaatggttctagtggtgtctcaggtggtatgaagcagagaggtgcctgcattcggttctccaggctggcccaagtttaaaagttgactgggtactttgtgctcccttgggatggctagatatttcctcataacctaggtgctgtgtaagctaatttgttaaaaaaaacaacaaaggccccatgttatgtaattattgatatctgaaccacaaaccagaaatctgtgcccagaaaccatcccacaatttctagatttccacccctgcacatatcgtggtccatttctataggatcactgttggtgtcatctttgtttatttactgtccaattttcaactgctataagtcattaactacattagttgaatactttcttaccccaaggaattccttattgcagtaggtttatatgaaggtggggttagctttagacttagctgcagagtcttcatttatttttcagtcctaatcagctttatttgtttattttgttttgttcatgtcaggattggtcagattgttgtgaccaccagcttagttatgacacggaccaggaaaactgtgtgacctccccagagctggcttgagctacaggaataagcactttcttaatgtggggccttgcctgcctgaaagatcagatgcatctgcataaatataaataattacttgtattcttgttttttgttttgttgtttacagtttacatgaactatttcacgttttttctctttaatcttcatgtgaaatttgggagatgggcacaattattgtctcattttatagacagaaaaactcaacctcaaagttttagtccaggtgtctgacttcaggatggatgctcttcgcagacctcccaacaacaatgttgcctgaccttctggcaagtttccaagagtgccaggaccccaaattagaaacctgggtgctgtgcttacacttcatgtgtgggtgatgaaggggaaaccatgggattgctaaggctcaggttccaccgttgcaaaatggggctaatacctgcggcgttggatgctgggaggattttgaggtcttatccatgtaaagtgataacagcacctgacacacaattgctctacgaggacagcagcgactattgtcatttaaagaaataaatcatcatatcctctcacttacccttcattcaataagttggcaagacctgtagattttacttactttaataccattgactctgccctggctttctaatccttctggtttggcacttcttacacaattcccgccataattggatggatcacactgcctccagtcaagcccctctaatctgtcatctgcactacatccagcctgatctttccaaacacagttttgaccttctccttgaacatccctcatttgcttacagaagaaatataaatctcctagtttttcaccaaagattctttataatctgaccctcttcttagtcttatttcacctatcccgaacacacaccctaccctttatcacacagaactaaaactcctctcttttctcatcctgtcttggtgccctaaatgcccgcattccgtgtgcctcatttgaccctattctccccctgccctctgcaccccctcccctccacaccccctcccctctgcatagctagcaccaactcaccttcagctttgggatcttagcaccgtgcacacaccctgcacggtgctcagtgaataaatgaattaactcttggtgtaagtggatacagtagccagcatctttagcctagggggtctcgcaagtctctagcctttctaaggggttggcaaggctggacacagactagatcttcatggggaaaccctgggatggcagcagagccacctgaagacctggagtgtgcacctgggatctgaggggaagagaaagaagtgagatcacagtcaccaaaacatctgctttatcagcagcaaaaaagcctacctgtggttgatctgaattcaaatatatgccagcagcagctgtctcatcagaaacttatctagagctgtcatttggctatttagaatttaaaccacaattgcttcctaaatattctctgcagaagtaactgcccttccccaccaagcaacaaccaggcaagatcagttatctgtggttaccaggtacaaaatctccattagctgaaataacagccaggcctgctatctgtgtggtctgcaggaccttgttctctgtggtaggaattacacctgttcacagtcatttgactgctttctactgaaggtgttaaagtgctaggcttgtcttactgttgttctgtgaaaaagacatttaatgcctcctatctttattttatgttttatgtctttggaaaaatggaagaactatggaaaatgtattgcgttacctgtaggttctagaccagtggtccccaacctgcttggcactagggactggctttgtgaaagacagtttttccactgaccgagggcaggggtgggggatggtttcgggatgattcaagcgcagtacatttatcattagattctcacaaggagcgtgcaacctagatccctcacatgtgcagttcacaatagggttcgtgctcctatgagaatctaatgccgccactgatctgacaggaggcggagctcaggtggtaatgctcactggcggctcacctctgctgtgcagcctggttcctaacaggccacggatcggtattggtctgtggcctgggggttgggaacccctgttctagacaaccagaaatctaagcctttctccttcatgaaaactgtagagatgcagagccttctaaatatgtttcctgagtgagcactggcatctctttgacttcagtgctcagatacacaggtaacgaatgaaaaaacctgaaagaattgtgagatccacctggtaggtgtcttgtaaatacctgtaattgcaaacctgcggggtggtgggggtagggtggggtagggtggggtggtggcggggagagtttctgagattcaggttactctctttatgtttgttttagtcaacttttcactgaagtataacacaatcagaaaagtacacagatcataagtgtacagtttgaattttcaagtcatccttttaatatattaatatacaatacatgaataatttatgtattcatgccacgaacaatttctttctttaattaaattaaggggttggtgaggatggcagtaggagccaagttctgagttctgttctgttgacataactgttgaatcacttccccccactcacttgttcaaggaggcaaggttttgtttcctgggggtaatatctaagccattcacagcctgaaatgtttacctctaattttgtttctttagctatctgaatacgtgaattccattaaaaccacacacatagaaaaatgatttctgttctgcatgtcagattttttgttttcccaatgaaagtgcaccaaagagtttgcaagtagctctgataaggaagttccttactgtgactggatttgttttctgcccttataaagatgcctctcttacctgcttttctgtcttcccccttaccgttgtcaaagaaaccttttccctttagggccctagcttatctgtcaagttcatagctgtcttttctcctagaatattatgtggttaccaccctccccgatccccacacacaaatacatcatgcagtcttttgtgggcccaatttatttaagtcagctaactacaggctagtataatttttagcagatttcacctcattcttgtacctggtatgaaggcggtactttctggtcccattagtgattaataccagctctggtgtcacctgaagttttttcagctggagttaccctactgccttccaacttttaaattatgaatttgcagatacacagagaacttgaaagcataggacaatattctccacataagttcaataattggtagtttgtttttgttttgttttgtttttttttaccagatttgctttattattctctttttttttttttttttttttgagacggagtctcgctctgtcgcccaggctggagtgcagtggcgggacctcggctcactgcaagctccgcctcccggattcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgttgggattacaggcgtgagccaccgcgcccggcctattctctttatatacagcttttttttgttgtttggttgtaccattgacagtaaatttcagtgatcaggatacttgacccctgaggattcagcatttatcccctgggaaaaaggagaaaacacaatctcacctaagaaagttaatggtgaatacatttctaatattcaacccatatttacatttctcagttgtcccaagaatgtattgagatgtagtagacttttaatcctctgcagtttattaatacatcagagaaatcccagtgattgtgctggctaggtggatggaacggtggtgcaactcattatttaatacttgtacacaaatgagctattttcctagagaagactgaactttccatatctgttgctggcatcttgctttcttgcttgatggaacagtgtaggcaagaatgaatgaatgagaatgaatgtataatacccattacaactgtaaatgggctacttataacttccagaagtccaggaatgtgtcgtttatttgctgaagctaattgagtctgataccagagagatgaggcagctaggtacatacatcattaacaaacaagaaccatctcttgtgtgattcatctaaaacctggtttcactgtagaagggatggttggtcagggcagaatatatggacaggcctcaggagttctccaggtatttgtctttttgatcatgaatagactattttttcggtagagtcttagatttatcaaataattgagcagatagaacattgtgttccatataccccccatgcattcccccatttcacctcttactgtatactaacatatcttgtattagtgtggcacatttattgggattaatgaaccaacattgatacattattactagctgtagtccatagtttacattaaggtttacaccttgtattatacacttacatgagttttgacaaatgcataatgtcgtgtatctactattatattatcatacagaataatttcactgccctaaaaataccctgtgctccacctatttgcccaccccctcttcccctgaacccctggcaactgctcatctttgtattgtctctgtagttatgcctttccaacatgttgtgtatttggaatcatacagtatggagcctcttcagattggctcctttcacttagcgatgtgccttttaagttccttcatgtctttttgatggcttgatagctcatatctttttatcgccaataatattccattgtgtggctgtactctagtttgtctatccatgcatgaagcttactgttttacacaaatgataggacatttcagcacatagcagttgtttgataaatagtcattaaatgacctagttagatggactgcttaatttttctgccagatatgtagtgccaagggagagttgtgatggaaaaggcaattatgttgttaggcactgacttctgttaatgtacagttaatgtttaagtggcttagcccagcaaaggtaggtggctttgatgtgtccaggcttccaacagcagtttcttaaattctctttagagctgcactgtccagtatggtagccactagaaaagtctggaaaaatagccacatgtgtctatttgaacttaaattgattgaaaagtaaataagatgaaaaattcagtaccttggttgtactagccacatatcagcgactcaatagccatatgtggctatttgctgttatttcggacagtgcagatgtagaacatttccatcatcacagattttattagacagccctaatgcaaataaaagcattcagagagaaggatgggattgaaattagttgaccaggctgattctggtttctctttaatgcttagctcttttgtgccacaattttacaatggaagagatgaagctcagaggtctgtttgctgaagaacagttgcttaagatgactttggggataaaaaggctgccaggccagtgaagctgtgaaatgccccctgtgtgacagccccaggcggcatggcttgacaatggtttaggcccttgatcagctagtgttaaggagttttacagaactctcagctcttgcttatttagtttggtgttgaaaaaataaagaaagaaagaaaagaaaaagcaggggccttctctaatttgaggggatgatggggtgggtgtggaaagggaattaaacttcccaactaataaatttggaaattgtacacccatttcctcagtaaactcctgcggttgttggataccaggaatgtgaaacctgaatgcgtatcagacacttgccacaggaattgtagctcagtcccttgtaactgcaattgctcttatttgggagcaaagcaaatagcagttaagtttttttgtgttttgtttctttgccagcacttcggatttgatcagatctaatttcattcacgtggtaggtgccacgctgacaataaagcattatgggctgtcagtctacttagatttcaattctgtattcgttttatgtatggcattttaataaagtcttaattttttttcttctaaacagataacagactagattatgttgtgctttcctttaatgtctaatctggaaattggctgttgatgctagtgagggtttttaatataagttttaaatgaaaatgccaaattgctttgtctgtgcattgtagctttttaaatattgactttgtgccttttgaaatgcttgagtttctaagaggcctagcgtgaaaaggcaaacttgacagaataatatatctaccataattcctgtgaaaagacttaaaatattctggtatttggaagttcagtcaggatgtgaccacttggaaccatgactgtctataaacacaggcttagaattgatacttttctctaagaataggcacagagaaaatagtatattatcttgcaaattaaaaattggaaatgccagatctcaaatgaagacagagttttcctcaatctttaagctattgtcatctgctaaagaactcttataagagttgcagagttttaatcagtatttaacaattattgaatttgttcaactggcatttgttttaaacaaacatgttgtctcttacatgaaaggcaggataacgtatggctttcttttatctgctacaatttttctgtaatttttgaatataacattttaatttagatactgtttcatgttagcaaagtctagaaaaattgattatagtttcttagcatgggattgttttcttaaaagccgtgaaagggaaaagaatcaatattagggctttccgaatggcagctttttacagagcccccccagcacgattgattatagctgcttttgtaaaggatttaaaaagaacaatctgtattaaaaacatcattctttggtatgagctttaacagctctaaatgggttaccatgggggctgcgctgcaatgtgaccacttgaacggattgtggtcatcaccggtgggccagggcagcgaggcaggggaaaggctcttaggtgaggcattgctggcatgcatgccaaagaggttaccgtggcagctgcaatcattcagccgcattctttagcctccaaagcaggaggggcaagaagcgtgtcatttttctacaggcagagtgtaaggttaagcagcaggaagggagagtcagaggatgtctttgttccagagcatttgccaaagccaggtatgtccagtcaaagggataatgcaaccgatagctcccaagcctccatatcctcagctgttgcttgttgccactgaggggtggacatgttttcatttggcatcttacatgtgagcatcatgactacagactcatcttataccaattaaataataaactccactctgtgggcagaggttctgtctggaggtgagtgtgcctgaagcagttaaatctattaaatattagaaacattggtcccatcctcacagggcatgggacagggcccaagcaagagaccattaatgtggactgggcttccagagtttaactcagtaagactctgtgggctctagaaaattcaaatgtaacaggtagtccaggtgctttcattctaaaagagggagcggggtgctcattgccattggctactttacagaaggcatttatttgcaggaatggggtaccctattaatttgggaagaattgaatatcctagagagtatggggatttttataaaatagtgttgaatttagcatcacttttcatttagcacccctgggtgccaaatcccacaggggcctctgtagtatggcttgcctcagaactagtagaatcagctttttttattcctggactaacttggagaaaaaaaattcctgagatgatctatttttaattcctaactgttttgcttttcttcgtcttccatatttttagaaaatgaaatgttatatctcttatgaaatggtacttacacatgtgtgttccaactgagacttttaattgtcactagtaaattactataaatcagcctcattcgggggcaaaaaataataatatgtgttcttgttttaaacgtattctcaaaagtgcttcttaagtagtattttttaattaagcatgtaattttatcattttgcaaattcgcttttacctttcatcctgtgcgaccctgatatcataagaataagagtactatatgagggctgggcatggtggctcacgcctgtaatcccagcactttgagaggctgaggcgggcagatcacttgagggttaggagttcgagaccaacctggccaacatggtgaaaccccgtctctactaaaaatacaaaaattagctgggcatagagttgcacatgcctgtaatcccagctacttgagaggctgagacaggagaatctcttgaacctgggaggcagaggttgcagtgagccgagattgcaccactgcactccagcctgggcgacagagcgagactctgtctcttaaaaaaaaaaaaaggtaaaagagtactatatgattctgtcagcaggatgctggaatgtcttcatatatagattctgatggaggtagattagaaagacagaaggcagcacgggagtggattaggttaccttttggatttttgagggctttggccacgtgtcagtttgtacagctgatgaagtatttgtcattggtgaaaaaaaaattactgtccacaggtttcctttccctcttattgggcaagaacctgaatgtcttcttcagagaaagtactcatatacagcacttcagcacaccaacaggagtcctttctaaaatgcgtttgctttgagatggcacaggtcacgtgatcatcagtatactctgcgtgaagcatgtcagtttgaccgggagctaatgcttctgccccaactgccatggtgcagctcggggaaggcttcatttcctggggaatttcatgcattttctgtgatggatttcataatgggctctaatacctttaaatattttcctggttcttctgtcaagcaaaccatttctttaaaagttgcttggttggccattatcatttattttacttggttaaaaattttggccaggaacagttcctttatatacaaaaataaatacagaacccagggctatgagtcttgggcagaatcaggctgttttcccagtagatatcaggaatatgaataatctctttgacacacagtgcagccaccctggtgacttggtgctaggtattaaaaaccctaccgttcagaacagtttcttttaacttcagctttgaaattggtggtctcgtcagctttagatttattccttcttttttagctttcttgcttttgtttagatttttaaatttttaagagagtctttgaaagtgctgacacattttcaggctcccagtataaggaaccaactgcaagtgtcattttcttcatttaaaaagtcctcctagatcaggtcactgtgtccacttataggctttcctgtaatcagcagaaggagaggctgccattacaaacaggtgagttaggtgtaatagattggacgcagaaaaccaggagcagtatggaacatctgcccagctcactggcatgtcagccctgcaggtgtgtcggaggcacagggctcaagtgcaggcatctccctcctctggttggggctaagctggaagggagcttgtatgctgggaaacggagcaagctcaccttgacatggagtggcttcctccacttgaaataacccaggagcaaggaggcgctaacaagacgggttattagacccaggaatttttaaaacctgaaatcttgcaactgaatatccattttattagaccttttgcctttgtgaccacaggtgaaatggatcaggagtggcccaagcactgttctgtgagttggcatttttctgaagtgtgattttttttttttttttttttttagtacttacatacttccataatatttgcttcttttcttaaaaaaatcttttgtagagatgagatcttactatgttgccctggctgatcttgaactcctgagctcaagcagttctccagccttggcctcccaaagtgctgggattacaagcatgagtcactgcacccagctcatgacacttgctttagatttatatataatatatatatgtaatatacaatatatatgatatatgtaatatatatattatatatcacatataaaatatatattatatatattatatatcatatataaaatatatatgacatatgtgtgtgtgtgtgtgtgtgtcttgtgtttggatgtattcgctgttaattaattttcaaaagtttatttgcacagttgatgtctgaaagctggttccaagtcatttgtgtctatgacttatcggtcttgtgctttctgtgctttcagcaacattatagtgccaaaaatgtagctgtaatatcaattaggaaaaaaattacacataaatccaccaccctaaccagttatctttcttcttcattttctattccctttcagtgcttggccaaatatatatatgtatttgaaatatatgtgtgtgtgtgtgtgtgtgtgtgtgtgtgtgtatatatatatatgagaaattgcaatatagttgtaatattagaaaaaaattaatgtatgctttttaaatttaatatgtcgttacaaacacttttacttattactatgtggtatatgatttttaatggctatgttgagaaaactaatatatcatgcataattatttaccagacatagtacacccctgtagtgggcattgagattgtctccctgatttgtctttaatgcagtagtaaacaccctaacttttatttcattaggataattcctgggagaagaaacatctggtcaaatagtataaaagatttcatagcttcttaaaacacattgccaatgtgatttccaaagggtctgtgccaatttctgttagttggcatcttttaaatagtcaaggcttctttttacaggccagcagcagagtgttccatattcctattgacattcagactcagttctagctcagacctctgaaacacttggaaattctatccattgactgtggcaagtctcagaactcagattctttctccagcctgagctgaagcctggaaaggtgtggtctgccctttggccccaaggtctttcccatttttctgtcctgtaagctttctgtggcattctgtcagcccttgtatagggaggagaatatatgtggttatgccttggggcctagaattgtagcagttgaaaaacccttaaagtgaattattaaatctaaaccagagcctgttggcttcctgtgcttgacttggactctgttccattatggtagtttttacaaacacttctgaatacgaaataaattccaaatatttttccccctttctcctgccaaactccgccaggaaacagaatctcattacttcagttagaatttattaatgctgaccctctccagcacttggagcttttcaggttaggctcacacagcttctgtttttactctagtctaaactgtggtcatatggatagcaaaataaatactagaatattctagtttgggaaggggagaggcagcgatgcctgtaataacatggctgcaaacctctcgcttctctctgtttgatattccaaaaaaggaagaaagctcaatgcggagcacatctgtaagtcatgaacattttccttttgtgtgtcatgcatattcaacataatcccactcaaagtcccaggcgttgctttagtatacattgcctcatacatccctactgttgttgccagaaaatttaattcaagacaaaggttgcttcccttctgtctctggatcaggaatctgaacccattaccacaaacagaagtaagaattgtcagtgtgttctgctttgcttttattttgtttttttcccccagttgccttttatccttgtggctgaggaggaagatttcttgttcgtttatttgtttttagtgtaagcaatacaccagtttcatgaagtgtatttttaaaaaacgtattgatgggattttgtaatgcaagtgttttgaaattcaaaagcaacaaaagggcataatgtgaacattctctccaggtgggatatttggcttttaattagttgtctctgtaattattttgattaaaaatgtacgaaatgtgtcaagagtttgggtgaaaaggtttagtttccttttagctggttttattcagttaagagttcatcatgagatgatggcttggaacacctgagggttcggatgacatgagtttgtagaatgatatgccagtgatacgatgactgggaggtgagcatagactcagtgagtgtgtgtacccagggctgctcattgttgccaagctttagattgaagagaaatgagaaggatgggggcgggtgcatcctgttttatgtgttgtgatgcttggggacaggggaaggggacatcattcagttaaataagcatatgagatctttctggatcatcatatctgagatgctgttttaaatttacccaacaaaccacttactgcactaggtactgttctgtagaatgaataagcaaacactgtaggaagaaaaattgttttacaccaccagatgccccaacgtacatacagcaaggaccctttctgaaaatgatattgattatattgaatcatgactacaagtttagatgtgccaagtaatcctctggcaagaggtttttttttttttttttttttttttggttggtgggggtcgcagttaatgtactgattattgcgctgagcattttatgaaacagattttacttggagctttgttggcttaggaaatctaactgctctgaagcaagtttagttcttttttcaaacaaaagaggagaatttctgcagttaagtaccctaacttggtgttactttttaacacactcctcagccatttaaatgttttccaaagaccagagccatgcctggctcattggaggccttcttcatgagcccaaggtttcttccaaggtcacatttaccttttctggcagttcccctcagaataaggccgaattccagctttttaaaaaagagaccatgtaagagaacattgatctgtttttctcagttgtggggtaaccaggtagtttctttaaagggcttggttatttcctttcaccaaatggcgtaaagcttggattcagccccttagaaaaaagggtttcttctactttctgtggagcctttaccatatattggttcctagaacacaacggcggtcaagggagaggacgcagaaagatcaggctcaggcctgggtcttgggcatcttcaaggaactcgctttctcagtggtataagaagagccccactctataagaggcatccaacaggaacagccaacatcagtggcaccttccaagtaagtggttcagacttcaaggactgtgaataattacagtaggaattctgtcatctcccagaccttgggtcatttcagaagcttcatggaactagaggaatttctccaaagttgcctattacctgacatctttatgaccagcccagtcatccttgtgcctcccactttccacccaaatgtgattctaccttcatgtaacctgattatttttttggctttgggtttgttttcctaatacgcatgagtaaatcatttaaattcattcccactctgtggaagggatgttgaagtgtttcttaaagagactttagctttctatataatgaattaagaactatttaagatgtttgaagcagtttggaactgaagacccttctttttttcttttttgtttttgagatggagtctggctctgtcacctaggctggagtgctgtggcgcaatctcggctcactgcaacctccgtctcctgggttcaagcgattctcctgcctcggcctcccaagtagctgggataacaggcacctgctaccacgcctggctaattttttgtatttttagtagagacggggtttcaccgtcttggccaggctggtctcaaactcctgacctcaggtgatctgcctgccttggcctcccaaagtgctgaggttataggtgtgagccactgtgtccagcctaaagacctttcttaagaatttcttatgtagggagggttaagaattttctttcatgtgtgacctcacttttgattttggcttttttccatggatggtttgtatgtatatacaggataataaggtaagcctaggaaattgctacatactagttagttctctgtaaacaaacccttaaagtaagtgctagtaaagacaacagtatgtgcttataagtcagccatatctaacatattcaagggcaagatcatctttttcccacagtaaacaaagggctctttccttctgttacatttttagtttgcatgggtcacctgcttgttagaattggcgttactaaaaattaatgaatgacaattggtgtacatggctccaggcatcttccatgtaggaaatttgaggggcattaggcagagaagtaactgttaagccagaactcaaaactctcagtgcaattttttccccatctatgatgccaagaatactagttctgaaagatgttaaatcgatattctggggggagaatttccatgatcaaagtttgaaaatgctggattaagccaagttcaacacagctctttattgtagttcttccccagtcctttattattattatgtgtgaatcacaggaaaagggagggacgaggtaggcagcatgttgaacatgctcagtgacatacattttgaggtcccaagtccctacttttggagctgtatgatttcaggcaacaatctcctgggtaggccctggagattgttgagatgattagatgagccaatgcttaataaaatgctaagcacaaaatgcctggcacgtaataaacacctaacagccacagctaatccttttgaacccgaggctgaatggtctgatgtcactcatgttgtggggcatgacagtgcagcagaaagagcccacacttaggtgtcaagagcttcgggctccagtttggccaccagctagaccagaggacttttgagctactttgctactctggtgttctgtttcttcatttgtgaaataaatcagtgatcttggtgactatagtgtccagtcaagctctaaaattgtatgttcctttgggctagacctaagccagaattgacaagtttagcttaaggacaggtatatcatctctgagtgactgtgtgggtgacataaatttttagctaattattatttcctttacaatgtgtgttgctagtaataaaatagtttactgagtcacctatggaaagataagctacagttatagcctttttggcactttgtaatcatcataaaagttaatatacatttgagtcataattggagttggactgcctttaccgtaaaacaggaggcatcatctagatgtttgttgtctgtgatgtgatacagaaatgtattattaggccacatggatattttatttttatgttcaaaggctaattttctgaaagttgggtctgggagtctgagttatccataattaagttttctaccttctgctttcgttgttaacctgagttaaaaccataaagtaaattcgacatttactaatttgagctttaattattttgaccactgtgttggttgcactggttgaaagcatgtgcaggacctctgcttagtaggtaaggcgttgtgttttttaaacaaggctttgaatttctaaataacagatttccacactggcagtttgaaacatggtatttgttcagtgtaggttttacctacatgagaaaaatcaaacaaatagatttgttcagttgctatcctacaaattgtcttcgctgagaaaatggacaggtttgtgatgtttctgactacatcaagactctactacacttgatcttttgtgtattgaattaacacttgttcttgtcatttttattacaactaccgtataagtttgggctgaatcattttatcaaactctaaatttttatcatcaaatgtggaaggcctaaatcaccatcgctgtcctcaattttccaacctaaaggtgtttatttcctcttaggggtataatacgaaggaaagtagtgtcaccagatctcttcttggtgtttttgtattggtgcctggggtttgggtagaggaagcagcagcagcagctgagactagaactgcagctgaggccacttggtaaagaacttttttccaggctaaggacttttgttttgtttgtttgtttgtttgtttgtttgttgtttgttttttgagacagagtctccttgctctgtctcccaggctggagtacagtggcgcagtcttggctcactgcagcctctgcctcccaggttcaagtgattctcctgcctcagccttgcgagtagctgggattacaggcacctgccaccacacccgcctaatttttgtaatttttggtaaaggagtttcaccatgttggccaggctggtctcaaactcctgacctcaggtgatccgcccgccttggcctcccaaagtgctgggattacaggcgtgagccactgtgctaggcccaactaaggagtttttatgtcatcctctatgtggcagggagccaataaaggcaggagagtgatacgatgatgtttgagttcaagaacagtccctctgcatcgaatggcttcaaagacacggacgtgggcagtgacaaggtcaggaggccttagtccaggtccaggcccaacatgatgagttagccagagccggggggccagaggcaaaggggtggagataggagacaagtatgtatcttgccttccttctaggcattgtgggtttacacaactgaatcagatgcgcattctcctctgggaatttcatctatggaggcagtgtagtgcttcagtttccctggctgaatgtggcattacgcagaaccctctatctgtctgccgcacattttcctcttggtcgtaccttgttgctttccacagccttcctttgctctcctgtattcacatcttgcatcagccaaaagggaaaggtctgaaagaccagctttgtttttctcccagcttgtactctggaccctgttagccaacagtattggcactgcctcacagcgatggtcagtcccaaattaaacagcctcgttatgacaccctacagccaggctgcagctctggacttgtgcttctgcacgtttccttccagttgctttcgtccagcgtctcggtcccattgagtaagggagtgtgtgcagagtatgtcccgaggttttctcctcagtcaagcagactacatttcgccaggtgtaaaatcggtagtttcgaattcaccccttttcatggccttgaggagatgcttgtctccttgtcccaagggaatattggtgcataaatcatttcccgtcctaggcatgttcattccagaaacctttcagaacagagtgtggagtcttcataaaaggaatttgtcatgagcgcaggggtttttttttattttttattttttaaaggggaaggcaatagaggtattcattatctgctacagagtgaaaagggccctgctttatgttaaattggacttcatggaaagatattggtaatttctcctatgttctttgtgctcctgaaatcagagtgggagagaactttgatttcaaaattattttcaccaccctggatcacagagaaacacacttttggctgcctttaaacacattaaacatctggtcagcccagagaccacccgggagccctgtagaccccaagtaactgagtggctgagggtaagccagcttctctagacacaccctgacttccaccccaagtcttgttgaaatacaggcctgacggctgtcccaggaagtcagttggcttgtcagactgccagtgtggttgaacggtgaggtggctagaattctctgggaggcatttttggcccatctgcctggtagcatgacagatgtgttagtccagacaactgggtcatcgaatgaattgaaattcaatttacacatagggattaagtatctcagtattacccttgccacatcaaacttcattgacagagccaagaggaaaatgaaagtcattcaatgttaagaaaagggaaacaagattctaacatggaaagggaatattttgcttacttttaagactgtaggttacttaaatagatgcaatgcaagctataggaggtttggggcagatggtctcctaggcttaaaatggagagattttaaactacgaggatcctggaggtcttgtgacatgtaactctgaaacctcagtccaaggccaatttggtttaagtaatctcagtcaaatatttattttgtggccatgcattttgagagggacagagaacacaggtcattcaaaacatgccttcaatgagttgtactctgctgaggggcaagaaaaatgcacatgaaacaatgaaaagtaacagtgagggtttatgtcttaaactgttcatatgctacaaaatcctaaaatagtactttataattaggaggtgtataaggagtggagaagtcacagcctgtttcatagtagccaggatttgagagaagaaaccaggaggtcctccaggggaagtaaatgggacaaagtttaagacaagcaggacggagaatggctttttcatgggagcacgaatggtggttcaacccaagcggtgtttactgagcatctactatatgccaggcactgtgactgggggagggaagccttgcctttaaaggagctgagagcctaagaggaggcagttgatgatagagctgtagaacacagggctcctgacacagttcacaagctttgggaattacaatctggaatggtgatagccttggaaaccagtgaaacagggtggcgtcagattgcagagttaagctctgaccattctactagaaaagttgcagcacactcttggctcagggtggtccaggccactggaacaccagtccctaaggtttcagttctcagaatccaccagtgtgatagctcaaacaaaatagattcccatgctttgctttcagttggcactgaggcctggtggagaatgtgggctcaggtttaaagtgctttagccttgctagccagctgctgaaacctgagaaaataaagtggtactgttacagagggttggacctgtcctcttaggaaggttccaatcacagcgactgctggaagagaaaattttattttaagattaaatctaatgaaagccagtgtagtaagggaaacattattttataatttctgttaagagcaaacattctatatgatttttaaaaatagagcaataatgagtgttgcctgtttccaaacaagcgttgtttaaaagctgcctgtctgctttattatttttttcctgggcttttgcgagataatggtagtaaaatatcaatttactaaaaccattttttaaagtcttatacctctactctgtctccagttcatgcaagttcttcttttggcaggattaggttgaattttaatactaaactcttactgaagagttaagaagctgtggaactggtatacttagtgactgatccctctccatattaagcgtgtgatttgctattaccagttgccagtaatagaaaaagaatgtgctcgtgtgggtttatctgtatttgtcattaaggctttgctaagccaatgagccctagaagcaggcgtgcagtgggctttctccctgtcaggtgagcctcacgggcgctgctcctctccgggcactgtggctggcctcagcacaggtctgggctggggtagaaaggcctgcatggcctgaggacccaggtgactggggatctctcatctgtagcggtaaagttctgagtattgccaggcctgcaagcactggtaggatttgatggatccctgggtgattatttagcctaagctaagccgtaatacctttgcatacatccccaagaaagtcctaagtgttttgttccctttccagtaagggagtgacaaagagaatgcccaagatggcttataactagcattgggatggctgaaagtcaggtaagtttagtggaatgcaacaaaataagcccaagataggagtttagatctccgaaatgttttcattctactggtttaagctgtgtaggcttcccttgcaggttattagtccgtgctcacctctcaaattgctgttaagttgtcagggtgcctgaggaagactgtggccagagatgtggattcagactactgtgggagtgggaggggtagtcactgcagtatgtacctgaacaatcagatatacaagtgtgtttcttaatctctcaacatcctgactcccttgtctttcctttctcagagagcagagctgacatctgataaagacatgtaccttgacaacagctccattgaagaagcttcaggagtgtatcctattgatgacgatgactacgcttctgcgtctggctcgggtaaggtggctgcttctaaacactggacctcattctccaggcatgcacgcacacacattttactgtgcttacttcaaggagacaggcaggatgcacagtggttaagggcaccgtctttggaatcaaagggcctgggtgctaattctagctctctctgccacttacgctgtgagatcttgagaatttatttgctgagcctcagtttcctcctttataaaatggaaagtaacaatagtccttaccatagagttgttgtgaggattaaaagggagttgacacatctaaagctcttagatttgggggcttggcacatagtgctctgtcaacattagcttttaatcgtattaagactttcagagtgatgtcatggaaaccacccttcaagaaatccctcaaacactggtttcataaaaccacctaccctatgttaaaaattgtagatgagaccaagaagttaatacgtttttattcctagggtattgtaggaggaaaatgcagcagccaagtaaaatgattatgtagtgacatgatcagattccttagtatattattccttaatagttatctgttaccactctaaggctacataataaaccaccccaaaacttggtggcttaaagtaacagtcattcatttaacttattattctgtaggttggtgatgtaggctgggctggctgggctccctcacatgtcagtggtcagctgccggttgagtgtacagctttaggttgggtttgcagctttcgggtactcatatccctggggcagctgagcagacttgggttctgttcgtgtggtctctcattctccagtaggcaagctattttttcacagtaacagcaagtagaagtgtgcaaagcctcttgcagccaggccttagaactgggcacagcatcacttttactacattttactggttgaagcaagtcagaaggccagaacagactccacctcttagtgaaaggattcataaagtcacatttacagaggatatgtatacacggaggattaagggattctggtcacatttacaatctaccataattgatgaatatttcccctgttctcagaatggcccctgtatgagttcattctcaccctgctaacaacacagggactgggtaatttataaaagaaaagaggtttagttgactcacagttcagcatgcctggggaggtctcaggaaacttacagtcatggcagaaggggaaacaaacatgtacttcttcacatggtggcagcagggagaagtatgagtgaagaggggataagccccttatgaaaccatcagatctcatgagaactcactgtcatgagaacagcatgagggtaactactcccatgagtcagtgatctcccaccagctccctcccatgacatgtggggattatgggaactacaatttaagatgagatttgggtggggacacagccaaaccatatcaacccccaagaagctcaaaaaagggaagagctttccacatacttaattaatagtcaagtgagaaatttgtggtcagcagcatggtaggcaagacttatccagaccttttttgctttagggtttttataacagattcaacagattgttagatatctatgttcggtataacttttgtgatcagattgagctgggcttcagaatgacccagaacagattaaaatcagttgtgtctttggtagaaatctagccatgtaagagtgaatgttttaagttgaaaagcagaaagtctgagaaagacaagagaggtggttgctgacctagtaacaatgagcttacaatgcagtcctaatgtaaaaataactctagttattcttgggagagtgatatatatcacacacacaaaatgggtgtgaaaagagttgttcttattgcccacaactctataaatatctttcactcatggcacctcttttttttttttagcaccttaagagttctttgtaactgtcatcttcaatatgtcccaggaaataataactatggacattttttgttcctacttcgcagatcttagaatccaagagttgttagtggggtgtacaggttggcgaagtcattttgctgatttgctaaggttgaccttaagtctagtttaaagaaaccagtatgcttaaagtaagttttctttaaattaaacttaaggacagtcttagcaaatcaacacaatgactttgccaacctctacagaccccctgcccccatccaggtaaaagagagttagggagggtcatttgaagtcctgaacccactgatcagatagatcaagctgagggttaaacctgggcccacactgctggtgccatggccctagccttaggcagatcactgctgtgaagaagtgaaagagcttcgttcttgactttggaaaccaccttacactgagctgggagtgttgtttttcagcatgaagcagcagtacttgtaactaaaatttgtgaagcttttaactgtgtcagaaactactctaacccctataacatctctgaaacgatagattctgttagtatttcgatgattcccacgagaaaacctgaggcacagagagattcacttgcctcaggtcacactattagaaggtaatagaactgggatagtgagaaagtgagggagttgggcgtgagagtgtgttttctttcattcctttgctgtgctgcctccttgtgtcataaaccccttctagaattacccagttccagcttaaaaacaccccagggtttggccagtgtaccagttgtcccttctttcatccagctatccagtagaaaagcaaatggattggaaaaaatggctgaaggcccagaggggacttcctgggcaaggagataggactatgttctatatgtgggctcaagtatgggcataagcaaacatgaaacccttcataagcatttgctgtgtgccacacactgtgccatgctcttggggcacagagataagaaagacttggtctctgtctgtaggggaccaagagtctaatgaaagaaatacaaacatgagaaataatcattgtgatacccggtgaggggtgacataatataggaaagggctgtataacaaaaatgtaagaggtaaaatatagacctttggttaaagatggcagatcgaacactactacctttcagtgtgcaactaaattgacgataaaagaattgggcatgaactcataaggacaaacgaaacagtaaaggaaacaaaagccatgaagttttgaaagctgggaagaagatgagctagtggggacagacttggcaggcttcagaaggccgagttagttcgcagtggggagagccaaaaagcaacccagttaacacagcagaatctcttgggacctaggaattggtggcattcagtggagggtgagagtgatgttaaactcaggatgattggctggaagtctgtttaagaaatagatcccctggttcctttcctctgtcatgtagcaaaggggctcatgttccctgccctcagagggaaacctggagatttattatctggagagggtaaaacagaacccgggggtatttcaggaacagatggggctgggggtaccttatgtaagacagagaaaataagttcttagattaagaataatttaatatggtgtgatcccaagttgtcttgtcttctcccagtcagttcccagaacactggcagtctgtccatttaccctctgggtaggggactgggaggctcccctctgggaagctggaccaattcaaagagagtggcatgggagctctccagtgaaacgtacagctctgtattacaaagaataaaacttcaatgagaaatgaaaaatttcagtcgaggggatgttgcctacatttgacacacctctcctgtgtgctcaaagcttctagtcctcttttcggtgtttccctcttcaatataaacaggcaaccaaggctccccagatatttaggaaaaacttgtaacatgagagaaagagaaacccccaaattgggagaggacagccacttacaggaagaaaaaaattcacagaaaaacatagtaaattcagagagaaaagcagatgctcgaacaatggcacaaaaacaggatactataaaacaggaatgttctgagacataagagttcttaagagtgtgggactgtcgtgtcaaaaatgaaaagctcatttggaaggtgagaagacacagaggatattcattcattgaggaagtatttcttaatcacttagtacatgggagaacaggcaccattctaggttctagggacacttcagtaaataaaatctaacaatgttttctctggcgataggctaattgtatttattccttctgtgtttccaaattcatacatgcaaatgtattttaaaaagtattatttttataagttgtctaagtccattcaggttgctatagcaaaatactttagactgggtaatttataaatttattggtctcagttctggaggctgggaagtcaaagatcaaggcacagcagatttggtgtctggtgagggctttctgactactttttagatggtgccttcctgctgcatcctcacatggcaaaggggacaaacagtgtccctcaagcctctttccgaagggcactaattccattccatgagggccctgcccccatgacctgctcatctcctgaagtccctcttcttaatactattgcattggagattaggttttaacacatggattttggggagacacattcataccataagtaaaagaaaatgttatttttaaaaaagaaaataaggctgggtgtggtgggttacgcctgtaatcccagcagtttgggaggctgaggtaggtggatcactcgaggtcaggagttcgagaacagcctgacatggcgaaaccccatctctaataaaaatacaaaaatcagccaggcgtggtggcgcatgcctgtaatcccagctacttgggaggctgagtcaggagaatcgcttgaactcgggaggcggaggttgcagtgagctgtgattgcactattgcactccagtctgggtgacgagcaaaattccatctcaaaataaataaataaataacaaaaaaaaataagagaatgagcatgggaacatagagacagaaccggtgccctggtggagagatcaaggaaggcttcagagagggggtgatattgatgctgtacttgatagtgagagcaggagtttcccagagggaaacaggccttggagtagtctatttcagacagggagaacagtaggacctgaaggaggagatattcagtggggcttcgagatttctggtttgagcaaaagagttaatgtttttaataaagatattaaaagcagcagagccatctgagacagattgcccatctgtctctatctttttttttttttttttttgagacagagcctcactctgttgcccaggctggagtgcagtggtggtatcccagctcactgcaacctcctcctcccaggttcaagtgattctcctgcttgagcctcccaagtagctgggactacaggcgcccaccaccacacctggctaattctttttatttttagtagggatggggtttcaccatgttagccaagatggtcttgatctcctgacctcgtgacccaccggcctcggcctcccaaagtgctaggattgcaggcgcgagctactgtgcttggccctgtctttaactttaaaagtgccagcttaagggggattttctacgttacaaatctcttccctcatacagattcatcccacttctaggttgatgactcatattggtaactcttgtgaaacaagagggtctttaaaagccctagactgaaatttttcatttctcattgaagttttattctttgtaagaaaatgattcattgtaggaacaaattaagcatattatatgtaaaatgttgatagataattaggtcacctgataaaacagcattatatttctggacccatcattattaatgacctatatttacgtaacagtttatatagaatgctttaaatatgtatcatgtctgttagatatgtatctgtgatatatatgtaccttcgtgggttagttattattagccccattttacaaatgaagaaaccaagactcaagtattacttgcctaagagtacagagctaataaatgccagaaccagtactaggtttgtttgctttcttaataccaaaccctgtatttattccaacatgccctgccatttcttctgtataataatgaatatatatgttttgaaattaaaggagacagttgataaattaagaaatgaaccggccaggagccgggcacagtgcctcatacctataatctcaacactttgggagacccaggcaggaggatcccttgagctcaggagctcgagaccaacctggcaacatagttgagaccccgtctcaacaacaaaaaataataataattttttttttaatattagctgggcacagtggcacatatatttagttccagctactcaggaggctgaggtgagaggattgcttgagcccgcaagtttgaagctacagtgagccatgatcgcacccctgcactctggcctgggtgacagagcaagaaaagaaaaagaaagaagtgaaccatggccattgcacatgtttccagcatgtgttgctttcccacctgcttattacattgatgcgattctgtggaaaatacccattttcttttgtttgaggaatttagaggtatttatcaatgtgttgtccgaggaagcctggttagtttgagttacagagttggagtttgtttgagttgttacaaatttgacaaatgatcaacttaaaaggaatgttgtatttgaatgtcagaaattctcaaatgctattctagtgaaaaggcaacaacaacaaacaaaaatcatgctcaggtagaaagtcacttgttgaacaaataccagatcagagcctgttatgtcttagacactatgttaggcactcaggggcctattaggaagaaggcaggtacagtgtttcatggaaaggtcacagtggcttggattggagtggtggccctggaactgtagaacggtgttaagagtggagggataataagaagataagattgataggactggataatggattcaaaaacaaggtaaggaagaggaagtcagagttctggtgtgtaggaacagagggcttcagtcactgcaaggtcacaggaggagaagacaaagggaccatgagttctggtttggacatgttcagaggtgtgttgtacctttgagtcattcaagtgaaaatgccaggaaggccactggatatgtgactttgagaggggtggtaaaagccgatgatgtaaatttaggtatcatctgtgcttaactcatcatttattgacattgtggacatggatgagggagaaagtgtagaggaagaagaggcctagggacagaccttcagatactctttgatatttgatgttgaggtagaggaggataaaccagcaaaggaaacttagaatagccagagaggtgagggggaagccaggaactcttaggaacccaaagaaatagggtttgtccggaagcagatggcacttgacagtgtgcagtggtgctaggaagttcttctactagaggaaggcgattctgaagagtgccattgggtgctgtggatactggtgaccttaacaaaacagtattaatagtgatgacagggaaaatgctcctggagggagtagaatgcagagtggagaagatgatgaggacaagacctagtgagtatccacccccactggaaaaatctgcctgtaaaaccaggagagggccaggcacggtggctcacgcctgtaatcccagaactttgggaggctgaagcaggtggatcacaaggtcaagagatccagaccatcctggccaacatggtgaaaccccatctctactaaaaatacaaaaaattagctgggtgtcgtagcatgcgcctgtagtcccagctactcgggaggctgaggcaggagaatcacttcaacctggaaggcagaggttgcagtgagcccagattgtgccattgcactccagcctggtgacagggcaagactccatctccaaaaaaaaaaaaaaaaaaagaaacaaaacaaaaacccgggagagagggcaaggaactcacatgaaataaggagtcagccataggagagttttcctgtttgcattttgttttgttgtgggtttttttaatttttatttttggcagagtctcaccctgccacccaggctggaatgcaatggtgtgacctctgctcactgcaacctccacctccaggttcaagtgattctcctgcctcagcctcccgagtagctgggattacaggcgtgcgccgccacgcccagctaaatttttgaatttttagtagagatgaggtttcaccatataggccaggctggtctcgatctcctgacctcgtgatccgctctcctcggcctcccaaagtgctgaaattacaggcgtgagcccctgcacctggactgttgtgttcttaaaatggaaatggagcacgtttcagtgtagatgggaaaaaatcttgtcaagcagggagaaaaggaacatgcaagtgaaagaagggctacttgaatgttcaggataatactattaaggaaaaacttgctagactacccacagacacctttgaaatcacttcttcatcatggtgaagaccacaggaagctttgtgctgaagtcttaaagagccagcattttgaaagaacatgattctgtcagtgtcaacgtcaggcaatagtgcctgataatggagacatctgtgtcatgattgccatgctcagttcatcttcacttacttttccaggagctgatgaggatgtagagagtccagagctgacaacatctcgaccacttccaaagatactgttgactagtgctgctccaaaagtggaaaccacgacgctgaatatacagaacaagatacctgctcagacaaaggtgcgttctattttccattgcattgcattatcaggttattacaaatgcttcactttactgactgtacacaacagtcccttttgtattattttcttctttttggagctacccatcatgaactatgtacacaacagttcttttaaaagaccccacttaaaattgtgtaaggacaaatggtcttcaggtggtgttataaatggctcttccttactctttttgatcattttggcatttacccacttataatctctgtcatccaggctcaaattatatacaactatttttcacatggccctccttcttaaggaacgtctgaagcccagttaagaagtaaagccctgtttctttggtttcctggtttgtaggttacgtaattagaagactccaggtcacgtcttgaggtggtcctagtctcactaagtcatttctcagtcttcctaggccgaccatcagtactatgtaatccttgacctctctcgatgatgatgaacctgggtacatctgtatatattcattttgagagctgacttattaagaataaggtctttggccttagacctgagtaaagtgaccagctaatgaaaacttggagcttgtgattttgacctcgttaatattgcagttagctgaccatccactaataggtaacccactgaagttagaacatgcatattaaagtctggcaaagacctaagtttcaaatcctggatccagtcaggtttcttagcttctgaacccatttcctatgggccttgaagaagatgaaatgtgagtgcatgtagcatggcacctgagacctagtcaccattctgtaagcattaattgaattggtggagcagaagagaccaagccaattcaccaaatgagcatgtgtaataactgtagtggtagactttgcaatcagtgcaggggtaacatatggcttaagaaaactcagaagcacaagcatccccttttagagctcacccatctgttgattagaaatgagatgctgccaagctttagcagcagacagggtatggatatggaaggctgtttgatgaaggtggcgacaggccttccttggagtaagaatcatcccgtcttcaggccagaatgcatgtgggcttttcttacccttgccccagagtacctttgttcttcctcctcctccatcctcccagtgcctgtgactggaatggtgaatggcaccgctggatgggtttctgcagatgtggaacagccaggaagccagccctgtccaaattgaagtgctttctgtaggaccaagaagggtcaattactattagtggtagacttcacaagccaggcggtaggaaggcagggagagccctatgagaactgagaccgactcacctggcatgtgctggatccatgcataaaagctactgtatcaatgtttcagttgagtgaatgaaacaaaaaaagaaagggagaaatgaaaagtgcaggtgcaattggtggtacgatgactgcctcagagtgtgtgtggcacaattagctactatttactaaagatgcatttggctcttaccacatttttatttgaccacttctcttgactaaatctgctgaagtcagagacaattaggactcactagcttgagggaagcaactctcctgggtgagttttggcttgtagtgatagagagttctatcctaagcaagacttaatttgacatagagttctgtctggtttgttaacagcaatggattgaccactaatttaagtttttaaaaattggttttaaggaagtaattgcatcagatcgagataaaaaatgtagaactttggcaggtgaatttaaaaattaaggagcccaaaagattttaatacatttatattcttactatcatttgtgttcaatatagtaatagtagaaattcatccatttataggagatttgttgagtgctattcattatgtgtcgaacactgtttgcagcactgataatgataatattgatcatgaataacatgaataataatgattaaatttttcattttgctgtttatgtggtacagccgaattgaacattgcctctaggataccattagtgtagattttgcttttcaattggtctcacagtggcattaatgtcactgttacggatatcctatctagtttgttgtaaatttaagtgactaaaatgcacaaaagggaatctcgttatttgtttgagaagagcatcactcataagcttttacttctgttgcatttccatggcatccaaacaaccagacatggatgtggcagatctttacttggcctcatttaatcatccctgctgtctttttgcggattcattttgcacatacattcatacaagagtgaaggtatttcagattagttccatattaccaaatggtatcttcttagtcaagcctttgcttccatacgataaaacattttgacttaaaaaatgaattttccacccagagccgcttgaggcttgtgcacctccagctgcagggcggctccagttctgtggagtccttcagttcccacactctcagatccctggattgcacgctttgttcagcctgccggatcagaggctgagtcagaggaaactgaaaagatcaactctcttaaatgactttagggactcaatcacatggtgaaaccatatgatttgtaataataatgggacaaagatgatatggatatggatgaattaaactcagtctctcatattacagtaactacttaggtccatttcatttctcaccagaacttgtttacctctctccctagtcacaaacctgagtattcacctatttgagatttctcttcccttttctaacttgtaatagtaaagcagtactaatgagcagtgaaaaggtctctagactagaacccagataatccattctctgacctgttgtctgtctttccacaaggcagccaattaatgatgggcttttcatgagaagaatagaaaaatctcagcaaaaatactgccaatgagctgctctcttctgctttactttggtacctgaaggcctgggaaggcctgtcgtatttccttctctcatagtaatagaaaggacggtgacattttcagtgcatattgtgcaccagtgaaatgaaatttctctatggcctctgctttttgtaagtcatggcaggttgaagtttaggtagtacagggtttcttgcaatttgggaatgacagttactctttattatactttattacataccaccttcagtagaagtgtagcgttctgctcactgagacagggacctattgatcttacataccctagagtacaaatggatccacctggtctagcttatggtccttcctagcaatgagggtggccttaaggtgcagaaaagaagtatgatgtggtcagggtcccacaggagctacttgcacagcccaagaaggtgtgaggtcttttcttcttacactctttaagcctctagacttaactagcaggccgccattttggatgaactctagccttcagaaagcaatcatttgctttgctgagccatggtatgttagactctgtggagtcctaatgaagatggtaggaagctctcaggaacttaggaagagtagtagagctgagaaggattattgtctgcagtattttttttgagacagggtctcactctgttacccaggctagaatgcagtggcacaattatagctcaccgcagcctccaactcctgggatcaagagatcctccacaggtacacagcaccatgcctggctaattttaaaaatttttttgtagagacaaggtctcagtatgttgcccaggttggtctcgaatgatcctctcaccttgggctccctacccagccacctttagcctttaaacctcaatgaagttgacagtgttttcatcagtgatgctggccgacaagaacttcagactgttagagaatgaacaactcctttgaatgggacttctctaatccactggttcttaaactatggaattgtctggagaacttaaatagcagtaaaagtcagtgccagctacatagtgccctgtatagctcagaagtgaaggagtaaggagaactggggcagtgctgttgggttggagcagtcagagggagatggtgacctgaagtcagaccaattgaaatggaacctctagtagtaggactgtattttttttaatgcctttcaggtgatgtggatcagcgtaaccttgggtgattcacataagatggccagtgatggtgctgagagttagaaaggcaagagataatttctgtgtaaataatcctgggggtttagtgaggtaaaaggtcagagaaggcttcattaaggacaaacagatagtaaaagaagtgcaacatttggactggggatagaactgcatgaactagagcagagttccccacccgcttctggggccacggaccagtagcggtggcctgttaggaaccaggctgcacagcaggaagtgagtgagcattaccacctgagctccgcctcctgtcagatcagtggaggcgtgccattcccataggatctaggagcgcaaacgcgattgtgaactgtgcctgttgtgctccttatgagagtctgaggtggaatagtttcatccccctccatcccccccaccctcccattcatggaaagattggggaccgctaaactacagcacagatactaagaaccatttttgataatgaagaggtggtggaaatgacctcacagggttttctactgggagtaagtggtgggttgggtgaggactggaagctacccaacacctgcagttctgaggtcgatgcgggatgggagctgggctgtgatgtgctggccacctgaacgaagctgtggaaatgagaacccaagggaagaagttaatgtgagagcaagatgggaggcaaattgacagtgctgtgacatggaaaacatatgatagaaaatgtgccgtaatagataacttggtaacaccccaaaatacagtgccattaatgggaatagaaaaggaggttgatctgattcagcagtgaattaattactacttagacttgacgagtagagttaaaggtggtacagccaacagttaatgtcctgcaggctgctggcttgttgggaataatgctgactagagatgcggctgtgagaggtattcccatagatttctgcttgagcattgtgcagtgtccgagacccagtgagtgtcgttcattagacaggtgaggaaatcaaggtggagaaaagaagtatgatgtgatcagggaggagctacttgcgcaatccaagtccctggaagtcctggtctagggtttgctgaaggtaatataactagggggaagcattaggagtaaggcttggggattgctccccacagagtggggacaggaaaagcccagtcaggcgtgagagaatatctgaaagggaactgttgtcctagtgccctgtgtagttcagaagtgaaggagcagggagaattggggcagtgctgttgggttggagcagtcagagggagatggtgacctgcagttagaagagtggtgagaaagtagaaatcttaggaaatgtccactaaaacaacctcaccatgtccttaggattattatgaactcactagctctccgacttgcctgatcatgcgatgggtgttgtgcaaaccatgaactacatgggtccatcatgacactcacccattgctataaacatcacacaagtgattattccagttatttcctaaactcattctttgggggaaaaaaaaattttggaatatactcatctattatttcttctttccaacacatttccttaaatcaatgtaatctttccctgtttcccataccagtcacctgaagaaactgataaagagaaagttcacctctctgactcagaaaggaaaatggacccagccgaagaggatacaaatgtgtatactgagaaacactcagacagtctgtttaaacggacagaagtcctagcaggtgagtagcctggtgggcctcaggtgggagggtgcctacataggcctctgttagtctaagtgatattcaaaagtgcagcaaagcttgctgtcatctttctgctgaaagcagtcttgtgggtgcttgattccagagcgagaagcaagaggctcagcaaacattgtctttattgtctgccagctccctcaacctacctcttcgccagccatcgggcaggggataggaggtagcctaaaagagggaaagttaacatctgaattgatccagaacaactggatgtagagagatggcagagtgtggagatccatcagtcttgctcacaggcattctacatttcaaaataaagagaacgaaaagttctttaggggaaggcagttcatataagtactgcccaaagtgttaagaacgttgtttctattttaacttaattggatggaagtgcaaatattttaaaggggaaaactttcaagatttaggcacacttggtagtctcaaatccaagaatagaaataaatttgcatgctttttttcatgtatactctttaaaattttaagtcaattatactatgttctctgttgaaaaaaagcagttagaaaattagaatatgaaatgtgagttctgaaaagacaaaagtagttttcaagtatggaattagttaagatcaaggccagatttttcttatcgaggtttttgggtggtattattaacactaaccaaagaaattactgtaccttcctgaggagtttcagatttgcatagttaccaggttgcttcattgaatccagctttttttttattggggttttcaaattaagccttttataaaagtgtaagtagattaggcttgacaataaagctaatgtctgcaacccttgaatctcttctaaagtaatcttccttttggttgtttcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgt

SEQ ID NO: 37639 - DNA, 49603 bp, Homo sapiens
ggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctggggtgagccgaggggccgcggggccgaggcggagtcagcacaggagcggtccggatcttttctgaggccggggaagtggacaggcgtccatccgtgtgggcttcggttggatgctacacgagaggggcttaggatgagagaaggcagagagatgaccaccggctatagacatcgatgtctgtggggctacttgggtgatcccagtgatccagtcatttaggggagttccccttgcttttgctctctgtgcagagtgggaggatgagctttcctttttagttgtgctcagctttggcccattttgattcccacgaagacttcattttagagggtcaaagcagtaagaagttctcagcctgccaggggcttgaagttgtccagatgtttgtgttgttttctagatgaaagtcaaccctggttttgggggcattgaacaagttaacaccatatgcttttttttccccttagtgatcattcgttcatttctcattcctgtagggaactcatgtagttagctaacctttgaatctagccaagcggttgattaccttatatccaaagtgtccaagttacctaactgtaggcggaagagtttccagactgtcttgaaacctaacccataaaaactagcatagtccttttgggattgactagtgcagaaggccgggacagacatctcttgtgtgctctgaaatacaaatgaaggtttcagggataacggtgaacattgtgctcttatccgtgagtgactggtttgataccagccgccaaagaccaaggaaatcatttctaactttcctcttaatgtttaggtcctagaaatcaaggaccataaaaagatgattcagatcccttaatcagatcttatactgagctagataggtaaccatgatgggccttatggaatcttggtggtgtctgataccatgtgcgtcagctgttcacagtgtcaccgagtcatccttgcagagttcttgatgacttcttctgtagggttctttcacgaagaattttcatgttaatgtgcacccttcctcctttagcagctctgggtctctttaaaatcatacctccacagtaagcagttctagtcctttgggttaagaggagaatcctacttcctccagacatctcaagaaaaccaatttctgtcattaaatgctctcattaaacatttaaatagaggaggagaaaaagtttttaaatgaaagacctgacactgcatgaaaggattaattcccccattgcttcatcagatatacttattaggtggctacacgggccattctctttgcttgggacagtaatacaatgatgaataagaaacagtgcctgtgctcctaggacacacactgggggacaaatacacgtgaacagattataatactagagacatatgctgcctattattgcaacatggatgagggggtacccaactcagctaaggacatatgtttctgaaagggattaatgcagctgtggctacacttgacttagctcgtcagaatccttgactctgatctcctgttggaccattagcacatagtgctcctagactctcaccaactccactttgtcacagtaaagattccttgcacctgtggttttcaggaacacagttttgaaacaataggtagcttttggccttccttgatcacccaccgaacaggagaaatgctctttggttcctaaggtgcttaggtacatattaggttacaagaggccattaactgcctcctgcttcaaaagtgctttatttccagatttgagcagcagtaattattgctctttctagtcattacccctttttaactacattgtgcctttggatggaaagttcgtccaggaacttccagaggcaggtcacacagggccaaatagtatttgaggtgtaaatgtcttagagacaacatactctgtctcctgggaaatagaaatcaggagagaacatgatgaggatgatttctttctaaactccaaagttgtataatcctgctgccttttcagcatcttcatttggatgtccagtagcatagccaaaaccgttcttgattcctctcccctcaaacatgcctgtcctcctgtatcttacgtctcagcaagtggcatttctatttacctctttgactaaagccaaaagctttggaatcgttcttgacttctttcattctgttttacactgtatcccatctatcagcaaatcttgtgtgttctacccctagaataaatctgaaatccagtcatttctctctatcttgatgattactactcttgaaggcaccatcatctgtcacctgaattactgtagtagtcttctcattgatcaccctatatttgccagtgtgccattttcagttttttgtctaccaggtagagtgaaactttgaaaacctaaatctgattccatcctctactcaaaaccctctcatggtatcacatcacaactagaataagttccaaagttttcaccctgtctggcaacatctgacatgatcaggccctgatttcttccctgtcttctgtgtacttacctctcactcctttctggtaccagtcccacacagccttctttgttccatcaatgcacaaagcacatacccacctcagggcctttacatttgctgtttccttggcctggcactcacttgcctttgtatatatggttcattcctcatttcactcagttctctgctgaaatgtcacccaaatcagcaaaaccttccctgtgtatcctatataaaagagattgccacatccaccaatgtgctgttttcttagccttatcttctaatcatgggtcaccatctactgttattttatatatttaattattattgcctctctcactccacattagaatataagttccctcagggcagtatctttgttttctgcattgctatatctgcagtacctaaaacatttcctgactcaatgggtattcattaaatatatatttaatgaataatgttaatatgaatagtaatagcttgcagttgttaaatgctaatctgtattaggcttttataaaataagactccattttacagaagaaagacctaaggcttagaaaatttaagaaatttttccaaggtcacatgtcctgtaaatcatgtctgcttctagagcctggttctcaaacttgaatgtatattcaaagcctgtaaaaaatgcagacttcacatgtatatatgagtatctgtatgtctatatatacatacatacctatattttccagagaaacaatggaaagataagtcaaaaattactaaaatgatgcccatagcagaagggagaagagaggataaaatggacaatgatagaaactagacttttcgtcgttttagctttggaactacatgaatgtttcataaaaacaaataaaatttaatttaattttattttattttattttatttcattattattttttgagactgagtctcgctctgtcgcccaggctgaagtgcagtggtgcaatctcagctcactgcaacctctgcctcccaggtacaagccactgtcgtgcctcagcctcccgagtagttaggattactgccacccaccaccatacctggcttatttttgtagttttagtagagacggggtttcgtcatgttggccaggctggtctcaaacgcctgacctgaggtgatccgcccacctcggcctcccaaagtgctgggattacaggcgtgagccactttgcccagccaacaagattaaattttaaaatgtaaatttcagggtaccacttcaaagccattgaatctgaatctccatgtgcagggcccaggaatgtgcatttttaataagtccaggtgattctaatgcagctaattgggggcttatgcccagatgagaagtactgttatttgccatgttacccaacgaagggaagtgactactatcttacttatctttgtggtccctgcagtggccagcattgggccagaaatggaatttattacatgaagttggactgcattgcactgttggaaggagctccattagggtaattatgagcaatagggcctagccctccttctcaggaggaattaagtccaaccttgtggctcagggttaggccgtcaggagttttttagggctgatactgctttgcttatgtgtgcgttttgtgtttgcttagtatgtctcactttctgttgtgtgttactgtattgagtctcagaaggcactgtccatcccatgctgcgcgtgctctgcaggcttgtcatcctctgtgttgtgcatgcacagctttgttaaataacgtgtcctagagagtggaggacccaacatgggacaggtcctctggctaatggcacatgtaatcaatcaggttgatttaaaagtttacagagaatttaatccatcggattgattcccttttatgaccagtagaatagacattttatttttttaattaattttttttttggaggcagaatttcacacttgtcacccaggctggagtgcaatggcgcacaatctccactcactgcaacctccgccgccagtgttcaagtggttctcctgtctcagcctccctagtacctgggattacaggtgctcaccagcacacctggctaattttttttttttttttgagacagagtcctgccccgtcacccaggctggagtgcagtggtacgatctcagctcactgcagcctctccctccggggttcatgcagttctcttgcctcagtctcctgagtagctgggattacaggcacacacaccaccatgcctggctaattttttttgtatttttagtagagatgggtttccactgtgttggccagactggtcttgaactcctgacctcaggtgatctgcccgccttggccttccaaagtgctgggattacaggcatgagccaaccacactcggcctaatttttatattttttagtagagacggggtttcaccatgttggccaggctagtctcaaactcctgacctccagtgattcgcccacttcggcctccgtgcccggcccctagacatttgactttttaaaatgttttgtcatgtcttagtttgggttcacaagaaaaaaaaaaagtaaattaaaaaatctattggcaagaaacatttcaataaaaatggaaaatagactcttgaatgtcatgtttaggaatttgacttcatattttggtagtgtagcttcacaggattttttaagccccagtgtgacagcatcagagatctgctctaagataactgacagcaaatgcgagagaatgcatggagtgaatgagaccagttgaaggtgtcacaggggtccccagagagactctataggaggaggctgtcatgaggtaccattacaggtagaattgatagaccctggccgacttgggaggaagctgaggctattaaaaaagataaagaaaagcaggaactggcagggatttgggggacagagtggagagagaaggatggggaagatgatgaacattatgttggccttttgttttggttgtagatttttatgtatgttatgagtggatttttaaaaaatttccacttcattttatttatatctgaaatatcagtgggtggcctaaaaatcaactttaatattgctaaattgcttgatatcatgatatctataaagttctaaatatagtatcttttacaaaacaaatattgcaaaatgaattcttttattttttcatgttctgctgcagcataaatctccagccttcattagagctgctgttatttctgatttcaacattttttttgtgtgtgacctgcctttcctttaagaccccaaatcaaagaaaatagaatcactctgtttttctggatgactaagaacatcatcctggagaaatactattgatcctttggataaggaatgtaggtgctgacctgtttttataaatataactactgccattcagacaacctttggctgacacccattttttttgacatgggtgccttagtaagtacatcacagcatgtggttgggaatcaagacaaattggggttgggatcccaactctgctgcttgccacatgtgtgactctggaaaagttatatattccctaggcctcaacttcctcatctataaaatggggatttgaaaaaaggacttacttcaagggatagttgtgaggattagtgaaataacagatgcgtttagcatttcctggaacacaatacatgctcaataaaagttatctatttgtaccattatccaagattttattttacagaggtcaagaatcaagagagtttatgaaaggaatgagtgacctttatgttatcaaaaagctaaggaagtatctgtacatgcttaccttccttgaatgatgtaatatgggtctgtcagggtaattatttaaactctttctgagcctctttttacctagaccagtgcctcccaaaatgtggtccttgaaccaccagcatcagcatcatctgggaagttgttagaaatgaaaattcctgggcctacttttaaacctactaaatcagatgctccggggtagagcctagcattctgtattttaacaaactctcaaataattgtgatacactaaagtttaagaaccactagcctagaccatcttttaaaatgtacaatttggctgggcacagtcgctcacccctgtaatcccaacactttgggaagctgaaggggcattgcttgcggtcaagagttggagaccagattgggcaatattgtgagccctcatctctataaacattttttaaaaaatagctgaacgtggtggtgcatgcctgtatttctcgccactcaggaggctgaggtgggaggatcacttgagctagggaggtggaggctgcaatgagccatgatcacaccactgctctctagcctgggcaacagagtagaaccctatcttaaaaaaataaaagttaaaaaaaagtgtacaattaaatggtttttagtacattcacagagttatgcaactatcagcacaataaattttagaacatattcatcactttcagaagaaactcagtacccattagtatttactttctattttcccccaagcccaccagccctgggcaaccgctaatctttctacctctgtggatttgcctactctggacatttcatataaatggaatcacgtggccttttgtctggcttccttcagttagcatcatgtttttaggttcatctgtgttgtagcatatatccatacttcctttcttttcattgttagctaatattccgttatatagacatgccacattttgtttatccgttcatcagttggtggacatttggtttgtttccatcttttagctattacagataatactgctgtgaacatttgtgtacaagtttttgtgtagaatatgttttcatttctgttgggtgtgtaaccaggagtggaattgctgggtcccagggtaactctgtttagccttttgaggagctgctagacttttccaaagtggctctcccattttacattcctgccagcagtgtatgaggattctaatttctttatattctcatcaacacttgttattaaatattttctactagactatcttttgagataatgaattctgtaagcttattatgttacgtcatttattttcctgaaagtaaaagcatttaaaggatgcctcttagctattattgctgaggttggatacctggtttcacatttgtacttccattttgtgattttataaactttcatcatattctttttagcagaatttaaaaatatatatctgaagatatatatcttaataaaagtatatataacaaaaaataaaaatcataataatttaatcttaaaaatacaaagcccttctatcttttttattagtttaacattaaaacaattgagccaggacatttttatcctctgatatgtctagcctagtaattattcaataaatgtgtttttaaatggttgattttcaaacatgagtataaacatttcttagctttgcaaaacacctcctatcaaaagcaactcattttcttgacacattgatttctgattacaagccccagctaaaaaaatagggttatactcaagctgattgacctttctcaaagctggtttttttttgtttttgtttttgttttgttttgtttttccagaggaatggcttcttgtgggaaccaaacaaggacatcttcttctctataggattcggaaggacgttggtaagtgcacattgctcatgcaaaaaaataagttttaatagtcagctagtatacaactgtgaaatcagttattcctggaccattaaaagagagattgaaggttagagggagcacggtgggaaaatggggagaagacttgagaatgcctagggtttttctcctccaaattgtattgccctacctgcatttgggaggtgaggatgaattgctggtttacttattactgaattacttattactggtagtgagtctctaagaaaagaggaggtggttgttttcctcctcttttctttgagactcactaccaataataagaaatactactaatgggcataagcttcctgtatatatggtgtggtggtaggaaaaaaaattaggcaacatcgatttaaaatatcttgttggcttatgaggggtagaacaagaagagaggaccagggtttgccttcatgtgcacttccccctggctgcgtgaccgtgagcaagttctttccaacatcagttttctataaactctctgccccacaaagttgttggggtggatgcaataataggctcgaagaaactgtgaaaactaaagttctaatcaaatgtgactgtcagtaatgtagagtaataactaaagtatttgaaatgtattctgttaaagagtgttttttattggggcagaaagtacctcactgcccttccttgttttcgtttctgtgctctctttatggagaatagatgtgtttaggtattatgccctggagccactctacagaaatctgcagttaatttcatacccttcaatataatatatatttctctggtaaatagcttaagagatagcttaagataaatagagctctcttgtggaacctggagcaagggtaacactgggggaaaaagcaccttactagtgcactcgggaaagagaagatatcctggtcagtttctgcagcagggtaagaaaagaaaccagagaacaaaatagataatttatttcatttctaagtttttcaactgtcctctaaatcagggtcagcaaacttgttctgaaaaggtccaaagaataaatattttaggctttgcagtgttgttactacttaactctgcctttgtaacatgaaagcagctgtaggcaatatgtaatgaataggtatggctatgttccaataaaactttatttacaaaaacatgcaaaggcctcagttaggccctggagcagtacattgttgatctttgttttaatgttttaaatttttaattctcatggcctgtgaagtggctcatgcctataatcccagcactttgggagactgaagtaggaggaatgattgaggccaggagttcgaggccagcctgggcaacatggcaacaccctgtctacaaaaaattagctggatgtggtggcacgtgcttataattccagctgctctggaggctgaggtgagaggatcgcttgagcccaggaggttgaggctgcagtgagctatgatcacaccattgctctccagcctcagcaacagactttgtctcaaaaaaaaatttctttttttagttctcggagccaaaatatttgcgttctgtgatatttgcctggtctataattttaaaattaagctcacattttaattttaaagctaaaaatgcttatcttattcagcattcaacaattgttttttgactctctgctttgctttcacatgtaagtggtgatcagaaattgaaaacaagactttataaatgaagtctcaacacagtatagacctgaactggtaatattagtgttaatctggcttggaaccctggtggcgactattccttgccctatgatcattttatcatgtcacctttgacaaattagttaatgttcctgggccttggtttcgccataggtagattaaatatagacaattaggaaatcaaattctgatttgaaacttttcttcaagaaatgccatttttccctatactcttggtgaacagtttagttctggcccagatctggcctgatgtgggccagaaatagacctgggcccgtgtgaattagttctagggttaatttggtttccagatttgagatatttcaagcctaaataggtctttgggtagactgtctttctgaggaaagggaggggataatagggtcaagaaaagactaggggtagggatcgtaggctctgatctgatctgagtcatttccctggagctcagttgagccagtgacatttttatcctctgatatgtctagcctagtaattattcaataaatgtgtttttaactggttgattctaaaatatgagtataaacattcctcaatagacatctctaggcttcattctgctcctttattttttgagacagggtcttgctgtgtcgcctaggctggagtgtagtggcgctatcttggctcactgcagcctcaacctcctgggttcaagccatcctcccacctcagcctcccaggtagatgggaccacaggcacacaccactatgcccaacccatttttgtatctttttttttttagcattacttagattttttctttttttttttttaggtttttttttccactctttttaattatactttaagttctagggtacaagtgcacaacgtgcaggtttgttacatatgtatacatgtgccatgttggtgtgctgcacccattaactcgtcatttacgttaggtatatctcctaatgctttccctcccccctccccccaccccacgacaggcccccagtgtgtgatgttccccttcctgtgtccaagtgttctcattgttcaattcccacctatgagtgagaacatgcagtgtttggtttttttgtccttgcaatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctcttgtgaacagtgctgcattaaacatacgtgtgcatgtgtctttatactagcatgatctataatcctttgggtatatactcagtaatgggatggctgggtcaactggtatttctagttctagatccttgaggaattgccacactgtcttccacaatggttgaactagtttacagtcccaccaacagtgtaaaagcgttcctgtttctctacatcctctccagcacctgttgtttcctgactttttaatgatcgccattctaactggtgtgagatggtatctcattgtggttttgatttgcatttctctgatggccagtgatgatgatgatgagcattttttcatgtgtctgttggctgcataaatgtcttcttttgagaagtgtctgttcatatcctttgcctactttttgatggggttgttggtttttttcttgtaagtttgatttctttgtagattctagatattagccctttgtcagatgagtagattgcaaaaatgttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctacatatgcctagccagttttccgagcaccatttattaaatagggaatcctttccccatttcttgtttttgtcaggtttgtcaaagatcagatggttgtagatgtgtggtattatttttgaggcctctgttctgttccatttgtctctatctctgttttggttccagtaccatgctgttttggttactgtagccttgtagtatagtttgaagtcaggcagcgtgacgcctccagctttgttctttttgcttaggatcgacttggcaatgcaggctcttttttggtttcatatgaactttaaagtagttttttccaattctgtgaagacagtcattggtagcttgatgaggatggcattgaatctctaaattaccttgggcagtatggccattttcacaatatgattcttcctatccatgatcatggaatgttcttccatttgtttgtgtcctcttttatttcgttgagcagtggtttgtagttctccttgaagaggttcttcacatcccttgtaagttggattcctaggtattttattctctttgaagcaattgtgaatgggagttcactcatgatttggctctctgtttgtctgttattggtgtataagaatgcttgtggtttttgcacattgattttgtatcctgagactttgctgaagttgcttatcagcttaaggagattttgggctgagccatttttgtatcttttgtagtgatggggtttcgccagattgcccaggctggacttgaattcctgggctcaagtgatctgcccacctcagcctcccaaagttccgggactacagatgcgtgccatcatgcccagttaatttttgtactattttagagacagggtttcaccatgttggccaggctggtctggaattcctgacctcaagtgatccgcccgcctcgacctcccaaagtgctgggattacaggcatgagccactgtgcccagcccagtctactcttattttgaactgagagggcttagatttgttcatgtctgaggcctttacaactctaggtttatttcagtcatgctgtcatcctagagcagtgttctgaaaatgtggtctctagacccctggggatcctcaagatcctttcagaggacctacaaggacaaaaccaagtttgcagaaacactaaaacatttcgttttttgttttttttttttttcactgtattgacatttacaatgatggtgcaaaaggaatggtaattaaaactggttagcacctgaacacaaatcagaacagtagtacctaacttcaaatagagatttttttaaaaaaacgaaaaaaacagtggtaccaagctgtactgatggtcattgtgtaattctcaccatgtgctcacagtgggttttgtttgtttgtttttttgagatggtctcattctgtcactcagactagagtgcagtggcgcaatcatgactcactgcaacctataactcctaggctcaggcgatcctcccgcctcagcctctcaagcagctaggactaccggcacacaccagcatgcccagatagttttttcacttcttgtaaagatgagttgtctcttcttgcccagggtggccccaaactccttgcctcaagtgatgggttttatttatttattttttcttttcttttttttgagacggaatttcacacttgtcttctaagctggaatgcaatggcataatctcggctcactgcaacctccccctcccaggttcaagcaattctcatgcctcagcctcctgagtaactgggattacaggcgcccaccaccatgcctggctaatttttgtattttcagtagagacaggatttcaccatattggccagtctggtctttaactcctgacctcaggtgatctacacctgggaggtttctcggcctcccaaagtgctgggattacaggcgtgaaccaccacacctggccagtttgtttttgtttttgtttttttttaaagctagtttcacttaaaagtgttcttggttaggcagtacaagttatttttattgtattttgacttttggcaacacatctttttagtaatctcatatgatataatgggaagtacacataaagcacttctgctgtgtgctagggtgtgaagtccgatagctgtctcaagggaaaaatgcttatgtgattgagttacgagctaaactggctacttttttcagggagtattatttttgtttgaaagaatgacaggttgtggttttttcagaccatttagatatttggcatttttttttttttttttatgaacaaagggaatctgttactttaaggtaaacaactggcagtatttgttgtgaatgataaagttagagcttttaagaaaaaaaatagaattatggaaaacttgtgttcactcccctgagtgtgacagcttctccataattaaagattttttctgatgagattgggggtgataataatgagtgtcattttttaacatcctataatgaaatgtaggtctggattggaaaatctgcataactcagtgaaccagtattttccaaatgactaatgcatgagttttaaaatcacgtatgagtaaaaaatacattcaaagtgtaaggtagaccaatgtttttttacgtaacagaaaatgaaaagttcattgacaggtgtgagatttcgctttacaagaaattacatttgttaagtgttggtgtagtatcaaagaagaatctgaaaaatctattaaagtacttttcccttttcaactatgttatctatatgaggacagattttttgtcatatacttcaaccaaaacaaattaaattatcaaaacagattaaatgcagaagcagatgtgggttcttacttatggggttattattgttatttttaaatacatatatgtttttaaatgtatgtatttaaatttctaacataaatattcatgtatataacccccaaaaaagttctttgaggtcctcagtaatttttaagattatcaagattttgagacaaaaaagtttaagaatctctgccttagaaaattctgtttgtaaagagaattataggccgggggcagtggctcactcctgtaatcccagcactttggaaggccgaggtgggtggatcacctgaggtcgagagttcaaggccagcctggccaacatggtgaaaccctgtctctactaaaaatacaaaaattagccgggcatggtggcacatgcctgtaatcccagctactccagaggctgagggcacgagaattgcttgaacccgggaggtggatgttgcagtgagctgagattgcactactgcactccggcctgggcaacagaatgagactctgtctcaaaaaaaaacaaaacaaaacaaaacaaaaaaataagaaaagagaagtattaaatgcaataataggacgctttcaagtgtaggaagtgtctgaattgtttttttttctcatgaaatgtaacagcagaataccagggcacactccctgcaactttagggccctttcttcatcccctctgctgagggacacatggaagaagtaagaccagctttggtggcatgagttcttatggctgccccaaagagtctccctgatttccagagggcaagggcagagctagctgtggggaacaactcaggtcagcagtgcgagcatcctgtccatgaagtagaaggcaggtagcagggcgtgggttcagagcacaggctttagagtcagcctgggtttgcttgtaggctccctcactggctgttacctaactgctttacccctcatgcccctcaaatatgagcttggaataataatacctacttcttgggagtagttgtgagtttacagaaaaaaatatatataaatttttaaaccccgaacccagtatgtagttattgcttcatgatagctgctctgatgatgatgatgataattattctctttttgactcattggtgacttttgaggctgaatatttttgtcatccccagcaaggctgaattcacatgtttttatggtatataactttcttccccttttttgtaacagtgccagcagatgtagcatcacctgaaagcggcagtaagtgtagacgcattgaattgctttagctctggagatgggtttgagtgtttgctctgtctccgtgatacagaacttagttagaatagttgctggaaattagttggtctagatctaaggatgctttgggctgggtttcatggcttgggctcttatatttgactgttactttttacacccttccttgtggaacactttgccaaggtactgattttgcaagataagatcttcagactcacgagtaccttgccgcttcagtgaactttgtgtgatcctttctgctgatgccgagtgaaggtgcatgaaacgctctgctctaaaattagagttgaaagcatcttatagtgcttgtaagagagctggctatttagatctctgatttttagtctttcaggaacttccaaagatttatataggagagcagtatggagcagtatttttctagtagtggtttttctatgtatccctgtatttggaactaccagtgtttatttgttttccataggttgcaacagatttgaagtgacactagagaaatccaataagaacttctccaaaaagattcagcaggtaagcagtgatggcagtccttacaagaatatttgacttacatgagaccctgtcagactagaactttggtaatgttatttattaactctgaatcctcttctctttgaccttctatttatgcaggagtgtctgctcatatatcatgtgcctgagatcctctctcacaagcagaaatgataatcacagaaattatagtgcccagaaaaatcagtgagatccctgtaactggataggctccgtggtccctttttattactgttattgaatgaacatttgctaaaccttgtcagaaatgtttaattgggtctcatgatttcctattttccagatccatgtggtttcccagtttaagattctggtcagcttgttaggtaagaaaaggagttgcatttgtatcctgtgtctaacaagaaaagatatgacctaattaatcctttcatggttaatttgatagtggttacttaacaatgaactgacgtgttccaaacctggtataacagggtacatggttaataaaggcagcagcatcctccatagactcgaactcttctctccaaggagtctcactttattcattcattcgttcattgatcaaatatttattgagcctattctatgcaaagtctggactagacattcgggataccaagttcagtgagacatagttgctatctttgagacttacattctgattatgaagactaaatgacaggaagtaatcacgatacaatgtggtaagttacagtgaaaatttataaaaagtgttgtggaatcttggtaatgggagggactatattgtctagtagataactagactttcagtaggaaaagaggccagcagcgtatcacaaacacagggaacaactagaacaaaggccttgagatgtggcagtttgtggcaaattgtttattgtggccagactaaggatatgtggtggagattggcaggatatcaggtaagagacagagcagggctacactgttgaggccctcatgtgaaaaaccatggtttcatagaaagcagccagtgaggccttttctggacatgcaggggactagcagctgatctcacactttgcgctgttgaccctggggcccaaagagtaaaatcatgttaaatgttgttcctgggtccacagataaacatctgaggtaacttaatcttcatgactaaaactagatatgaggcccaggtaaaatgattattttgattgctttgctaggaaagaaatcattgccatgggttagtacaaaatgcacaggggatttcccttttctaattggagcctcctaatgtgagtagctttgaaagccatttcttgtataaatactgcatcataatatttcagacttgaaatggacagagtataagagtgctttggactgggtgcagtggctcacaccagtaatcccagcactttgggaggctaaggcaggaggattgcttgagtccaggagtttgagaccagcctgggcaacacagggagacctcatctccacaaaaaataaacaaaattagccaggtgtggtggtgcatgcctgtagtcctagctactcaggaggctgaggtaggaggatcacttgagtctcaaggaggttaaggctgtagtgagctgagatcatgccccttttgttgatgcactctagcctgggcaacagagtgagaccgtgcctcaaaaaaaaaaaaaaaaaaaaaaaaaagagtgttttggaagtgaaagatctcttttactcaagtcagccccaattttttttttttttttttttgagacggagtctcactctgtcgcccaggctggagtgtagtggtgcagccctggctcactgcaacttctgacctcctgggtcaagggattctcctgcttcaaccccctgagtagctgggattacaggcacccaccaccatacccagctgatttttgtatttttagtagagacagggtttcactgtgttacccaggctggtctcaaactcttgacctcaagtgatctgcctgtctcagcctcccaaagtgctgggatgacaggtgtgagccaccatgccgggccaagctcaaatgtttaaggaagaaaatatccaagtttagaagaccaagtgacctcttaaatgctttgtactggttataggtgagaatgaatcatcctagtgaaactgaagggacatcttcaaccaacatctgccatttgcttcttctagatgttaacacagttactttttttgcctcgatagtggctatgctagagaattatgatcattgatcctgatgttatacctcctcccaaacagaaaataacatttatgtccatgacctattgacatttcaacaaatcactacggtttcaaaggcaaagggagcatcactgtttacttgtgacctccaggtaagtttacccaagatgaaatttggctttatgctttaatcaatacagtctttcctacatcattcctaccattagatgggaagaatgacactgatgatccatacccaacagagactccaaagattatttatttatttatttttttcctgagatggagtcttgttctgtcgcccaggctagagtgtagtggcacgatctcggctcactgcaacccctgcctctcgggctcaagtgattctcttgcctcagcctcctgtgtagctgggactacaggtgtgcaccaccacgtccggctattttttgtatttttttaaattagagatggggtttcaccatgttggccaggctagtctcgaactcctgaccttaggtgaccttggcctcccaaagtgctgggattacaggcatgagccactgcacccggcccaaagagaatatttaattgtattagagaaatttctctgttggtgcatagtgtgaagttgaagcgtttgcattccctgtgcgtgggttaatgagaatctaatactattggcaagaggcagctaaccgaggacaaaaactctcgtcctggacaaaccattgttgggaaagcaagactgtaacaatatcatgaagataattataagacattaaatggagtcttgttctaaacagatcactgaggtctttgtcattagggacttttcattgttcagaaaagatatcgctctttatttttgccaatttatcattcttttattcttcagaatctgcctcacccctctctctactcaacttaccattttttagcatttatgttctacattgacactgcatcattttatgcttaggaatactcttttccttgctctttaaaggcttaaaagtgggcttgatgtcactggcacatggtcacccttaacccagcatgcattgacagccaggagcaagaaacatttaagagcaaaaaggagggaggagttatataggggaaggactgccccaggattttctcctctgaattgtgaatgtccatgtgatttgctggtgctgtggtctttggctggcaacccttcgggaggaagtgttcctcagtcacttgtttcttagcgcatcttagagaatggtgttctgctcagctttcctggcaggatgactgtgttacagggaattttcagagtagtagcaatttcaaggtagacaatctctaatttagttatcactcagttagagagagtcattgtattttcatttgctctgcatgtctcctcccagcacacagagaccggtgaggaggtgttacggatgtgtgtggcagtaaaaaagaagctgcagctctatttctggaaggacagggaatttcatgaattgcaggtaagtccactgttccttggtccatggttgggtgggagctgctgcagtggctcggttctagtgaagttcaggactccagtcttgtcattctacgcaaatgaatactctggtatgaagtgcatgagagcttgttgatgcctacttgtaatatgattctacagtgtttttatagattggtttatttcaaagtgggttttcaccttttccaaatgtactttgtccagttcatggacttgtatttttattaagggtagtttcctggccttgtgcctgtagaattgtgcccgatgagggtgagggttgttttgcagaatggaggttgcagaataacaggaaagtcatgattttttaaaaaaatatttatttcattcagatccttgctctcttttttcagggggactttagtgtgccagatgtgcccaagtccatggcgtggtgtgaaaattctatctgtgtgggtttcaagagagactactacctaataagggtaaaatcttattattttgcaaatatcattagtttatcttggggaagatgattatctgctccaaactccaggtcaagcgaccactttaagtagagcttttggcataacaggatttgttatttgtatgtgtagttatcattcatgctcagcatttttcacaaataggatatctttgtaacttaagtcagtccaagagtcaacgctcagttctttacgtaatgatgatccacagtgtgtattttactattgggacagataatgaaggctgtttgcctctgtccagtggatcatcatggactgctatcctaaggcttcagtgcttaggaattttaaactaattttagtataaacttaagtatttttaagactttgagtttcctctcctgccgtcaaatctttttgtatgtttgtactaaaagtgattctcactatttttttaaatttcaaaagccacgtgtttttacacgtgtttattacagaaaatatagataaggagataaaggaagtgcaaatcaaccatagtccccccactcagaaatagtcactgccaacttcttggtatatgaacttccatcctattggtaaaaatactatgctatacaattgttttatgacctgtgttttctcttaacgtaagttgtaaatatccatgacgttgtttttctccaatatgcatactatatgtagaaaagattgacacactgttcgtttcattgaataatctaaatctcttagcttcacaccccttgtaattcagacatggcaattctagaagcctctctctctaccttccactgggtgagctcttcattggttattttattttatttgagacagggtacccctctgtcacccaggcgggagtgcagtggcaggatcttggctcactgcagcctccgtctcctgggctcaagcagtcctcccacctcagcctcccaggtagcccagatgcctaccaccatgctcagctaatttttgtattttttttttttttgtatttttgtagagatggggtcacaatatgttgcataggctggtcttaaactcctgggctcaagcagccctcctgcctcagcctcccaaagtgctgagattacagccaccatgcctggccccattgttatcttgttaatatatttgttccatctttgtgtcatttgaatatcctgattttatcagcatcagagttgcagactcctggaggagtcactgctgtgccactgactcaatagcaagtaggcctacagatggtgagagagcgcacaaggaataagggaactgagcaaaagctggacttaaggctctcagttctctgactgccttggatgctgacatcaccttcagggtgggaaaccttgctttaggaccaggctattcagaaattacttatttacatacagtaaaatttattctttttggtgtacagttctgtgttttgacaaatgcttagatttatgtgactaatgccacaatcgagattcacaacactaccatcaccccccaaaattccctcatattgaagtcagcctctccttctgttcctagacctctggtaaccactcatctgttcttcatctcctatagctttgccttttccagaatgtcatataaattgaatgacacaatatgtaggcttttgagtctggcttctttcacttagcagaatgcactggagatttatccatgttgttgtgtgtgttaatagtttattctttctcatggctgaatagtagtctatggcaaggtgtttgtttatccattcatcagttgatggacaaagttgattttggccaggcgcggtggctcacacctttaatcccagcactttgggaggccgtggcgggtggatcacgaggtcaggagattgagaccatcctggctaacacggtgaaaccccatctctactaaaaatacaaaaaaaaaaattagcctggcgtggtggcacacgcctgtagttccagctactcaggaggctgaggcaggaggattgtttgaacccaggaggcggaggttgcagtgagctgagattgtgccactgcactccagcctgggcgacagagcaagactgtctccaaaaaaaaaaaaaaaaaaagttgttttcaatttttagcaattttgaataagcatctaagacatttgcatacaagcgtttgtgtaaacatacattggcattcctgggcaaatgcctgggaatgggattgctggggcatatggtaagtgtatctttaaggggcatatggcaagtgtatcttaaactttgtaagaaaccaacaaacaaaacagctgcaccattttgcattcccaccagcagtgaatgtgagttctagttgctctgcattcttgccagcacctggcattgtcagttgccaggctagatgctttcctttgcattagagaacgggttttacattgtgataacaacggttattataataaactctgtaacattttcttatgtcaaacaaggaatattattggcttctctaggtttcgggttctatctggatttttcctgtgttcttacctctggctggggaatgctaggtgactcactctgtttcttcctataggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatgggtgagaccaacagtagctgctgtttcccactttgggttgaggttgtgtgccattcctgcagaacggagtcccattcgtagctttagcagactggtttacgttgtgtcattcactttcagttccccttcttataagtagatgacattttagggtcattaaaaatgggatagtctagttcttgcaagaagctgagttttactccagagggggaaaacatataaacagaaatgtttattttaggaagtgattatctactgctatcttttacttcttagtttttttcttcctcctttttttaagagttttgattgtgtcctctgccaaatagactacatttggaaattagtggaaattccttgtgtattcctatagtatgagtaattccatattgaagggtttttgatatagtaattccatgttgaagggtttttctattgttgctttttttttttttttttttttgtagcttagaggcacagacaacatttaggtgattttggtgtcagcctctattctacgcattaggtgcttctgttcttatgcttgcttcaggttcccagctctccacaatggaattgcctggaagcatataaccactcttgccccattttattttcagtcggaagagtgagcattactaaaatagttactgctgtgaagtgggacgtactgacatgctttctgtctttaaagacccctgtctctggagacaagggttacagtcttggataaagagacaaaacaaggcactgcttaaggtgttaaattggatgagttaaaattcagtagttcagagaaagggaagtttgttgtttaattaggaagaagtttcattacataggtaagactgaactatggactaggtcaggcagggagtttggaacctggcttgaagaaaaatttccattcaatctaggcagaaagcccaataaatgagtagaagtccaaagaaagacatgccgatttgggagagggtattacagagcctgacttgatacaggtggtctgaattacagagcagtgaaatagggccagttggtagatgtccgtgagaaggtctgggaggccagtagattcctgaatggtagaatgtcttgataaaagcatcatgttctggccgggcacagtggctcacgcctgtaatcctagcactttgggaggctgaggcaggcagattgcctaagctcaggagttcacaatcagcctgggcaacatggtgaaaccccgtctcaaacacgaaaaaaaaaaaaaactagctgagtgtggcagtgtgtgcctgtggtcccagctacttgggaagttgaggcaggagaactgcttgaagggagggggaagttgcggtgagccgagattgtgccactgcactccagcgtgggtgacagagcaagactcccgcctcaaaaaaaaaaacaaaaaacacatcatgttctagggtgattgttctggttgtggttagagataagtagactagaaggaagagaaatcaaaaggtcagtattttaaaaggcccaggattatggatagtcacaagtttgaggggcttatggagctttatgagaggctttcccgatgttctaggcgaccttgttttcccttcagaagaggaactttggtagatgagtttaagaggcatgtaaaagtcaagcgtgtttctgatttcccaggatgagagttcctgtcttccaaccttcgttagtgcctggggccttcatcagtgcttctcaaaaccatgtctgtgtcttactgctgaagaaagttttgaggcacttgccctgtgaggtctcctttgacccacaggcaggattagtcacttcttggtgcttccctaaccctttcaggtatctctgtcacagcaacttgtcacacgtgagcgatctgtctcctctgttcctgtaggagctctgtgaggtctggatgcatgtcttgatccactttgagtccttactacatagtacagtgcctgaaacatcagagcgtgtaagaaaatgcttgctgaataattgcatcattatcctggtcagtcattatttatatgcctgctgtacaccagccagtctcccaacttttggagatataaagagatccagaccatctctattgtcaacaaaagatatgacaaccaaaggggtttctgttatagattacctttttaattaaatgagaacgtattcaagtgggacagattttaaaaggagaaagaaattttacatatgttatacaagttagcactaaagaaaattgtactaacttttcaaaatgaggccagcataaaaataaaataaaaaattcaatataaaacaatatgcttttaatttcatttttctggtaagatgaaaaatatcagtataatagcagtagcgttcaaaatgatagaaatataacttagttctcaagttactcatttctgagttccctcatagctttgaaattttattgtactattcattgatagtataaattgcaaatataataggaaaaactttttatcagaaaatggataattaaactagtgcagcgactcatgcctgtaatcccagcacattgggaggctgaggcaggaggactgcttgagcccaggagtttgagaccagcctgggcaacatagtgagaccctgtctctacaaaaaatacatttaagaaattagctgggcatcgtgctgtacgcatatattcccaggacttgggtggctgaggtgggaggattgcttgagcctgggagatggaggcggcagtaagccgtgatcacaccactcactgcattccagccgggcctatagagagagactctgtctcaaaaaaaaaaaaggataattagaaatattagcaaattagacacactaagaaattatttttatgaatatatattttgaagttaaatttctatgtggtaattatgcatctagtggtttgctttttactaatttttttacttttaaaaacatttttatttttaaatgtaaaaaacacataacatacaatttaccacctgaaccatttttaagtgtacagttaagtggtattacgtatgttaacattgtggtacaatagatcttcagaacttttttatgttgcaaaactgaaactctatacccattaacaactcctcagttcttctccctccagtccctgaagccaccattctcctttctgcttctatgaatttgacatcttctagatacctcatataagggaaatcatacagtatttgtctttctgtgactgccttgtttaatttagcataatgtcctcaaggttcatgccttcctttttaaggctgaaccttaaaaaggtaatatatattccacttaaaaaggtaataaaataattacttaaaaaagtaataatattccactgtgtgtatataccacattttgtttatccatccgttcgtggatacttgggttactttcaccattggctgctgtgaataatgctgctacgaacatgtgtgtgcaaatatctccttgaaatcctgattttcaactgttttgaatatgtacccagaaatgagattcctggaccatatggtgattctatttttaattttctgaggaaccaccatactgttttccatagcggccgcaccattttacagtcccaccaacagtgcgcaagggttccaatttttccatattcttgtcaacacttgttattttcatttttttaatagtagccatcctaaaggcgtatgaggtgatatctcactgtagttctttacggattcttgatatagcacagaatatagtcatagaaaatatttctattatctctaagttagtgaaattatgtttcatatagtatacaaacaataaatttatcttacagttcagtgtaaggtaaagcagatccttattcagtcttgttctgagatttgtgtttttaaagatatgttttgtgttgcttattttctaaattccctccatttatgttaaatctccttcaccatacaacttctcaaatattggaagacttgatttgcaatgattttatggttttgtcagtctgctttttgcatgctgacttctttagcactgtgtggaattgttctgcttcatccagcattttaagctttggactgtcacatgcttgtcaaaaagtacagaaaaatatagtggatatattaaaagttattttcaaaagagagaggaagagtgaagaaaaggagtataacccaataatttgtactggatcagaagggtaaatttggggtcatggatagatgaatgaaaggtttttttttagatataatagaggaaaacaattttaagactcgacagcaagtatcaaatagaaatgccttcactgagaagtccatccagccaccttctctgtgtaccattaagccatgtcttagttcatttgtgcagctataacagaataccacagactaggtaatttataaaaaccagaaatttgtttcctcacagttttggagacttggaagtcccagatcagggtgccggcatctggtgtctggtaagggccttcttgatgctccttcacatggtggaaggagaagggtaagagaaagatgagctctgcattctcacatggcagaagagagagaacccactccacaagccctttttatagtgcattaatctattgatgaggctggagcctcaccacctaaacacctcccattaggccccacctcccaacacttttgcactgaggattaagtgtccaatgcataagttggggagggaataaaaatagccaaaccatagcagccatcaggtggagcatcacaccttttctctgtgaaaatctctagcagaaacaacattggctagaaatgtggaactcttcccttagagtaattttagggaaaacagaatttgccttccccctacctttcttttttatttcttttttttttattttttattttatttatttatttatttatttatttatttatttatttatttatttattgagatggagtcttgctctgtcgcccaggctggagtgcagtggtgcatctcggctcactgcaagctccgtcttccaggttcacgccattctcctgcctcagcctcccgagtagctgggactacaggcgcctgccaccacgcccggctaatttttttgtattttttttttttagtagagacagggtttcaccatgttagccaggatggtctcgatctcctgacctcgtgatccacctgcctcagcctcccaaagtgctaggattacaggcgtgagccactgcacccggcctttccccctcccgccacttttctaagagaatgaaagaagaggttctgttacctggttctcccactgatgcattgttatgggcagctgcaactggcctttgtctggcctggctttgtgactgatgaaaaaggagcaagtgaaacttttatccagttctttggggaataaggcaggagtgggatcaggtgactgtcagcacagctgatgtgtcttttttgtgcaagagatttctctgatcataactcaagcaaagcaatttttttttatttttcttttttttagagtcaggatctcactctgtcacccatgctggagtgcagtggtgcagttatggctcattgcagcctcaaactcctgggcttaaatgatcttcccacctcagcctcctgagtagctgggactacaggtgtgcaccaccacacctgactaattttttaataaatgtttttgttgaggcagtgtctcactaagatgcctaggtcggtctcaaacttccggcctacgtgaccttcccacctcaacctctcaagttgctgggattacaggccaattttttttttctttctttctgaatcacagtgtaagatcctggcttgatatttgactaggggactttttggagatccatttaaatgtatcttagaatgggcagctgaaacactccataaacccaaagccttagaccggaacaactgctgtgtatgttctctttcacagagcaccagcctccctacatcattgcagtgttgcctcgatatgttgagatccgaacatttgaaccgaggcttctggtccaaagcattgaattgcaaaggccccgtttcattacctcaggagggtaaggaatttctttttttgctatggctgtatattatcccaaagttgtaaagtcacctgtgtcatcacaaagcctgtgatcttttgctaatattcttactcttgcttccagatcaaacattatctatgtggccagcaatcattttgtttggagactcatccctgtccccatggcaacccaaatccaacaacttctccaggacaagcagtttgaattggctctgcagctcgcagtaagtcttgttcctgactagtcttccttccttattgttcttgaaagtaggtgatttgggtttcaatgttcatatttattttgggttagtagaataagcacatagctgaaagtccagggccttgaatactaggtctgactccaccgtaaaatatctatgtaactctaagtgagtttactttttcactttatctgtcaaatgtagaatgaatatcaattctagtaatagtaccttgtagaattaaggtgagagtccgggagcagtggctcacgcctgtaatcccagcattttgggaggccaaggcgagcagatcacctgaggtcaggagttcgagaccagcttggccaacatgacaaaaccctgtctccactaaaaatacaaaaattagctgggcatggtggcaggaacctgtaatcccagccactcaggaagctgaggcaggagaattgcttgaacccaggaggtagaggttgcggtgagccaagatcatgccactgcactccagcttgggtgacatagcgagactctgtctcaaaaaacaaaaaaaaaaattaatgggagaataaaataatttaatatattgtatggtcatgaaaaattaaagataatggagacattaaagtttagtagcaatcataaatatactgttatagtaaagttgaatgcaacaactagaggacccctcaaaattcctttccacagtagactcctatgtttggataagtaggctttcttttgatattctgaaactacttcaagttgttgtattcagccaggcggcagtcttatatttatgatgcttactgtaatgtttgcaagggatcttgttcacagcaaaatagtgaccacctcttgttccaatgttgatgtcagagtctgtgtcttgttcttttaaacatcgtcagtgatgattattgtcatctgtagggggtggatttgcttttaggaaacaaccaaaagtcattctgagcctaacctagttgttaaaccagatattgctactttatgtatttgggggttttttgaggtttttttttttttttttttttttttttaaaacagggtctcactctgtcacccagactggagtgcagtgatgcagtcttggctcactgcagtcttgacctcctggtctcaagtgatcagcccacctcagcctcctgtgttgctgggaccacaagcatgtaccaccacacccagctaatttgtttattttttgtagagacagggtctcactttgttgcccaggctggtcttaaactcctgagctcaagtgatcctcctgtctcagcctcccaaagtgctgggattatagatgtgaactactatgcccagcctcagatagtgatactttaaagaagagatgtttatgaagataatagtaataaaactgaatttctagagtatcctgtaaactatttctaaaaggaaagcacttttttagaatgcagatactttaagttacctatggtggctactcgtgaagaacatttactttggacatatatgttctggatttaaaataaaaatctgatcttaatagtaagacatagttaatattccataaagatgattgctttcttagagcactgaatttcagcatcttactgtttttttttctactcatgcattgtcctatattattttattttcatttttaaaaataatacagtgaatacccatgaactcaccatcctacccaagaaccataacttttataactttttataatccttcccatcccatccctctgcctctcctccagatgtaatcattatcctaaattttgtatttatcatgaccttactcttttacatatatatttaaaatataaacatatttagtatacgtttaaaatatatatttaatgattaaacacatatgtttaatcttttacatatatttaacatatggaagtaatgtatttagtttttgataaaaaggttatgcagtatgaaactctttagtctatttttcttagcagaaaggtctcagagtcttttcagtgatcttcctagttcaggttgtttaatctcaggtaaagaaaatggaagtgggttcccatttttccttctcttttctaggctcatacttattttgtgctctgccctttttatgacaaaaaaaggttgattgacatcatgttagtccaggaagaacctatcttttatttaaatagatacacaaacataatggaactttcagagggaaattacaaactaaactttggcattgataagtcctggagccaagtgtcagagagggacagttcgctgtgggctggaaaaggcatcctacggctggacacttgagttgaccgtttaagaatatgttagattaggatcaagagcaggaaatggaacattccagatggagaggaagttaaagaagtgtaaagtgtggcctgtgtctatcgcatttggagcctgtcctgactggagaagaaggtatggcctaagtgtttgggactcagctagataaggaagctggcaccaggttttggaagcctttgaagcaccaagcaggagagcggagaccagggacagccacatgttgatgatggcttggactagtgtggcggtaataggaaaagaaaggaaagggggaaattgagagacattttgaaagaaaaaactaaatttgataaagattggctaaagaggtataaggggaaaataggttatgaggaagaagcaaagctcatagcagctgcatttgtttagcttttactgagaataggacctttcccgaccgtgccagctatgccagatggctttctgttttttttctttctttttttttttttttcccgagacagagtcttcctctatcgccaggctggagtgcagtggtgcaatctcagctcgctgcaacctccgcctcccgggttcaagcaattcccctgcctcggcctcctgagtagctgggactacaggcgtgcgccaccacgcccagctaattttttgtattttagtagagacggggtttcaccatgttggccaggatggtctttcctgacctcatgatccgcccgcttcagcctcccaaagttctgggattacaggcgtgagctaccgcgcccggcccatcggatgtttttcattccttgagtacactgtgctctctctgccattttaaagccttgcacatgtgctgtctcctttgctggggagtacatgctcctcttcccctccctgtcatctgctcagcctcatttagctaactcaaactcatccttttgtttgagatggagtctcgctctgtcacccaaactggagtacagtggcgtgatcttggctcactgcaacctccgcctcctgggttcaagcagttctcctgccttggcctcctgagtagctgggattacaggcacatgccaccatgtccagctaatttttgtatttttagtagagacgggtttcactatgttggccaggctgggtctcaaactcctgacctgaggtgatctgcccacctcggcctcccaaggtgctgggattacaggcatgagccaccgtgcctggcccaactcatccgttatgtctcagtttaggtccctcttggaatccatcctggaccccggactcagactggattggggacccctcccacatgcttatcatcactcttaccctattttgtgtttttaaactaaactctaggttttattcagatttggccagtttttctattagtgtccttttttctgttccagaatcaaatccagaaatcagattgcatttagttgtcatgtgtccttagtgtcctctggtctgtgacattttatctttccttgtttttcatgaccatgacaattttcaagattaccggttaggcatcttgtagaaaccctgttgtgttttaattgcgtagttacttagcagtcttacagttagactgtaagggcaggctgcaaggtggataccatgtggctgtcttgtacactttgttttattttttattttttttttgagatggagtctcactctgtcacccaggctggagtgcagtggcatgatcttggcccactgcaacctctacctcctgggttcaggtgattctcctgcctcagcctcccgagtagctgggactacaggcacgtgccaccacgcccagctaattttttgtatttttagtagagacggggtttcaccgtgttagccaggatggtctcaatctcctgaccttgtgatccgcccgcctcggcctcccaaagtgctgggattacaagcgtgaggcaccgcgcccggccttgtcttgtacactttggtgtctgtagctcctagcatcttctctaacatcaagaacatactgaacaatatttgttgagtgagtgaactcttacatattctgctccgttattaggaaatgaaagatgattctgacagtgaaaagcagcaacaaattcatcacatcaagaacttgtatgccttcaacctcttctgccagaagcgttttgatgagtccatgcaggtctttgctaaacttggcacaggtaacaagtggtgaggcctttatataagggactaatggaggaggggagcctgaaaagtatggggagaaatgataacagacttctgagaatggagaaggtttaggctcagctaaattgatcctcatacctagcaagatcctgtggggtgaccacagtggttacatatctatactcctaatcctatgaatctggtcttctcaataaatgtggactcccaattttccagtatgatatgcccttgccattagagaaaggtagcagaaagtcattcagttcaacaaatgggtatttgatcagctagtgtttattgaatgctgttctgaaccaaagtccttggattaaactgcagatcatttatgagagccaacacagggcagtgccatgaagctcttccttttcttaatgtcctgaaacctctagacatgagtgtagtggcgaggagcaggtaccctggggtctgcctgaggtctggtagagttactggacctctctgtgtttctgctttctcctctgcaaaaaagagatgatcatactactgcttgctttagagtgctgctataaggattatatgaagtgctttgaacagtgtgtggcacttaacaagtgctctgtaagtgtttgatgttattagtattgaatttcattactgtatattcaaaactgtatatcccagttttgcttaatttggatcaatctatctatatatacttggattgactctatatcatactagcatctcctcttttctcctcttcattgctttgccttttttccaccattcctcaaccttggccagtaatgaactgtggtaattccctgtatcagtcaagattcttggttgtgagcaatggagaccaactctggatcgtttaagtagaatctggataaattaagcagagtttattggaatattagggtaatgacagttgaaagaattcataaaattgatgggagattaggctggggaatagatggaaacgaagggagctctggaagccctcccagctggaaacaaaacaggaagccagacaatgatcagtttgtagccaggacaggctgggccatcctgcactagcatagccaccttcttagccgttgccactgccacttcccctgttgttgcatccttgataaaaattgccctctgctagtgtattagctgtctaatgctacgtaagaaatctccccaaaactgtatggcttaaagtaacagtaatcatccatctctgttagtacttgttggtccggagtttgggaaggggtcagctgcactgtccttgcttcagatctctcaggcagttgcagttttatgtcacctgggctaccatcatttgaaatcggggctagaagatccacttccaagctggctcactcatatggctgaaaaagtggtgctggctggagccaggggcctcagttcttgtccaagggggtctctcttcagagctgcttgagtgtcctcatgcataacagctggctctttccggaaggcgtgtttaagagacctaggcagaagcttcaatgtcttttgtgactctcactcttcctatattctgttggtttacaagggtcctgccaggttcaaggcaaggaagttcatcagacttcctctcttgatggaggagtgtcatgttacctaagaggagcacataggatgggatgtatgatatatgttggtgtgtaccacgctacttgtcatccttgcatcatttcctccagatcaagggatctgattagccaggattaggtcatggtctgacccccagactctactaggggtggagaaagaggtttggctcccctctgcttctgaaggcaaaggtaggtccctagagctatcctaccaccaagactccacatagcctggaagagagaacttgcccttatctgaagtacctagagtaggcagattcatggagactgtaagtaaaatagagaggttcccaggggttggaatggagggagaatagggagtaattgtttattattaaggtagtttcaatttgagatgatggaaaagtcctggagatggatggtgtgatggttgcacaacagtgtgaatgtatttaatgccactgaattgtatgcttacaaatggttaaaaggataaatattgtggcatgtatattttactacatatagacacacagattgttggatgagctgaatgagcagaagacagggttccactactggacattgatgtgggcacatccctgtgatccagaggtcagcaagttgctactgcttccacagcctaagccctgtagtatcctcagttcccacagagctggtgactgagtgcaggctgctgtatccaggcaggtgcctctatggaatggcagagctgataaccagacactggaaatgccgagtctggctgcacacactcatgagctggaagagggaggcttccatctcactttcagtttccaaatctcatatcctgtttctgggtggaaccagattttcacttagaaccctgactgctagggagtttgataaaagtagttttcagttttatagcccctgtggactataaaggagtagaaatggatgggaagtgccaattgaccatacaccatagtgttccacagcattgatgcactgtaaattatataaccagcccccagtcagtgaggggatatgttggctacttacagcattttgctgttacaatctgggagtggccaggtacagtggctcatgcctataatcccagcattttgggagaccaaagagaagaggattgcttgagcccaggagttcaagaccagcctaggcaacatagtgagaccttgtctttacaaaaaatttaaaaataattagctggcaggatagtacatgcctgtagtcccagctacttgggaaggtgaggcaggaggatcacttgagccaggaggtcaagactacaagaagccaagattgtgccactgagcaaaaccctgtctcaaaaaaaaaaaaaaaaaaaaaaaaaaaaatctgcgagcatctgtgagaacaccataaattctaaggcagaaggaaaatgtcacctctttgacattgttaacgtgcaccattttgattcttaatatagcagaacattttcccacatatttatattctcttgtcagttggtcttgtcttttggtcatttgtcaaatgaagtcttacattttattgccaatttatgtgaatttgtttaatcaacatattaccctcttttaaaaaatttttttgagacagggtctccactcttgcccatgctggagtacagtggcatgatcacagctcactgcagcctcgacctcctgggctcaagcgatcctcccacctcagcctcccaagtagctggatacaggcacatgccaccatgcctagcaaatttaaaatttttttgtagacatgtgttcttactatgctgcccagtcttgtaatcaacaaattagcctcttgccatatatactacaaatatattccctagcctgttgtctttttttttagtaatgtttctttttttgacttaaattttttattgttgagtctcttgatctcttctacttcaatatcagcatttttccttagaaattttttattctctactttcagaggcttgataaatattcaattctaattatgtgtgtgtatttgaatatagtcaggcatttttgtgatgttttagtgaattttaacatatgtataaaaagtgctcaaatcataagtctacagctcgttgaatgtttatgaactgagagtcttttttttttttttaaatcagtctggaacttattttgctatagtaatagtcctgttttattttatccctaaattgttgggctcctttccagaggaatcatgtttaccttccatatagatcccacccatgtgatgggcctgtaccctgacctgctgcccacagactacagaaagcagttgcagtatcccaacccattgcctgtgctctccggggctgaattggagaaggctcacttagctctgattgactacctgacacaggtaggtatagtacagagtgcgtgaaagagtttgcctgggagtttcagtacttgtttctttgtggcaaggaattgagggccttctctaatgccaaggcagtctgtaaattaatgctgtaggaagtctgcctggggtaaagtttctttctgctacttctaactttacagtaccattgaggtggggttttctgccaaatcttgataaaaataaacacacccaattcctagtaaattcacacaaagctgttatagaaactaaaaaaagtaaattttagttgatagaagcatacaagtttttttaaaacaaactttttgtaatatacatggttttggggaaaatgcctcctgtatgtggaaccacttggaaaacacacacaaaaaagtacaaagcagaaatacaaattacctataactctaccaccagaatgtaagaaactaacattttagtgttgtccttctagacttgtatatctatgaattagcttttgtttatttacttcttggtttatttattgcaaatggatatcaaattgtagattgttttatagcttaactttttaaaaatttagccatatactgagaaagtacttccttatcaataaatgtccttatataacatgttttttagggaggtatttagatttaaaattttttatgatttactgttatagacagatacattttttaagtcagcactaaagccagcatctccattaaagtctcttaaccctagatttctgtcacagaaggctattgtttatttcctgtgtacccattcagaatcagagaccttattgatattttttcctcttaagtgttttgcagatctttgtaagaggtctccagaatgctctagggtaggcactgagaagtattgctgttggccgggtgtggtgggtcatgcccgtaatcccagcactttgggaggctgagacagaagatcacctgaggtcaggagttcgaaaccagcctggccaacatggcaaaacccagtctctactaaaaatacaaaaattagctgggtgtggtggcccacgcctgtaatcccagctattcaggaggctgaggcaggagaattgcttgaactcaggaggcagaggtggaagtgagccgagattgcgccactacacttcagcctgggcaacagagtgagactctgtctcaaaaaaaaaaaaaaaaaagaagaagtattgctggaaaaattgtcatgccactttccactccctgcctctgggtcagtgagtccctgcaggtctgatcaggcatgggtggccttggcccttccttgacattgggctccaggggtaccctcctggggctggcagcctgcaaggagcacacaaacttgccactgcctacacactgcacacactgtgctaagtaaaaaagattcctgggcatactatctcccaaagccagtggcattgtggaaggccctccactgccaatgtcttagctgtaggaaggtgagcacacgtccttccctggccttcttcactgacaatgggaatgtgtgaagtaactgacactagtattgtgccagagagatggcagagcaagaccatgggctctgccagactcaagagaatacatactggatgaagttctaggataggcagaaactcatctccagggatcaaaagcagatcagtaggtgggattgtttgggaatagcacgaggaactttctggagtgatagaaatgttatcttccttcactgaggtggttacatgcatgtacacatctgtcaaaatgtatctgatggtacactttaaaagattagattttattgtaagttatacctcaataaggttgatttttaaaaaaataaaagaacatgggctttggagtcagcccccagtgtgaatcctgccctaccccttatgtagcagctgacacctgtgccttgggttcctcacctgtaaaataaggataatattatcggcacttgttttaggtttaagatggtatatataaagtgcttggcatggtgcctggtctgtagtaaatattcaataaataattgttgttgtctctgtggcaatttggcagtgctaaaaatcgaatgctaatgtgagatcaggccaataggcatgagctgattggaggtattcagaattacccagtagctcagatgacaaaggaagacttagtcctggccttaaccccacattttgacctttgcagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatgtgagttacctgagcgctcgggtgccacaattcccagttaccctgacagtctgggaaagtaaaagggagtgctagaccctgagggacctgccattagtaagagtgaagtctttgattctggaaaccatatagacttctcctgatgtctgtgagtctcttggaattaagaggatagggcaagatatcaatgcacaattgtacagtggattcatcttctctggtcggattgcagttagtgctacaaagtcagctgggacagtatttccttcaagaaatgttctcccccacagaacattaaaacacattgtgcgaaggtccataaatgctctaaaagcctctacctgctgtcctgaaagagggctgtctgctttctcttgcttgtgctacattcctggcctttcagcctagagcaggcctgggccagggaagggtggggctccccaggaagcagtttccactgaactcctgctctttctgcagacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaaggtgtgggagtggttccttggatctgggaggggctcttgtacatggcaggggaaacccactgagatatggaaatctcccgtggggaaaaggctcatgaccttgttcttgggcttggtggccagctctgcaggtgctcgtggaccagtccaagaaagccaactcccctctgaaaggccacgagaggacagtgcagtatctgcagcatctgggtaagtccgccttttgaaaggggtgggaaagcgctcctgttcaaatgacctggtctccctctgtttctgtttctggttggttgctcccctccctcccgtgctcgtgttcactcaatttcattcctccaaatggcataaaagtccctcggtggttggcctgtgacagccccctggtatggagccagcccagtagggctaacaaccccaagtggctcatgcttgagctgtcttttcaggaaaatgaattctggggcaacctgcccacctgccttcccagtgccacaggcaagatgggcctcaactgctgacaagtcctgcttttccttctaggcacagaaaacctgcatttgattttctcctactcagtgtgggtgctgagagacttcccagaagatggcctgaaggtgagccacaggagtcccttggatttatctggtaaacacttggttctgattgcacttgagacagcagtggatggagaggagggtggattcatgcatctgtcttcattggtgcatgaagaaagggtggactgggaagcgcgagccagcactgtagttggtagagagagccttacacaggcatgaggaggcctgtgcctcgtctgacatgctgactgcctacagatgccttctcgtacccttgccctcctaaagtctgtttgatccctgcgctcacatgcgtgtgtgtttgctggaactgcagtcagatggttctgctgctggaactcgggttcattctaacagatatttactgaagatctcccggaagtggagtctctgccacgtgatcgagtcctcggcttcttaatagagaattttaagggtctggctattccttatctggtaaggtattttttggtctgcactaaaaagctttaaacccaggatccaggactgcgtggttctgttatcgggctgttcagatttgggatttatgtcacttggggattggaaggatgagggttatttcagcttcctctgaagaaaaagatcccagtagaccaagctggaaatgctacctaccaaatctaggtaaactacagagggataaaagaataatgttttagaaaaaaaaattccaaagccacatttggaaaaaaaattccaaagcgaaactcaaaagtgaccacaggacaatcaaataggcttaagtaccaggatgcagatatttaaccacaattacatgagtcgctatgagagtttggaggattatgggacaaaattagtaaaatggagtttagtaattgagaagatggctcctcacgttactgggtcgcattgtgaaacttcctggtggctttagacgagctgtctcttagtcatctttgcagcccgattaggggataatctggatgggacctgttgggccttaaaaatgtgagggaggctgggagaccaggtcacagcctggagaataccagtgacaaagacctacatcttgcctcaggaacacatcatccatgtttgggaggagacaggctctcggttccacaactgcctgatccagctatactgtgagaaggtgcaaggtctgatgaaggagtatctcctgtccttccctgcaggtaccagttcttttaggaagccggttggccccaggccttagaggagagcacagacccaggtgccacgtgtggtgggggtaagcaggccaccctattctctgcccaggtgcgcagaagttctgaagaggagccaggggagctaagtgacacaagcctggcacatgagactcaggagctcttgtctaggtcctggcatctctgagtgtctcagagtcatccctcggggagggtggaaggaacagacctgtctgcaagatgacagctatactgataagaaacaggtttgcccacagagtatttctctattcagcttatttttttaaccgtaagctgatgttttggggccacatggagactatgaactaaaagaagttagcatggaagccaccctggaggccctttctggtcatgtggtgacatccttgaaccccattcccttcatttttcttgatgaccctacattgccacctggcagtgtcctttcattttgagcttggtttcccttaaaggcaaaaccccagtcccagctggagaggaagagggtgagctgggagaataccggcaaaagctcctcatgttcttggagatttccagctactatgatccaggccggctcatctgtgattttccctttgatggtgagtgtctggcttagggccagaagccacttcagcgaaggtcatgcaaagactaatccacccctttaattgttccccaactctccacaaaagttgggcctggaaaaaccaggcatttcaggccagtgctcctgttttgtcctctctgaagactcacttttgtaccgtgactgagaaaagtctccttcctgggtatgaaccacatgctaattgatagccaggttgcaacctgttttttgcttcagaacatgttcttggccaagttcattgttcagcagtttttgtaatctggcataatttgtctttatgagagctgagagcaagcatttgctcatcttacctgaaccacctagcatgttgtaggtggttgttaagtacttggctgctgaatgaatattcttacccagtttatatgtgacctcaaaaaagatgggataaagtacttcctaaaatagctccctcccccttttttaaacttcagttattttctccttgaagaaaaacccaagcaataagaatcctattgtcttccctttatattgcctcgtgtccactcctctgacagcatagcccccaccttgtgcttgcgtgatggcggcagtggttcctcatattccttttcctcctaggcctcttagaagaacgagctctcctgttggggcgcatggggaaacatgaacaagctcttttcatttatgtccacatcttgaaggatacaaggatggctgaggagtaagtttgccccaacatcccacctcctaagcagtctaaaagcaggccctgcagagagatgagagttaagaaggccatctccccatactccactgcgggagcaagaatcgcctccgtcctggcccgcagttttggctgtggttaggctgctcgagcaggctgcacgcacagcctctcatttagatgtgcccccctcacaccacctgctctcaccactctctcccttgcaggtactgccacaaacactatgaccgaaacaaagatggcaacaaagatgtgagtagtgaccctgacccagggagcacgtgtgcatacctctccccgttggtttgaccagaggtggcaataatatgagtggcagaataagacagggcacgagtcagggctctgattgatcttgcatgtgtgtattgagggacagcaggggaccattcatcctggtgtgcttggggtagttctggcgtatatctttgttatccctgtgattaatagcactcctgtctctttactctcttgatttgtgtcataaattatgaggtctgcctgtcgagcgggaacccgtcatggttctgatgtactatatcttgaatacacattgacttttcaatgtctggagacatttttgattgttgtgactgaggacaggggtgcttccagaatccagggggtagaggccagagatgctgctaaacaatgcacaggacagcccccaaaccaggaatcatctggccccgaatgcgcactgaggttgcgaaagcctgtggtactggcaccagtaggcaatgcagcatctcaccttaggatatccccacctgcaaaaatgtgacggagtctcagcttttaaagccaaaggaaatgaggaatctttttgaattgttttacagtggtagcattttgtaaatggcataatggtaaacgaatacaaggcatttggttttttctctcagggaaaaagcaatccttaattaacatcttcagttgcctgtttgaccttaccaatttacaaggtgaaaatgaccagttttacatgctcagtgatagctgttactgtaggcgagcccctcgaatcgttaggcatgctcagtgctgggggttctgggagggttgctgccagcctgacgtagctcatgtctctctgagacaggtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggtcaggagttgttcctagggagatggagggtgtttgcagggagcaccgaatgagaagaggaaatgtggaaagggactagggtccaagagctccacggctgcagacatttcttcattctcactcctgttcacctcacccagtccctatctctgttcctgtccctaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtaggtatgggccttccaaactctagggtgggcttttaacttttagtatgagacaatgtccacatgttcccttctgaccaaggcagagcctgtacagtgcagctcaagctgatccagtagccagcttgacattgaattgccaatgttctaagcagaagaatctgtgacgactgaaagaggacacagttgctggcctctgcctcctgtttctgggtgccacactgtagaacttcttcctcaatccccctgttcttccaggtccaggaagagcggattttacaccagcaggtgaagtgcatcatcacagaggagaaggtgtgcatggtgtgtaagaagaagattgggaacaggtgagcctccttcacacctgtgtggcatctgggctttgtggaggttcccaggggtggagaacgctcaggatggatttctgccctttaacagagaaggagaacatggctgctggctgtcctgacaacttttagttcttgagccttcagagagcagcctgttctatctgttgggagtgggcttcgagaatttaaagacctgcaatgtatggtatggagctgttggattcttgtccataaaactcttcccctcttgaagctagaacctgatatagtgggtgcccaagagatgtaggtctgcagaaagttcttataaggaagatccagtgaaggaagaaaaagatctttcaagctactgcattgtgactcaagtaggatcctgagccagactcatactgtgttaagacatatactctagttagtccccttttcttcaaaggagagtgatttgtctcttatgtagctggaaaaatatttttctttagaaagacaaactcgccgtccttttcagaattagcctgaaacctgttctgatgaacattgttggctctcaggaagccagggctgagctttgggctggtgcactgcccatctttaatatgccttgtgttttgcataataaaaaaataccccatgcactcttaactgtgtgcacctcatcctctgtttggttatttgacagagatgatggctacagaaatccagagcccctcaggcaggctgttctttgaggtttgggtgggctgcttttggaatggccccccagcaatgtgcctcttctgtaggaggtgccgctgccagagaagtggtcacttagaagcagtcctcactcccaagccattttcttccctgcagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaagcct

SEQ ID NO: 37640 - DNA, 118156 bp, Homo sapiens; identical to SEQ ID NO: 37638

SEQ ID NO: 37641 - DNA, 38881 bp, Homo sapiens
cggagccgctgagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggtaagactcccgcagcccctgaacgggtggggctgtgcggggctcgtggtgccccttggtggcccggggcggggccttcggaggccttcgagcccgcggcaactagcgccccacacaaagggtcgaggcagggctgcagggggagtgggatgccacttaggcctctgagatctgagaggatgcaaggaggacgcaagaggatgagcctgcgtaccgaagtggggacgaggccatagcgaggactcccccgtggtctgagagggggcaggccagagctggctggctcagcggcctgcgagctaacggggactgcagtaaaaacacgcctacatcccgagtacggaggatttcttgtctcccccagtgaagcagaggttataactacatctctgtgcctggaggtggggagataatcgtagtgaggacactccttcaacccgaaatggaaaggaggcctttgtggcctaccagcaaaaggggacccaggtcacacctgtggggaggaagctgtagtcggtacactcctgtgagttcagaaaggaagtgtcacaaccggccgccttcgtggcctgaaggtggaggggtttgcagtgaaatgcctccgaggtccattgctggggaggggctttactcgagggtgtagcagttttgagaagccggcgtctgaagctaggaggtgagggggtggggtgagtacgcctcctgaggctctgagaattgtagtaagatgccaggcctttggtcccccagtagggaaggggctgctgtgagcagcacatttacggctccctcgggagaggatcctgtggcatttcaggaggacgagatccagtgggctgcggagggtgggtgcttttgatggagagttaattgagtttctctgaagcttggctgcattagtttgcagccacgtgaattgggtggtgggagggactttgaggatctacaggttagtgacggggttggacgccagtgcagcaggcttagctgctaggttgtaaacgtacgggctttttgtgtgcctccaacgtgtgctttatagtgacaaatctgaggggctcttgtgagggttactcagtattaagtgctaaacatttactcatctgcgtggtgtcatgctgagaattgcagactttaagagatttctgggccctaaaaccctccttggctccaggattctcagagataacctaatataaattgaagaagttggtagggaccgttttatattattcaataatagagtcagtataacccactggaaaaaagtgtgatggcaactgaaggtttgttgaagggagaggctaggcttgtgactgcagtattttagagcttcttgcttgaatggtttgaaatggtgtaatttttgcaaaatgcagtcttagcaacaagaattgtctgggaccttgttaactagtgtatattgttaatgcatctcagagcatttgcagtcgagaaaaatccctcaagtctggacacatagggaaatcttgttttttaaattatagaactacaatacaagactggttgtacttgtttttgaaatttggcagttttgataagaatggaggatttctggatttagtggaaagtgtgcagacattttcaaagagtataaaaagttgggaagaactgttacaggtggttcaaataacgttatggtaatttatgaagaaagtgaaatgtttggcgtgtttatacaaaacaatgaagatgtgcttagtatatattattggacagatttttaatgaaacagggaatacatttttatatatgctcgattaaatgtgattactttgcttatggattgtaatgtataattttcattttctttatgttcaaatctgttagatgaaaaatgtgaagctttagaaataattgtgtggttacttgcaacgtattgttacatgctaataccagtactctttgggcttctttcaccttctttgacacgtcaaatgttttgatgattgagtattgagagtttgggagttgttagtacagtctttaggtgtgaaacttgatgttgtgggccagtgtgttccaggtgctggaatccagtgacagtgttgatagtttttactccattttgcagagagccattctgtcattgtatgaatgtatgttttcttctgtagatgttgtaggaagaaccaagtgtcagtagttggttgcacaaaagatgcttttagatgtccctccctaaaatgcagagactgatgatgtccacttttatatcttttgtctggcccacaagtgcttaatagtaaatgttcatggagtaaaggaatattgttaaatgttttcaactaaacagaaaagataattttatctaaactacagttttatcagattttactaccacacccatataccttttggtttgcacaaaatttaattaagtttaaagccagcttttaagactcaaaaacagagtgaatgtggttgtttaggttagaagtataattttgctctgaagtgaaaatgaaggtagcaacatttttgttggcatttggggggattgaaacataacttaatatttttgacaggaggaatatcttatttagaaatgtcttctgatttgctgcctttgagtacggaatggaggttaatggaaaaattgagtaatgcgttataaaaagtacacatctccatcagtgtcagaataattttttcattaagagtgatcccagactttgatatatggtccatttgggaatggggaacaaaatcaagtggctgaaactgtggttgtttcataatgtttattataatgtgattatactgtttttagcattgtgcccgttgtgattggttctctgttgctaatctctgaggtgaacatttgagagtttgtttcttttggatctgaagaacctagctctgctgtaccctggttcttgttgattaaagagtgataactgaacaaagttaaagttcacttttggatgtttactaccagatgaagagtgaaaatagtcgttttagtttgtgccttgacttcttgatgaagagatttgttgtcagacatttttttctgaaattccaagtgattagaatggctagtaaatacgaaagtctgtcttgccataatatgttaaatttttgtagcagatacttgtgatttgtgcatgcatccggtattttgtcaagttgaagcaagcctttatgttaggactaattcctgataatatgaatggaaaacatactaaagccagcttcttgttttagatcttctgaagtatatcagtggctttaatgacaaatcaggcccattttctcctttcctatcattatgctgtatgtatagatagaatatgtattttagatgttttattgtttagttattattttagtcttatccttctaaagttcagcaaagctttaggtaaatggcgtggatttttgaaatcctgcattcagtcgctagctgacatttagaatacaggaatagtagtttcctggaaaacagtgacacttatgttaaattcttgtggtttttacaaagtgaggtgtcaacacagaagtatttcagttctatttccatttacctttcccttttgaagaggtataataccaagggttgtgaagttctgacttgtagcatcaactttctgcatggttttccttggtatggggtggggtgggtattcctctttgctgaaatagaagagaatcataaatttctatctggattgattttgtgctttaagttgtacacataaaacttgaactaggcatttgtcaaattcagctgggcctttcagccttgccttgtggaatgagaaatatcttccttttaaaggtaatttctggtaaccttttagaaatttttgagagtagacctggtgagttccctttgagcttaactggctgaccccagatatgtccttctcaagatagacatacggtatcttttgagtttgcaagggaagaggctgagaggaaccttcttaccttatattcaggcatatgccctggccccatacctgaccttttgaattggaatctccagtagggatcagatgtttattacaagttctagaaactagaaagttaccctgttatgtggctgctggagtcaaacctgtacataaatattacagtacttcatgctcttgctcattgctttacttgaagcaggtttttttctgtttcacattttcctttgtgacctgttaaactactagatatggctttcaaatgaagaatttttaaactccttagacttagttaggctaggccaggcgtggtggctcacacctgtaatctcagcactttgggaggctgaggcgggtggatcacttgaggtgaggagttaagagaccagcctgggtaacataatgaaacccctgtctctactaaaaatacaaaaataagctgcgggtggtggcgcaagcctgtagtcagtcccagctactccagaggctgaggcatgagaatagcttgaacccagggaggcggaggttgcaatgagcctaatgagcctagatcgcgccactgcactctagcctgggcgacagagcgataccctgtctcaaaaaaagaaaaaaaaaagaggctagatttctacaacatgtaaaagattaatacaatgctctagacttttgattgtgttgattacatatttgcatagctttttgtggtaaaaccatctcactattctttagcaacttgagtagttgactagacgatgaatagtttgtcctttagaaaatcacacagatttttgaaatatgttttactttttggcgatgaatattaaggtcattagttgtattttggtcttggaagatactaatttaagatgagcatcatttggaaaagtagtcgtaggtaatcttaatactgaacagtggcaaatttcttctctctccgaattaaaacatgacctttgaaaaaaaataaaaagcaaaaaatgacctttgaatatagttgtctagacatttggtcatatatgcttgtgacttgttaataacctcaccagtttggaagaaatgacagtgaaagatgagtgacctgtttttattttgggatatactcttaatatgtcaggcatttttagggtgtttttaaattttattttattttatttatttaaattttacaagtttttgagaactgttgtgatgtcagaggaaaaaacactttcccttaatattttgttaatattttgagctccagtggaattagtccttatagcaagaactcatacttcatttgttttgtgatgttggatgctattttgtgcaaaataaaatatattgaaagaataattgcagtaatttccatgagtacccttgaattgctatcttaagttgtccaagaattgttattgtgcgaacttgtgccttttcatcacaaatttggtgagaacctggggaaatagacttgtgttacggagttttctggactggtttaattataaagtgatcaaagcaattagctgtgaagctgagctttatgactgttttaattttcagtggattcgttattgggctaagttaatgacactcttgtaaatatataattattttgagatactcaaatttgaaagcaataccaactaaaaagcatgtgtgggattttgttacggtgtctttctttttttttttttttttgatatgcattctaatgaagtactctggtggtttcagactcgccttcgtaatgtacagtgtggcctgtgcgtgttgttttgtgtttcctgcattgatttttgcctccgtttattctctattgcagtctaaaagttggttttaattggttgcccacaggattgacttggcctctacttcttgttaaggaaattcatctcttgttttatcaggtaagagattttgaatagagagttcgtttttatacaaaataaaatgagatagcttattaagaaatatgaaaatatatgtagcaactatattgtgtgtgtgtgtgtgtgtgtgtgtgtgtgtgtgtgtttttgtttgcttgttttttgttttgagacggagtcttgctcagttgcccaggctagactctgttgcccaggctggagtgcagtggtgccatctcggctcactgcaacctccgcctcccgggttcaagcacttctctgcctcagcctcccgaatagctgggattacaggcgcctgccaccatacccggctaatttttttgtatttttagtagagatggggttttatcctcttggccaggctggtcttgaactcctgaccttgtgatccacctgccttagcctcccaaagtgctgggattacaggcatgagccgccacccaggccggtgtggttttttacaagtttatctgagggataggggtggggtagatgggtgctttgaacagttgttcctttgggggtcaatttcatttatatggatctatttatcttgtgattttcctgataggcagtaagttttattccttagtagcattttagactaattacaaatacagatgcttgttattgatatgtttatttatatttcctaagagtttaagtatagataatgggtcacatgttttagagtacaaattttagactttaaatggaaccttagcaagtggaatctaaccctcttgtttaagtaactaagataggcccaagttaggttgaaatgacttagctgtcaaacagttacttagtaacagaaaagcagatacttttttaaatttttttttaaatttttatttgttttatttatttatttctttttgagacagagtttcgctcttgttgcccaggctggagtgcagtggcgtgatctctgcctcccgggttcaagtgattcttctgcctcagcctccctagtagctgggattacaggcacctgccaccatgcccagctaattttttgtgtttttagtagagacggggtttcaccttgttggccaggctggtcttgaactcctgacctcgggtgatccacccacctcatcctcccaaagtgctggggttacaggtgtgagccaccgcacctggctgcggatattatttcatattttttggaagctagaaacaatttttctcatcagatggctttatgaataaatcttgtattccactttggtttaatattcagccctttccagctggtaatctgaggcagattttcaatagcatattctcatgtgtaccttgtacaaactttcagtaaatccctgctcttaacagaaaatggcttgaagacttaactgtgtatgtcactttagccctgtgtttaatttttgtgttcttgggactatatcaagtttctgtttgattgtcccagtgcaaactagtctctctctctctctcaagttgttttgagtacctggattgcccatgatgtttcccctatacaaagtgattaaccgttttttgaagttgaacaggaaatgctatcacattttgcatacagccacatattctagattgagcaaggaatgtgaatttgatttaatgacttggaaactgcttgatgaacctccttataggctgctaaatagtaaatgagaaaagagactgttggtgtgatgttttttagcgttaatttttcttgttgactcttgaagtttgtaaatgaaaagcttccccacacttcccaaatttctagtgctttataatggcctcacaaaaagcattttctgtttgctagtccatttttctggattaaatttgaaggtggctttttatttttgtgtatgtgtctgtgagaaaactgtcaaagccaagcagtttgtttcttgtttgtatacggcagttgtaatattgagatataattacagattttgttgcattagtatttatataatatttgacaatgaagttacagaattcttagagcttatagtagaaaatcttgccccttctaatattcttgagaagtgataaaaccaaatctcttcattaatttataacctttctgagggtcatgagctgattttatgggcttatatttaaaagttgacttttcaggtggggcgcagtggctcacgcctgtaatcccagcactttggaagactgaggagggtggatcacctgaggtcaggtgaaatcccatctctcctaaatacaaacacttagccaggcatggtggcgcatgcctgtaatcccagctacttgggaggctgaggcaggagaattacttgaacctgggaggtggaggttgccgtgaaccgagatcgtgccgttgcactgcagcctgggctacaagagtgaaactctgtctcaaaataaataaataaataaaagttgacttttcagatgggttggaaaacaccctatgttattgaccaccttaatttcaaagtagtatgtttcccaggcccaataattcggtttgtgtcactttccaaagggctgcccttgaatttgctcttagaagcctttggaactgaaatactgaaatttgaggggaacatttcttttttgattatgtcaaaacaggcatgatctaaggagatcacagagatcctgtaggagttgtgtaggtccaagactgtaacaaccactgagtaattcacactctggttctaaaacaaaaacaaaaaatatttttattgtcagccctctcctaggggaaaataatactttaaaaaattttattaaatagaggatttggttatgagtcattggacctgagttttaattaaaatagtcacagtgaatgggactataaccaggttctacttttgggggtaatgaatcaaggtaactcagattttagctgtcctattcagtagttcttttggcttcttagtatgtcttaaccttgtttataataaataattccatatgtagttttttgtaatgtacaaggcagattgaaaagttttaggatgaataaaataatggaaccagttctcatttaagacttgaatctacttttagtcttaagtattatttacaattcattagtattctagttttttgcttctgttggatggattttgagactgagctctataaaatcacactcttgataattctatgaaattatcaagtatatagggaagatgctaagccagttttaaatactaacttctatatattctttgcatgttttttccctatagattgttaaactttgtttcctgatttgacttagacatttcttttaaatcttactgaatgattagtggtctgaatgatgtatatgtattttactgtcctacagttgttttttcttgaactttttgagtcttgggactgaactgtttccaaaattaatgccttctggaagttgaaattgtctacgttttacattgtaaatggcacgtaatgttcagtttttagaatatctaaattaaagacattgcctgtgatagcttgagggaatatttgagggcctaatatggtagctggtcattcttgtagctaaaaacttggtgtgataaacaggagtctgacctggccgttgccttttctcatctgcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgcacaaaagtactttactgagctataatattatcttgtcagggtttttgttttgttttgtttttaaacctgaaaatattttgtgcctttggagaggtagatttggtaatcttggagaggtaaaaattgttgcttatccttgcctgctaatgctgaagtgtcaagagaagaggatacttggaacagcagggaggaaacttgattcaagtccatagtatccaccttttcagaattttatgtgtatgatgtgttggcaaacaaagcccttaaatgttgaaaactttttatcttgaaagagtttagcttgtattagaatttggatacccagtgtgttttagagggggctagacatataattccaggtagtagctgagccattattaaataatcgggatttgactaagcaatggacaaatcactgagtgaaatcagctgcctacagatatccaaaatggcttttaccatctgaaaggggtggactgtgtgataatatgtctccttttcttgttcaggagagatcagttatgtaattcattgttacctgctttccagtgttttacagcaagaaatagtttatcaactatgtgcatcatcactaatctcccaaaagtagagcttttacagggtatggtagaatcaaacttatggctttccttttttattaaaaatggctttatttcagtcttatctttttagtatagaatctgatcattttgacttgtgaaatgttctggaaagagtgtactctggtagtagcacaattctctgatgttacagtgacttttctgggaaaacccctgtctattcaacaacataagcaagttcatctcctgctcaggtaaatggtaatttttttttttttttgagatggagtctgtatctgttgcccaggctggagtgcagtggtgcgatctcggctcactgcaacctccacctcctgggttcaagcgattctcctgcctcagcctctcagtagctgagactataggtgcgtgccgccaagcccagctaatttttttttttttttttttcatttttagtagagacggggttttgccatgttggccagcatagtccccacctcctgatctcatgatccgcccacctcggcctcccaaagtgctgggattacaggcgtgagccaccgtgcccagctggtaaatggtaattctttaccatgctgttcttgggtttattcttggtgctttggctgctttgtgttagagtctcaaaagcatcctagagtatgactccttttctggatcaacgttaactagcagtgagtagccacggtggcttgctactctacatactgctctatcactggagtccagaaggaggaaaaagccacctgacataaacatttcagacccagggacagaaggacagcactctgaaagtctaagggcaggaaagagtgctgggaaaaatcacaaccaaatcccttgaattctgtcaatagccccacggacctccttccagtgaaaatgtttaagatgtgcttgcttcagcagcacatattaaaaacgaattaaacagagaagattagcatggcccctctacaaggatgacacgcaatttgtgaagcgctcttttttttttttttttttttttgagacaaagtctcacgcttgtcccccaggctggagtgcgatggcgtgatctcagctcactgcaacctccgcctcccgggttcaagcgattctcctgcctcagcctcccgagtagctgggattatgggcatctgccaccatgcccagctaattttttttgtatttttagtagagatggggtttcaccatgttggccaggctggtctcgaactcctgacctcaggtgatccacccacctcagcctcccaaagtgctgggattacaggcatgagccaccatgcccggccctatttttttttaattaaaatgttaaaggttagggcatagagactcagcaaacgtcatatagagaagtggtaaatggcacagctgagcattggaattggctccccagttgttccagacatctggatattgatcttagtaacttactagtttcaagtcattttgcttaattaatggcttgccatttcatgataggagatgactatttcgttgtggggcaatgcccagcaagagaacataattcagtatgaacagtcaaaggtgttgagtgtatttaactcattttaggaatgagctgtactgtattcaaatgggctacttgatggttcattacctccattctgctgctgttcatttcctccctttgcttgcttatatagtaaacctgctcgtaaccaggacttaaaactcttagactgaagccccttcactgctgtctctagcctcagcctcctaatgggtgggagtagttcattcatagcttttgattggtggataagacttgtcaggctgggtgtggtgggtcacacctgtaatcccagcactttgggaggccgaggtgggaggatcgcttgagcccaggaattgagactagcgtgagtaacatagcaagaccctgtctcaaaaaaaaaaaaaaaaagccttgtcacttagagtttgtgcttcatatcaaatgataacaaccacattgtgctacaccacaagtcacacagtgggaaggatttaagagggttaaatagtttttttgtttcttttttttttttttttttttttttttgagatggtcttgctctgctgcccaggctggagtgcagtggtacagtcagctcactgtaacctcgatgtcctgggctcaagcaatcctgcttcagcctcctaagtagctatttttttttttttttaatttttttgtagagatgaggtaattgctggggtaggggtgatggtggagtggaggggtagtttcactatgtggctcaggccggtcttgaactccggggctcaagtgatgctcccgccttggcctctcaaagtgctgggattacaggtgtgagccactatgcctggcctcagtttcttaaaaggttttaaatcacaccaactggtaccagtgcctctgattgccttgatttttctgtgatcccacttggaagtttgttaatgccacactccactatactccacacattagattgcagtgggggctggagagtggcccagcctttatacataactcccttctgtggtttggcctgtgggaccagtagggtccctgtgctgtaactctgactgaagtgatggacattaatgcaactactaattactgatgtagatgagctgctttacttctatgaccattgaattgacagattggaattggaagcacctgtcaccttcaagcttttaagacaacttcacatgaatgtacagcttagccatagctgtatctcatactaacagatttttgcagtggtgtgcacccagcacttatactttggtggaaaagcaaaataaggttcctgttcttcaacagttgagggttttaagtcacaactaagtgcttggttgtgcttatactaggtacattcctataccacgggaaccaggtagtggctttcctggccatttgctaagttatggttagacaggaacaagtgtaaactagtctttgtcatagtgtagtttcctgttgttgaaatattcctttgctttctcggcttccctaacatgtaaattctgaagacccatcttaaactctccccagtgtcccaaatgaatttattccagtgaagggtaaggggcttgcattatgaacaataggtaggtttcttttccaagagctctggtctgcttttgttcatttactcatctcattttgtgctgtaggagatatacactccttttgtgcacactgtagatgcacaggtatttggtgatgcctcagtcctggagatcatcaggaaggcggtatagtactgttgtctcagacaccccacaggtgatagacattaaaagaatgtagatttcagccgggagggatgggggcagaattgactaccctatagatgtcctttgaaaattttgatacagatcacattttttagaggtgagttctaccttatttgcactatgcatgcttgctacttaaaatttattcctttgatcaactcctgtaaatgtggagtccaggatttcctaccttccttccccagcagtcagacaaatagggagaattatattccatgtttgtgcaaggctaacattagcatagatcatgaggggagaccatgtgagtctcactgctgttgtagtggcagggtagatttcagattggggtgaattacaaaatgtgaactgttgctaaaatggttggatatagaaataacattctcagaatcggttcgtggttccatcagttatgtgacttaggacagattatttccctctggcctcagtgtttcttttacagtatgggattaaattagataagcttgtgtccagttttaagcttctgtgattgtatgaacctagccattcggtttctggaaatctgtactgagtttggaccttaaactaaagtgaccaggaatggagctccaaattttgatctgggtactgctctcctggtttccctagtgtggtagtgattctacactgcagcttgagaaattcaaaggggaagagtcttcatctctccttttgggggctgtccctgtcctgctagttatatcctggagcaggtagaccagaggcattcctcctggatccactcctccttggtccaattaaccaagaaggagttaatgatactgcagaaggacccaaaggtgcacttccctgtttgtgagcacctacagggacagttgacactgggtacttactctgtgccgggcaggggatactttctatgactgtcctcatgtaatcctcacaaataacactgtaaagttaacattatcatccctactttacaggtggggtaatccaggcagagaaaaataattaatagtaaggggaaaacaaagatgttttaatcatggatgcttgtatgactcctcaggtagaaaccctccctcaactatccccagcccctccctgacttttagggaaagtgggaggccactggcagcagtcttctgtcatggattctgagctgctggggaaggagccttttcagtttgccaactccaactatagtgtggagggcccttacctattggtagggcttcttggcctccacggtcaagcttatgattgcagagggggacctgaacttactttgttgtttttttgttttcgcaacagagtctcactctgttgcttaggctgcagtgcagtggcgtgatctcagctccgcctcctgggttcaagcaattctcctgcctcagcctgccaagtagctgggattacaggtgtgcaccaccacacctggctaatttttgtatttttagtagagacagggtttcaccatgttggccaggctggtctcgaactcctgacctcaggtgatccagcctcccaaagtgctgggattacaggtgtgagccactgcaccctgcctgaacttattttgaagtactcacgtgaagactttgtgttggtgtgttcagagtctctgggcagagaaaaacacccactccgctacagtcctatcctgcttttgagagcctgtttgcaggttctagcaggggagcactcgtatatccttgaccaaagaccagtcctcctctctcagggatggtcgtcttcaatcgagcatgcagcttcgggacagatgcatgtggagcggtgagggaggaaggggacacccacctagtcagccagatcagccaaatcaaccctggtgatcaatggggtgacagatgtcacagccagatggccctatcctgcttttgaagaccatgtagtcctcctcagtttgcttctttccttctccatatccagttttgtcgtcaagttaggttctttttgaagagttagttgtacagtggtcagatttgttcaacttttggataagcctttggggatgttggggttagattagtggctttggttttttgtttttgaccttcacccagtacagtaaagtggaaaaccttgtggccatcttctttttcatattttcccaccttttagtttttgtgtgcacatgttaagctttgtagtgttgccaaatactttgtgtcagcctgactccttagtagtatatggatctaaaccaaatttattgaaaatttcagtttatgagtaccattcagtagcccttagtcatatgtatgaataaggaatgtgtagttttatagaaaggattttcatttttggttcagtttgtgacctgtgaggaatatccttagagctgctgatgtaaatttggagaatcctcgagttagaaaagtagggataagaaaacttgtctaccttctccatgtcctttgatggggccaaaaaggaaaaagaagagtggtggtggttggtgtagtttgtcttttcagtcttacgggaaacaatgttccatgggtggtcctttgtaagcctatggaggattttctgattggctttcaagacttgatcctgcatctgtgagctgatccagcatgccaaggtaggcaataggagtgtgagcatgacattggtttattaaaggagtggccctgccacccagaccttcagccctctatgccaccttcttgcagcctctgtacaacttctggtcattacctggggtggataaggaattgggaattgcaggctggtgcctttctgggttaggactttggaagtggaagagggaagtgttaaggactgacaaatgaatttcagctcatttggcactgaattagatcccactggacccaggagaaatctgttcttggttatgaataggaaaattagaacctcccaaggcaagggaagggtggccatagaaaatgaagggcaagttactcccttgtagcagagaatgggattccctatcgacagtagtatgctggtaaactggctggcagggtgaaggaagccatgactttttgcagttgcccaatttctacagttttaaacttaccaaggccacctgcttcaacgatttcctgatatgtaacagttggctcttgcaagccatacaagcttgcgccagcacactgctgcagacttgcctcaagtatttgaattcccattatgtgctcaggtatatgctgtgtggcaggagatgctgaaacagtgtttattctgaagagctttgtcatttaattgacaggcaagaagctggagaaacatcgacagaatacagtcgtgtggcatgaattgaatatagtggtccagagtgagaagttgagtgctggaaagatcatgaaaaggggagcatatataagctaggcttgaaggataacgataatagctaacacgtggtcatagcagttccagcctctgtactaagcatcatgcatacattatttatattaatcttcagaaatagatactatcccccagtttacacctgaggaacctgaagtttagtgagattaagtatttgcccaagttatatagatatgacatcaatttagtgttgtagtatgtcattattgtggctaggaaggaataaggccagtatttggagcctggtcacttcactgcagaacccacactcttgcccactgcatcagattgcaacaatataaaaaggggggcttttcaaagagaggaaaaaagtctaacaacagtccaaggtttgagattaggtaggaatcagaatatttgagttctagtcttcatttcacttaaccatatatgtggccttagccaaaccacatcttccctctatgccttggattgagggacttgaattagatggccactcagttcttttttatttctgacattttgtgaattttaagttataaaaatgggaatgagtatgcctttcttaagggacactgagagaatgtgccctgctagggcacattgaggttggcagagggagtaaacagaagaaaacaaactataaagggtaactcctaagtggtagaaagcagaggcagaaaaatgttggagctatagactcagctgttccattcgcaacacccgactagtcccaaatggaagggtcagggggtggggacctaacagagaagataaattggtgtttggtgttgggtgttcctagaaagcctacttctctcagtgtctcagtagcaggtcagagctagatttgggtcatttctgaggatccttgagtatcactcctttcctagcattcataaatttaacagatatcagtagagcacctgctgtgttccaggcgttggcacagaagcaagactaatctggtccctctgcttgttgaagttacagtccaagaggagaaatacataataagcaagttacacattttgataggattataagaattggggttttgttggattagagtcagggaatgtctgtgacttcaacataacagataggaggggactgagagtggaaatggtaaaaccagttagactgttagagacatcgagccaagatgtgctcggtgatgaaagagtgcacaaatatcacaaaaataaatgacaaattttttttattgactcaaatgtgatatttaatatggttctggaagattttggtcctaaaaaggaggttgaaagtccatggcgttaattataatggcagtatatgaaaaatacatgagtctggtttaaagtaggtagttgttcaagagatgtaggacagaagagtgacatgaacagttttaatcacagatttctaagcagagataggcttagaggtagatttcaaaggagattaaacatgttttggaagagattaataatcccgtggtttatagatcatttaaaggaaatgttgctcaaaggatagaaaactacagatggaaaagatttgtttataaagagttgattccaatgagaaagaaaaggagacaaatctgtgaacaaaactgcttgcacaggaagctctgacctcagaatggaagccaggccaccttaggggctcacatcagtgagagttcagccccttatcctactgaggcacacatgagcccacaacagtatggctggggtttgattctgggttcaaaaaactgaaaaaggatttagtccaggaaaagtggtgtaatggtaatgattaggaaggaatagtccaccagaaattgaggcctacacaggaagatgataatagtagcccactacacgtgtttggcccagaccaagggcatctcttttggggacatttgagaagtcgtggagtgagaagacagcagctccagttgtggcctgtaatcttaccaccccaaataatcactgctaatgcttttgtcattcacaacaacctcttaccagggggaggacctgtagttctccaattaaaaatttccctagctgggtgcggtggctcatgcctgtaatcccagcactttgggaggccaaggcgggcggatcacctcaggtcaggagttcaataccagcctagccaacatggtgaaaccctgtctctacaaaaatatgaaaattagccgggcatgatggcaggtgcctgtaatcccagctactctggaggctgtagtgggagaatcgctggaacccaggaggcggaggttactatgagccgagatggtgccattgcactccagcctgggcaacagagtgagactctgtctaaaaaaaaaataatagtttccccaacattttattatgaaaattttcaacatgtagcaaagttgaaaaaaattatacccatatatccgccatttcagatcctacaacttaaaatcttgttttatcacatttcttcaacaactccttttattttttggtggatttcaaaaaagtttcagtcatcggtacacttgtaaacatttcaacatgccttaactttagtgcaacatttgtttatgggttgttgggttttgttttttttttttgtaaaattttacaatcagatgtgtacactcagtgttcctttagatggaagtggcaaatgcacacactcctgtgacccatattcttagaatgctaagaacgtttccctttccactgggagctctctgcctctgctcagttaataccttcccttcccctgggggagaagggaggacaaccagtgttctgaatatttacatcacagattcgttttgcctgttctgaaacttcataaatggaatctgtttactttattcttcatttttattcatgttacagatactaatagatttttttgttgctgaatagttttctataaacatcacaattggttctcatattgatgaatacctgggctgtttcaagtttttggctattgtgaataaagctgctgtgaacattcttatacaaatctttgtggacataatgtttccatttcttttggctaaaaatgtaggagtggaatcgctcttgggctaggtgtttgttaggttttttgataagctgccagactgttttccaaagtggtacatttaatgctttcactaacaatatatgagagttccatatccttgccagcatttggtggtggtggtctttttaattatacttttagccattgtggtgggtatgtaacagtatctcattgtggttttatttttcatttccctgataattaacgctgtggatcactttgcttatttctgattcacatattttcctttatgaagtgcctgatcaaatcttttgcccattttaattgactatcatttaatattgagttgtaggagtcctgcatttaaatttcaaagttgaactatacaagatcaggataggggagatttattgttacacatcagttcaaggcctgaagtgtgacttgagcaaaagcacattcaccatttgttcagcaaatggttattagtaccagctatatactaagtactaatactagtgatacagagataatatccagccctagttcaaggaccccatagtttacagggtagacagacaaaagtaaaaattatggtgtggcttcaatgttaagtcagtcactaaatacttactgatgagtatctactgtaggatagatagatactgctgtgggtcctggagctagccagagttcctactctagtatagcttattttctgtagtgtataaggagggagacagagtgcaaaagccctgaggtggtaaataaggttggtgttaggtatatgtggatcagaaaggccaacctggctggaggatagttgcgtggctagatgattagttaggcaagggtaaggtcttgcagggccttgaagaccatggtaagaactttgggttttatcttaagtgttttggaaaggcattccagagttttcagtggaaaaatgacatgatcaggtttctgtttggctaataaacccagaaatgtgtgtgtatggtcgcagaaacactaatgaggaaacatcgcagtcatccagagcagagacaagaaaatccttggggaaaacaggcaagggttcataaaggaataatgtcatattagaaccatggatgacaggacatttgctaggcaggaaagtcaggcatgtgtgttagatgaaccagaaataactttggatgactagttcggtgggtgggtgagtgagcggcaggaggtagagctgatggcaaactgggaagagctttgaaggttgatctagggatgcagggttaccagattgcaaaactaccaaattctatgtaggtatgtcctttggagttgtgcagcaaggtagctttgctagggagtttggctccgaacctaaaggcagctatacggggcttttacttggaatagagactggaagctggcatctgggatgaccaggtggagcagtgctaggacagaaaccaagcaggacgcaagagactaataaggcctgaagttaggtaggggttgttgaactggaagtggaggctttgggcttagaatgaacagtcaagaagatttgaggtgtggatttggggggaaagctgatgaggcctttttatttattttgcttgttttgtttttgttttttatttcatataaggccttttaaaaaatacaaaacagtataaaatattgaaacaatacagaattatggagttcacaaaattcttatcttccactcctttgagctacctaaaacatttgatgcatcttctatttttctgtgtgtgtatttatttatgtttgtattcaaatctgttataaagatacacctacaattgaagtttaaaatggaagtttacaattgaagtaaaaaatggtcatactcttcctattattattattattatttgagatggagtcttgtgtacagtgccatgatctcggctcactgcaacctccaactcccaggttcaagtgattctcctggctcccgagtagctgggactacaggtgtgcaccaccacacccagctgatatttgtatttttggtagagactgggtttcaccacgttggccacgctggtcttgaactgacctcaagtgatccgcctgcctcggcgtcccaaaacgctgggattacaacagtgagccactgcgcccggcctatttttgattttttcataggataccaatataatatagttctggcttgttttttagccactattcagcattccgttgttcagatgtatcatatttagttgatagacctttaagctgccttagatttttcactattcccagcattagtgaaatgagcattcttttttatttgtctctgtactgtgtaaacactgcctgggagagcatgtgaggtgacatgcatggagttcagattgtgacttgggggaagctgtgatcctgatcccttgagggagcatgtattctgctctgggtctgtccttggggaacccccaagggagtgatcaggatggtcagaagtctgcaggccacattctaggggcaacagccaaaagaactgcggctgtttctccagatttcagctgggactgttcacagcttccaggtatcagatgagttctcatagggagatagggtaaggccttcccatggagccctaggctggggaagaactaccaggtagaagtaagaattccacagagttaggtcagtttgggtaggatttgtatggacctagactttctgatgattggattgtaagactgggttttctatcactgggactgttcatgcaggggccagggtgctgtggaggggcagtatgtgaagcaagttgaactctgaagcattccaactttgataacagcattccagatggaaactatgagggaccaagatgaggtgctgtgggctgcgagggaggagcgattgactgaggatcagtataggggagggctgacgctggaggcatctcagggtatagctttgggaaacatggaatgctgagtgaagctcagtgaaagatctgacctcgtgtgcactgctggtggagtggtcttcaggtatatgggccaagggggacacagggataacaagaggtctgagggtgattgttatggtggctgcaggaggacggaattacccaggtgttgtcgtggtgaaccatgcaagaaaataatgttcccagcagagggaaggggtgaatcagagaagcttggtgctgcctgattacaagggcgagacatcagttagtttggagctggctgggcagggagctggggctggagatgaactttcagatttcattctgcaaatatgtattgtctaggtgcttgggatagagcaataaacagaacagctaaatattcctttctcacagaatttatattctagtgggggaaacagtatatacatgtatataatgttagacattgagaaaaagcaaaaaaggggtatgcaatgccaggggcagtggggttgaaattttagaggggctaaaagggagagcctttatatatatatgtatatataaaacagggaagattattttgagtaaagacttgtggggaaagggagcagtgagccatgtggatataatgcagagaaagaacacattccaggtactgcaaagtgtttggggtagaaacaaacttggctggctgggtgtggtggcacacactatcatgccaggactttgggaggctgaggtgggtggattgcttgatccgaggagttgcccagcagcctgggcaacatagtgagaccctgtctctacaaaaaaaaaaaaaaaaaaatagctgggtgtggtgatgcacacctgtagtcccagctacttgggaggctgaggtgggagggatcgcttgaacccaaggggcagaggttgtggtgagctgagatctcaccactgcacttcagcctgggtgacagtgagactctgtctcacgaaagaaggaacaaacaaacttggcttatttgaggagtgacaaagtggctgaaatggagtgagcaagagagacactccgagatcaggttaaagaaatctggaccttccaggaccttataggccatggtatagtttggactttttttcttttcttttctttttggaaatggagtctagctttgttgcccaggctggagtacggtggcgcgatctcggcttacttcaacctccacccgccaggttcaagcgattctcctgcctcagcctcccaaagtgctaggattacaggcgcccaccaccataccagctaattttttttatttttagtagagacagggtttcaccatgttggtcaggctggtctcgaactcctgacctcaagtgagccaccatatctggccaagtttggagtttttctaagctcagtaggaaatgggaagtactagagggttcaggcagaggcgtgatatgacctcacttttttttttttttttttgtgacagagtcaacctcggtcccccaggctggagtgcagtggcgccatctcggctcactgcaagctctgcctcccggattcacgccattctcctgcctcagcctcccgagtagctgggactacaggcgcccgccaccacacctggctaattttttgtatttttagtagagacagggtctcaccatgttagccaggatggtctcgatctcctgacctcgtgatccacccaccttggcctcccaaggtgctgggattacaggcttgagccaccgtccccggccttttttttttttttttttttgagacggaatcttgctcttgttgcccaggctggagtacagtggcacagtctcggctcactgcaacctccacctcctgggttcaagcaattctcctgcctcagcctcctgagtagccaggattataggcacacgccaacatgcctggctaatttttgtatttttttttttagtagagacggggtttcaccatgttggccaggctggtctcaaactcctgacctcaagtgatctgcccaccttggcctcccaaagtgccaggattacaggcatgagccactgtgtccggcctcacttatgttttaataggatcgccctgattgctgtatttagaatagcctgttggggtggacatgggggaacggaggtggagacagcatagaataagggagaccagttgaagaggctaatgctgtaagccaggtgacaaacagtgatggcttagattgggcagcagcagtggaaatagtgaggagttgaacattagcagtagaggtgaggagaattagtagggggatcataactccaccacaagagttagatccccagggttagtgagaaattattggaagaagataatttgtggaggatattatctggatcatagttatatttggggttatgttaggatcagaacttggattagggtctggcctggggccagtaagggggtcagaaagatttattggtctttgcaaagaccaagattagagtctgggtttggacagccctattgggattaagacaaattttagggtgaggatagtttggggtcacagttgtagatggaggctagtaccccttttcaatatcttcagaccagggttggttgtatctgccatcttctgtgccagtgagctcacctaggggtggaggggtttggaggctatgaggccttctcttccttgggtgtcacgggggtggacgtatgctcagccctgcctgggtgatgcctgctggccttcccaagctgggacctgtagtcggggaaggggagagaaggctccctggtgcttgacccagctccttttccctcagatggcccactgcgtgaccttggttcagctgtccatttcctgtgaccatctcattgacaaggacatcggctccaagtctgacccactctgcgtccttttacaggatgtgggagggggcagctgggctgaggtgaggcggattatggaggttaaggttgtggagggaggctaggattgtgttttggggtggaggctgtgactgtgatgcttactggcctctgcccacagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacaggtatgtagggctggggattaggatccttcagatgcaggtctgtgagacaacctagcctgcctggaggtagggggcaagcaggacctaaccctgcctgttatcctgaaactcccttccctgcttttccccagattgtgtccagccaggtactgactctccccttgatgctgaagcctggaaaacctgctgggcgggggaccatcacggtaaggaacccagcaagggttgaggagggacttaacatcaatgaattcatgaggtgatgtagtctcccctacctaggtctcagctcaggaattaaaggacaatcgtgtagtaaccatggaggtagaggccagaaacctagataagaaggtgtgtctggaagtaggccctggtaatccaagagttaaggggccaaggatggtgtatgggggatgggggtgtggacagagggatggcataatggttgtttgttcctgagtcttgtaactggggtctcgcattggcaggacttcctgggaaaatcagatccatttctggagttcttccgccagggtgatgggaaatggcacctggtgtacagatctgaggtatgagacccctgggattgggtgggctggggtaggagataatctcctggggcctgtgactagcaaggtttggaactcagaaagagactgcaggtgggtagagaagtgtggcagctcctcagggggccatgccagagctcactggaggccttggcctccaccttcaggtcatcaagaacaacctgaaccctacatggaagcgtttctcagtccccgttcagcatttctgtggtgggaaccccagcacacccatccaggtgaggagcttgccccctaagtggactgcgctggagaagagaacctggggagggacttattctcatctgccacctggcttgtttatgtccacacacacctttccctcaggtgcaatgctccgattatgacagtgacgggtcacatgatctcatcggtaccttccacaccagcttggcccagctgcaggcagtcccggtgagtgctggtcttgccaggggtgtggaaatgggcctagatagctgaagcttgtgggagagaggaaggagaaggcagctcgagtccttgactgatgctctgagaatttcctaccctaatttttctgtcctcaccaggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtaagttactttaccaagggcaagagaacaggtctggggctcagggtggcctttagctgccttcctcacctcctcccaggtgggcgtggacttcactggctccaatggagacccctcctcacctgactccctacactacctgagtccaacaggggtcaatgagtacctgatggcactgtggagtgtgggcagcgtggttcaggactatgactcgtgagtacctgcttctctgggctatacccgctccctgcagatgcttcagcctctgagcttacagtcccctcactgccttttgcccaatacactgtcctcccacagagacaagctgttccctgcatttggatttggggcccaggttccccctgactggcaggtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatttcaaccccagtaacccctactgtgcaggtaagtttccccatccaccctgaggcaggtctgtccacacaaagaggggcaagcctgcatgagtaaaagggagagtgggggcagatacctgccttcattgtccagagggtggattttatttaattttagtttaatttattttttgagaaagagtcttgctctgtcacccaggctggagtgcggtggcgcaatcttagctcacttgcaacctctgcctactgggttcgagcaattcttctgcctcagcctcccaagtagctgggactacagtcgcttgccaccgtgcctggctaatttttgtatgtttagtagagacggggttttgccatgttggccagggtggtctcgaattcctgacctcaggtgattgacctgccttggcctcccaaagtgctgggattacaggtattgagccacagcgcctgacccagagggtggattttagagctaggcctctggaatcaaatcgtcatgccaggccaggagtggtggctcacgcccgtaatcctagcactcagttgcgaggccaaggtgggtggatcgcttgagcccaggaatttgagactagcttgggaaacatggcaaaaccccatctctactaaaattacaaaaattagccgagcatgatggcaggcgcctgtagttctagctactcaggaggctgaggtgggaggatcacctgagcccaggaggttgaggttgtggtgagccatgatcatgatcatgccactatactccagcctgggtgatagagtgagaacctatctcaaaaaaaaaaaaaaatgatgccacatgacttggggcaggttgcttaatctctgtgtgctttggtttcataagactaaacataggaaattgagtactcaaggagaggatacaagtaaagcagtaagcctggtacttactaagtgttctccgaaaaatggtatctgttatattatcgttattatctttgcctagaagctaacaggtacttacttgagcatcagtggaagccttgtttgcctccttgcagggtgcattttgccagagtccaccaagcccttttgtttagggccaaaccttttgactccccagtacccccaagggggcacaagctgaagtggaaaatctgacctgacctgatctgatctgggttttaaaattttaattttgtatttcaacataagttcagacttagagaaaagttgcaagaatagtcataggagctcagtcccttggaactcaggggtcagggcctgagttcacaggggctcttcacctttatcccaattaccctaacataacattttaccacatttgttttctcttttctcatacatgtatacagtgtgtatgtgtgtgtatatgtgtgtgtgtgtgtacacatgtatacatatacacacacattcacacatttcaagggaaaaaagattaaaaatatgtgtttatgtatgtacacacatgtatacgtgtgttggagaatgctgtagtgaatagccctgcctcaggtttgcttctatggccctaccagctttgtacccatcattatccacctggctttttacctctgagtacttcagtatctcctaaaatcaaagactctttcttacattatcacagaccaatcctcaaaatcaggaaatgaacatctatgctattatccagcctatagcatttattcagatgttgccaattgtcctaatgtcttttacagcaaaagaaaatctcagatcacacattgcgttcagttagcacatatctttttatatggaagacttcttgcctttcatgacattcacatttcatgatataaacagtataggccagatattttctagaatgtccctcagtttgggtttacctgataaatcctcaggattagattcaggttgtacatttttggcaggaataccaccaaagtgatgctgtatattctcagtgcatcatattcagaggaacatgatgttgatttgtcctattaccagtcatgttgactttggtcacttagttaaggtaagatctaccaggtttctccactatacaagtactattttctcctttctatttagtaagtatattctgggaagagactatacaaatactcatcacacacacatcaacattcccctctagtttttttttttttaatttattttttattttttattttttgagatggagtcttgctctgtcacccaggctggaatgcggtggcgcgatcttggctcactgcaagctccacctcctgggttcacgccattctcctgcctcagcctcccgagtagctgggactacaggcgcccaccaccacgcccggctagttttttttttgtatttttagtagagacggggtttcactgtgttagctgggatggtctcaatctcctgaccttgtgatccgcccgcctcagcctcccaaagtgctgggattacaggcctgagccactgcgcccggccttagtttttttattttttaagtgacgggggtctcactatgttgcctaagctggccttgaacccctgggctcaagcagtcctcccacctcagcctcgtgagtagctgggactacaggcacatgccactgtgcctggctatactctctagttttaacatccattgatgatccttgcctgaatcagtcatttctgtgattgtcaaatgattgtgtaattcttccttttacatttattaggagctttcccttctccctcagtaattaatccatagtacggatccttattgtatcaaatggatcattattaaataggttataatctgatgctcaaactctcctggatttgtccaggagaatccctctcatctgggtgctaattcaagctgtgatttagggcaagtcccctcctctctttgaaccttagtttcctcatgtgtaggagacagttaagtaccctggtttacaagggtgaatgaatgaaatgcacccaggttccgagatctcctgggctgggatggggtgatttcaggactggtgtagtcctgagaggtccaggattttacggtatttcttgctctcctctgcaggcatccagggcattgtggatgcctaccgccaagccctgccccaagttcgcctctatggccctaccaactttgcacccatcatcaaccatgtggccaggtttgcagcccaggctgcacatcaggggactgcctcggtgagagtcgtgggtggcagtggcagtggtggcaatcaagggcttccttgagggttatggaacaaaggacttttttttttttttttttttttgagatggactcttgctctgtcacccaggctggagtgcagtgacgcgatctcagctcactgcaacctgcacctcctgggttcaagtgattctcctgcctcagccttcctagtagcttggattacaggcgtgtgccaccatgcccagctaatttttatatttttagtagagacgggctttcaccatgttggctggggtggtcacaaactcctgacctcaagtgatccgcctgccttagcctcccaaagtgctgggattacaggtgtgagccatcgcacccggcctgtaacaagggacttcttatgagtgtggggatgtgtggctggggtgtttgcaggggtttaggaggaggatctgcttcaggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgtgagtaggtgcaaatttgatctgggagtttaccctttcacctttccctgatgtgagtagggttgaggcccaagggatgctcaccttttcctctaagcctgggatatggttgggttcttgagcatgaaatacagactttgggcagctgttctgggccaccactgacttttcccttttcttggcaggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagacc

SEQ ID NO: 37642 - DNA, 543341 bp, Homo sapiens
gctttgcctccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggtgaggaaagggcccgcccccgcccccagccgttcgggcgttcgccccttccggggcccccctgccctgcttctgtgtgctcagctcgcgtcgtgcagtcctccccacagcgcctgcgacccttcgcctctcaacctgactccttttgcagctcctcccacccgccccacatgaagcccagcccccacaacctcttccttctgcccctgaaaaatggttgagcagcggaggagctggttgatacgtgtaggttgtaggtttttaacttctgctttggtggagtgggaggaaagcatcgaagaccggccccactctcttccccgtccatcattgtctccactggctttctgggtgtccacctataatgggagtctagaaaaattcagtgcttggactctgctttcaaggtaataggctcagtgggcttgcatactaatgcttcaggtagcttgcagcacatgcagcctccgtagaaaaatcagcttcctttgtttatctgatggaagccttggaatctctcctgttaggtacggttgtcgattgactttgcctcccccttcccattggtccttagttttgctatttcatcttctccagattttgccttttggtgagagattaatctctccatatcaaccgcaataagagaaagtgtattaccaaaccgttcaaatataaaggcgtttttcagcagcctcactgaatcattaatgcagcatctgaaatggaatatttgcaatctatgtattgaaggcaagagaacaaaatagaaacaggattatttaatgagcaagcaaacactggaagggaatgatgtcataatgtgctagtgaacagtaaattgaaatgcttttttgaagtattaaaaatagtaattgccaccactagctaatgaagcatttagtttcttgcattccacaggaaatgtaacattttagaagacttattggcaaaaattaagttctctagggaataagagaaaagtgatgggagtgaaaaaatcgtgtttgtgcgtaattttgaaatatatcctcacacctggaatgccagcacttttagagactgatatgaaaggctcacttgagcccaggagtttgagaccagcttagataacaaagggaaacactgtctccacaaaaaaattaaaaaattagttgcatgtgatagcgcacttgtagtcccagctactcggtaggctaaggtgggaacatcgcttgagcccaggaggctgaggctacagtgacccttgatcccaccactgcactccagcctgggtgagagagcaagaccctgtctcaatcccagcactttgggaggccgaggcgggtggatcacctgaggtgaggagttcgaaaccagcctggacaacacggtgaaaccccgcctctactaaaaatacaaaattagctgcgcgtggtggcacatgcctgtgatcccagctacttgggaggctgaggcacgagaattgcttgaagccgggaggcagaggttgctgtgagccgagatcacgccattgcactccagcctgggcaacaagagcgaaaaaaaaagttttggaaagtgtgtgttacatgcataagtcttagaatgactggtctagaatctgttctttataacctgtacatcaggtgttttcagaggctttaattaaagtatgtaagatttgccccaggatagattaatcagctacctaattctccactttaactattttacttccaggtgtaaattaaaggtgcatggctcattgagttgtgactctgacttaacacggttttaacttgtgtgagggtacttagactgctcttccaagtattcaaaattgccgtgggtcatgttgaccattagttctttttttttttttttttcttcagatggaatctcactctctcacccaggctggagtgcagtggagctcggctcactacaagctctgcctcctgggttcacaccattctcctgcctcagcctcccgagtagctgggactacaggcgcccgccaccgcgcccggctaattttttgtatttttagtagagacggggtttcacaatgttagccaggatggtctcgatctccttacctcgtgatccgcccgcctcggcctcccaaagtgctgggattacaggcgtgagccaccacgcccagtcatgaccattagttctaaatgtgcgctgagattgtgcatagggaagattcctatacttggtcgtaatttgtaacttttaaatagaagtgactgaagtaaaacctttgttttaaaagtgatgcctttcagcagtccgcttggttaagcatgataactttgtcatttgacatggacctcaaagtaaaagccatcttctaatactgctgtgttgaagacccaaaactaggcttgtggaaaatgttagttcattttgtttctagcactttttccacctttgaagtcctcagattttttttttttttttttttttttgagacggagtcttgttctgtcacccaggctggagttcagtgcagtggcgcgatctccactcactgcaactttcacctcctgggttcaagtgattctcctgcctcagcctcccaagtagctgggattacaggcatgcaccaccgtacctggctaattttttatatttttggtagagacggggtttcaccatgttggtcaggctggtctagaactcctgacctcaagtgatccacccgccttggcctcccaaagtactgggattacaggcatcaggccagatgtattttaaatgaaaaattccttcatttgaatttaaatgaacatctattaactttatcacttgatctttttttttttttcacttttatttgggtaacttgtggaagtaaattcttctgtagatagcgtgttagcttctagatgtcatttttctagtttactgatatacttaacatttagaacattttaagtgatttttttgagttctaccataacatttaaagttgtttcaaaatatttactcatttcaactttttactgaattgtttaaaatttaatatttaacaagggataataattaacaagggataatttaacatttaacaagggatactaagtgtggccgggtgcagtagctcatgcctgtaatcctaacactttgggaggccgaggcgggtggatcacctgaggtgaggagttcgaaaccagcctggacaacacggtgaaaccccgcctctactaaaaatacaaaattagctgcgcgtggtggcacatgcctgtgatcccagctacttgggaggctgaggcaggagatttgcttgaatctgggaggcggaggttacagtgagcgaagatctgcctactgcactccagcctgggcgacaatgagtccctgtctcaaaacgaaacaaaacaaaaatttatctgacattagaccctttggcatgaaataatttatggataccttctctgtagtaaattggcttgttatagattgtgtattccagagttttgtttgttccaatatataaattatacttgtcggactaccaaaattttttgctaagtagcatcaaatatatatcacattaactctgtttttttttttcataaacaggttagaacttttttaactactcaagttaaaagggaataggttattttccaaagtgatgtcataaaaagttgaaataattacttaatttttggccacttttctgatagtttattgttttgtatacatagctagcagttttaagtcttaagtaaactggatttaccaaactgtatttctaatacaaaaaaggcagaataacaatttttttttttaattatactttaagttctgggatacatgtgcgaaacattcgggtttgttatataggtatacatgtgccatggtggtttgctgcatccatcaaccagtcatctagattttaagccccatatgcattaggtatttgtcctaatgctttccctccccttgcctcccatcccccaacaggcaccagtctgtgatgttcccctccctgtgtccatgtgttctcattgttcaactcccacttatgagtgagaacatgtggtgtttggttttgtgttcctgtgttagtttgctgagaatgatggtttccagcttcatccatatctctgcaaaggacatgaactcattctttttcatggctgcatagtattccatggtgtgtatgtaccacattttctttatccagtctatcattgatgggcatttgggttggttccaagtctttgctattgtgaatagtgctgcaataaacgtgtctgtgtgtgtctttatagtagaatgatgtataatccttcgggtatatacccagtagtggggttgctgggtcaaatggtatttctggttctagatccttgaggaatcaccacactgtcttccacaatgattgaactaatttacacttccatcaatagtgtaaaagcattcctatttcacatcctctccagcatctgttgtttcctgacattttaatgatcaccattctaactggcatgagatggtatctcatggttttgatttgcatttctctaatgaccaatgatgatgagctttttttcatatgtttattggctgcacagatatcttttgagaagtgtctgttcatatccttcgcccactttttgatggggttgttttttttcttataaatttgtttaagttccttgtagagtctggatattaggcctttgtcagatgggtagattgcaaaaattttctctcattccataggttgcctgttcactctaatgctagtttctttggtttaattagagctctttagtttttttttaatttaagctctttagtttaattagatcccatttgtcaattttgtcttttgttgcaattgcttttggtgttttagttacgaagtctttgccatgcctatatcctgaatggtattgcctaggttttcttctggggtttttatggttttaggtgttagtttaagtctttaatccatcctctgttaatttttgtataaggtgtaaggaaggggtctagtttcagttttctgcatatggcttgcctgttttcccagcaccagttattaaatagggaatcttttccccattgcttattttgtcaggtttgtcaaagagcagatggctgtagatgtgtggtgttatttgtgagacctctgttctgtcccgttggtctatatgtctaaaaagcagaagtataaaagagctagaactaatcttaacactagttccaccagtgagtaaagcaaccagcagcagtgaagaaaatggcagattttcctgttggtgtgagtggactggtcacaagaaagtctccatggggtagcagaatgttgcattgcaaatttagaaatgggttgatattagggggattgtttatgttggagtgctacaactatactcaagccctgagtgattcaggttttggtgacagatgactcactgacaagccttttttggcaactgctattaatgaaatcctgtggtgacaataatgaaacatttgggagggtttgtttgattcttgttgcaataagtagttctttggaacaagaaagaagaaaactgaagggttagcagttagggaagaataaccttttaagattctttttagctgctagttttacagaaactttgttctgaaacaagattgcattttctggcccttcactgcacttttatttcttcaactttaatattttggtagatggtttttcctgattttggccatgctttttgtatatgctgaaattatgaaaatctctgacttagcagggctgcagcattgacagaacaatggaatagttttcattcaggctttggcattgtggctaagcggagtgggtgtcaacttgtgtactagaactttgaaatatcaggaagattcctttgttctcttatgggtcctcccagctagcaagaatgtgcctaatttctttctttggcttaagcctttgatccctagtaaaatacttatacaccatgagtaatcatctacttcatgtcattgatatgattcagatcctttgctgaatgtagatttttgctaaagggaagactgcagaagggccctaatctactagggatggacaacagaaagatgcagacacatagggagaagagcctacttacctacttaattttaagactgctccttttttatatggattaagaactcaggttctccctaggatatttttagaggatattatctaagctgatatttttggcagtttttaaatcatatttcagtatttttgaaaataacatttatgataaaaaaaaaatatgtactggccaggcacagtggctcatgtctgtaatcccagcactttgggaggccaagatgggaagatcgcttgagcccaggagttcgagaccagcctgggcaacatagggagacctcatctttgccaaaaagtaaaaaaattagccaggtttggaggtgcatgcctgtagtcccagctacttgggaggctggtgtgagtgcactggtcacaaaaaagtgaagcaggagtatcacttgagcccagcaggtcgaagctgcagtgagccgagatggcaccactgcactccagcctgggtgagagagtaaaaccctttctcaaaaaaaaaaaaaaaaagaaagaaaaggtatcaaaccataatcatgtttcatggcctacctttttcatgtgaaatataccattaatatttttctgtattagtaaataattgaattatattttaaaattgctaaatagtattttgtagaaatacttttatttaactgatctcctttttagatacttaggtggcattctaatttttcactattttgaatagcgctgcaaagaacatccttgtggctttttgcaccttttctcataagtatagagacttcattgtagccatttttttggtgaagtttgtattaaaatggattttgaaacagaacttactgaacacaatttaagttactctgggtgactctcttcagagcaaatgtcactcatactgtggcattctccgtttaacatagagtgatttgcacgtggctctgactttgttgggccctagccggccagacagagaggtgacagatatgttagtaattatttcccaatgtcaatactatccatagtgatggtggtgttttccgcttccctttatttgatgcttttcttccattgattgggagaccacatctactgaatctgttgtgtgaaataaaatgactcagtcatgggttttgaaaggaaacctaaagccttcttggtatactgtcaagagctttataataactggttttgctgatagatgtttttttcatttgtttctggttcttggcagttttgtaggtaattaagttgtcagaagtgtgacttctgaataaactctgggtgttcatttagatttcaaatatgggccaggtgcggtggctcacaactgtaaatcccagcactttgggaggccgaggcaggtggatcacttgaggcccggagttcgagcccagcctggccaacatggtgaaacccccatctctactaaaagatatatatatatatctatatatatagatatagatatagagagatatatatatatacacacacacacacacacacacacacacacacaaattagccgggcttggtggcacgtgcctgtagtcccagctactcgggaggctgaggcaggagaatcgcttgaacctgggaggcagaggttgcagtgagctgagatcttgccattgcactccagcctgggacagagcaagactccgtctcaagggaaaaaaaaaaaaaaaactagatttgaaatatggcactctgcacttgtgcctttcatcacatcactgtgctcattgtcacagggtatgctgagtgttcatatatgtgcacatggctacaaggttctttttttttttgtttcgagacggagtctcactctgccacccaggctggagtgcagtaaaatgatcttcgttcactgcatcctccacctccggggtacaagcaattctcctgcctcagcctcccgagtagctgggattacaggtgtgcaccaccacacccggctatgttttgtatttttagtagagtcagggtttcaccctgttggccaggcaggtctcaaactcctgagctcagatgatctgcctgcctcagcctcccaaagtgctgggattacaggcgtaagccaccgcacctggcctttgcaagattcttaatgaaacccacgtctgccccgtggccttcactgacggtattaggaatgtgttaggctccctttggtgggtgtgatgcactcccagaaattataatatctttattgcctcatgaaatttcaatattgaaatgaagaaaattgaaatgttaaacatgaattgatgtataaaagattgccaggataaagttcattaacatttcaattaaatacattgatttaatttaataaatcaattgatttgatcatttgttgggaaagttctaatttttttcctgtaagaaaaatggtttttatagctttgatgacatctttgtatatattttcaggaacctggagataatgttccatttatatcatctcattcagaaaaccagtctttatcattacaccttatgttttgtacaaatcgttgtcttatcctctagcagaggatctttatatacaatatttcttttttttatacttacagctctgataaattctctcttatctcttttaccatatgagaatcaagatgtaagtttggacctaattgtcattaggtgtgtaagctggggcaagttgcctaatgtttatggacttcagtttcttcatctataaaatgagagttttaaagtaggtgactgctaagattatttccacttctatgattctaagatgaaattagcaaacatttgctgaatacctgtcatcagaggctacattcagaaacatgcccaggacattccaggacaggcagaagtaatatttaatgatagcaatctgaatagaggaactttctgggatggtgaaaaatctgtgcattgatgaggtatttgcccatgaatgtgtggatcctcaaaacctatgaactctgtacactaagattttttattttattttatttatttttttgagacggagtctcgctctgtcacccaggctggagtgcggtggcatgatctcagctcgctgcaacctccacctcctgggtacaagcgattctcctgccttagcctcccatgtagctgggattacaagagtatgccaccatgccccgctaatttttgtatttttagtaggaacagggtttcaccatgttggccaggctggtctcgaactcctgacctcaagtgatctgccaaccttggcttcccaaagtgctgggattacaggtgtgaatcactgcacccggcctgatctttttattttatacttcgtaatatatatcaaatctaatttaaaagttttagaaaataaacgcttcggctgggcgtggtggcttacgcctgtaatcccagcactttgggaggccaaggcgggcagatcacaaggtcaggagtttgagaccagcctggccaacatggtgaaaccccatctctactaaaaataccaaaattagccaggcatgtagcaggtgtctgtaatcccagctactcgggaggctgaggcacaagaatcacttgaaaccggaaggcggaggttgcagtgagctgagatcacgccactatactccagcctaggcaacaagagcaaaactccgtctcaaaaaaaaaaaagaaagaaagaaacccttctactttgtagcaaatcacaaaaccctacattctttagtacttttgaaagaggcttttcaaaattgccatttaattaatatgattttctttctttaaattgcttatactagtacagaggtaggagatatagtgacagttctccacttgcgttctttaattttgagacttacaagtatgtaatttagaaaaaaaagagtaactcaaacaatagctctgctgtttttttatattctattttccacatactgttctaagcaaacattgtgtcttagagaaataaaagccactacttaatataggaacccagacctctcttggatgctcatatatatatttatgtactgagagcataaatttctattaagtagagtcattttcttcactctttgtaagcaacagcaaagattctaagtccgtaaagtgtgccctaaacataatctctgcttgttatgaactatttttaaaaactatccatgagggtcaccatgcagttcattattgtaattctatgaagatgtatatttttctaatttttttcctgtacatacatatgataaagtttagtttataagctaggcacaagagattaacaaaaaaatttttttaatttttaatttaaaatgtttcgactttttaattttaaaaattttaaactttttaaacaaatttttttaaacatttagaaatcagtcataagagattaacaaaaataactagtagtaaaatagaatatttataacagtatgccaacatcactactcttgggctttggggtcattattaagtaaaataagaattactcaaacacaagcatcttgatactgctgcagtcaatccgataactaagatggctgttcagtgactaatgagagggtagcctgtacagcgaggataagctggttgatgggatgattcacaagtcaagtggaatggagagggacagtgtaagatttcatcatgctcctcagaatggcacacaatttaagacttatgaattgtttattactgaaactttccatttaaaattttcagaatgtggttgaccatgactaactggagccattgaaaatgaaactgggcaaggtgcagtggctcacacctgtaatcccagcacttcgggaggccaaacgggaggattacctgaggccacaagtttgagaccagcctggacaacatagaccctgtctctatttaaaaaaaaaaaaagaaagtgaaactgcaggtcagggggactattgtaatgaagaaaataccaatccttcacaaactctgtcggaaaacagaagaggagggaacatttctcaacttattttatgaggccagcattacattaataccaaagccagacaaattattataagaaaaaaacaaagatcaatatccctcatgaacattgatgcaaaaatccttaactagatagttgcaaaaaaaatccagtaatatataaaaggaataatacatcataaccaaatggggtttgtcacaggttggtttcatatttgaaaatatcctttcacaatattaataaataatagggtaaagctatatggtcctctacagttggcaaatgggaagggaaggtagaaggggaaagctcctggggtttttatgtatatccttgtccctcccacccagaatcacaacttgtcagaattcacttttcaaagttaggccttcttgataggcacattctttaaaagaaaatgtttaatgtgaaacatcatacatacacagaaaagtgcttcccttcccaatatatagatcacactgattgatcacaattgtgtgtaattacctcacaagtctagaaatattaatattgacagcaccccagaagcgactcttgtgtcctttcctacttttctttttcctcaacgctaaccaccctctccacttgtaacaccatagattactctgtttcttcactttatggaaatataatcatatattatgtgtgcttttgtgttcggcttcttttgttcagcattatgcttgtggaattcatctatgccgttgcatattcctgtggtttcatttcttctcataactgtgtagtgttccctttggtgataaaccacaatttatttattcaactgttgacaggcattcggttgtttcatcatgggcattacaaataatgccatcatgagcattttttagatgtctcttggtgcacgtgtgcaaatcattttgttggatatatacttaagagtggaattgatggattatagggaatacctgtcttcgcttttagtagatatcaaattgttttccgaaacagtggaaccaattaactttatcactggtgttcttcatgctccttgccaacactgggcattgtccatccttttaattacagtaattctggtggggtatgtagtgtcatctcattattgttttacatcacattttttgatttgttatgaggctggacacttttttataggtctgctggtcattgggctatcctctttttgtgacgcacatgctccaaatcttatcctgtttttcaattggattgtcttttctttatttgttgaagttctttttatattattgaaaaaagccatttaagacttatatgtgctgcaaattcttttccctctctgttgcttgccttttcagtatcttaatggtgtcttttttacaccataattgaaatgtggtcaactatattagtctttcccattgtggttagtgctttttaaatgccatttaagacatttttactaatttgatgtcctgaagatatttttctgtattaccttctagatcagtgttgtctaataaaaatactaagtgagctgcatacataatttaaaatttgtagtatccacattaagagagcaaaataatcagataaaactaattttaatattgtgttttttaactcactccaaattagtatttcaaagtttcaatataaaaattgagatatttcacattgttttttcctactaagtaattaaaatcaaatgcaaattttacttaatagcacatctcgaatgttcagtatccatacatgggcagagcagttctagaagatttattgtttttaccctttcacattatatcttatgttccacctgaaaatgattttttgaatgaattgtgaggtagaaatcattacttactcatttgggcatccagttgccttaagaccactttattgaatataaagacagtcctatcttcactgttctgttatgctactttggtattaaagtgtccacatatgtgtgtcttgttcctgtattctgtgacatttgtctatttttctatgcttgcaccagtattacactatcttattataatttttgtaataagttttgatacctggtaaagaagaatttcttcttaggagagtcttggctactcttgaccctttacatttccatataaattataatcagcttgccaggttctgcaaaaatatcttttggagttttgattgagattgtattgaatctaaggatcagtttgaggacagcacttctttttatattatctgttcatcagatgctctcatctgggtaggatctggacatgctgtgccttccagactctgctacctttccctttctggcgtggaagcagctaactgagagggaggctcaaccctcagctttgatgagagccctggagggccccctccctctttttgcaggagactttccttaagggcagaaagtccctggcaagattctggaattctaggatgaagaaaaatgaagtctgggaggaaccagacccaaaaaaacacaataaaaaacaaaactctgtaccctgtatctatatagcaggggccttgtaccctgtgtgtgagttctcaggggtcacctgttcttgcattgacttgaacctagggcacatcaacacaacttaccctacttgaaaacagattaacgctttttactcctcactctcctctttctctgtcatcagtcctatagtttgctttgtggtttcagaccaagttccattgagaaaccagttccaaaggtagaggcttgtatatcctagctgactagacaggagaggaaaggaacagactgtcttggccgggcgggcggatcacttgaggtcaggagtttgagaccagcttggccaacataatgaaaccccatctctactaaaaatacaaaaaattagccaggcgtggtggcgggcgcctgtaatcccagctactcgggaggctgaagtgggagaatcacttgaactgagaggtggaggttgcagtgaaccaagatcacaccactgtactccagcctgggcaacagagtgagactgtctcaaaaagaaaaaaagactgtctagaaaaaggtaatctctagaatctgaagagggttaacaaaatgaggattaaggcaaaatacagttagtaataagataacaaggaatctgatcatggaaaaggggtccttgtaacttactgaggctgaatgttggtttaccatcttacattttctacgtccattaaatcagccttctgggaatccacagtcctggcaattctgaactgccccaggaggagggaagccatctctctagggtgagataggtgagccatcaggtctggtggtgggagtccacagtcctggcacttctgaactgccccagtaggagcgagcccatctctccagggtgagatacgtgagccgtcaggtctggctgtgggagtccacagtcctgacacttctgaactgccccagtaggaggaaagccatctctccaaggtgagatttgtgagctgtcaggtctggctgagagaatgcacagtcctggcaattctgaactgccccagtatgagggaaaccatctccccagggtaagatttgtgagccgtcatgtctggctgtgggagtccacagtcctggcacttctgaactgccccagtatgagggaagccatctctccagggtgagattcatgagccatcaggtctcgttgggagaatccacagtcctggcacttctgaactgccccagtatgagggaagccatctctccagggtaagatttgtgagccgtcaggtctggttgtaggagtccacagtcctggcacttctgaactgccccattatgagggaaaccatctccccagggtaagatttgtgagccgtcaggtctggttgtgggagtctacagtcctggcacttctgaactgccccagtatgagggaaaccatctccccagggtaagatttgtgagccgtcaggtctgggtgtaggagtccacagtcctggcacttctgaactgccccagtatgagggaagccgtctctccagggtgagattcatgagccatcaggtctcgttgggagaatccacagtcctggcacttctgaactgccccagtatgagggaagccatctctccagggtaagatttgtgagccgtcaggtctggttgtgggagtccacaatcctggcacttctgaactgccccggtatgagggaaaccatctccccagggtaagatttgtgagccgtcaggtctggttgtgggagtccacagtcctggcacttctgaactgccccagtatgagggaaaccatctccccagggtaagatttgtgagccgtcaggtctggttgtaggagtccacagtcctggcacttctgaactgccccagtatgagggaagccatctctccagggtgagattcatgagccatcaagtctctttgggagaatccacagtcctggcaattctgaactgccccagtatgagggaaaccatctccccagggtaagatttgtgagccgtcaggtctgcttgtgggaatccacagtcctggcacttctgaactgccccagtatgaggaaagcaatctctccagggtgagatttgtgagccatcaggtctggttgtgggagtccacagtcctggaaattctgaactgccccagtaggagggaagccatctctctaggataagatgcaggggtgtactaggttgtggggattagagtacaggggactagcaagagggtctatgaggagggcgagggggaaagataggaggacacttggaaaggggtgcctgacgagcagggcggtggcatacggacgctctggaattaacagaggaagagctgggcagggagttccgggaggtagggtgctgggaaggggcgacattagtcagctgggggaaacaggtacgctggaaaactgaacagcttggacggtcctggagaggaggctgagggcaggaagtttgaggagtaaggggaggaagaagggctggaagacgagagccagaaggaacagaaagaaatggaggccagggttgaggccgagaaattggaggtagctttctggtcatttttccaaatgagtgctgtagtaactcacttgtccaaacgagtcagaatgaataactgagatgtgctgagaccgactccagcatttatctcctcaggacattccatcacagaatgcctattatgaaacatacatttatctccttaggacatttcttgatggaatgcccattatgaaacatacatgctcccttttattctagtgaggaggccccatcaatcagggaaatggtcccagtttctcagtttaagagtggtcatgggaagtagcaaagaaaataaatggatctgtaattattggtccttgttcttgggataccatgtagttttgcccctccataggcaaagattgatcaaggggctaacagaggcaggggcttggggcctaggagagcagttctgaagcaggaattgggaaaatgggaagtcagtatcctagtctcttttccttactacattgttcaaagccctttcacatcatttacctcactgtgtgaatgcacatgattagagatgttacgttattttatcgatgaggacactaaagaccagaaaacgaactaccagtaggcacaaagcaggtgggactagaacttggccagaaagagggctggtgggagggagcacagaatggcacaaagtgcttaccagcatctttgcctcctcctgtgtctctggacaggatcttgtaggaggagcttaagagcagaactgtacttttcgtagcttacctcgtagttcctgtggtcccttggtttgatgcctttctgttcactggaaccagaaacaaaaggccaaagctggtacactctctgcccattgaaactgtgccccaaagagctgaagaaagcagtaacagaaatcttcgagcttgcaggatggcagataagaaacaacttgctaaaataaaactccctccccttctaagagaatgaaattggctaaaattggttaaaactaatatggccaatgaatatatgtagaatgaactcgctgatatcacaacccaaatttctaccacatgtttcatactgactcctcttgtttcatactaacttcccctgaatttgtgtatgggatccatgaggaggcatggagagataactgtgcacgcctgagggacttcgcagatgttccctttccttctaccaactacttgctaatcccagaatcagccccttaaccttttctaataaaagtactgccttaaagccagcacagggagacagatttgagctggactcctgtctccttgttgagtaacctgcaatgaaaagcttttcttttctcaaaaacctggtgtcatagtattggctttgtaaaccaaaaataaaattcaaaggcacccctgcaaccatcccaatggattccctcctcagccagggcaccctaaaatttaaccaaaaaagactggtttaggccttgaagccaggtgggggttgaacttgcttcattatacccttccagcattactatcatcacagaccttaagaaacatttacagtctattctctctaaagcctgatacttggaggcttcatctgcatgataaaacctccgcaaccccttgtcttcacccagacattcttttctatagataaaaactctttcaaccaattgccaatcagaatatgtttaagtgtacctatgacttggaagcctccttctttgagttgtcccacccttccagatcaaaccaatgtaaatcttaatgtattggtggatgtattgaagggggcctgcccctccacacctgtgggtatttctcgcaaggtggagacgagagactgagaaaagaaataagacacggagacaaagtatagaggacgaaaagtgggcccaggggaccagcgctcagcaagttaggacctgcaccagcgctggtctctgagttccctcagtatttattgatcactatctttactatcttggtgaggggaatgtggtgtaactatagggtgatggtggggagagggtcagcagaaaaacatttgagcaaaggaatctgtgtcataaataaggaaaggtgttgtgcctggatgtgcacataggctagttttatgtttaactttacataaacatttcagtgcagtaaaaagtaacagagcagtattgccaccatgatgtctcacctccagccataaggcggttttctcctatctcagaatagaatgtacgctcggttttacaccaagtcattccattcccagagacatgcaggaaacaaatgccttcctcttatctcaactgcatggaagtcttcctctttcactaatcctcctcagcactgaccctttacaggtgtcgggctgaggggctgtaaggtctttcccttcccacgaggccatatcttaggctgtctcagtggggagaaacctggacaatacccaggctttcttgggcaggggtccctgcggccttccacagtgcattgtgtctctggttaatagagaatggagaatggcgatgactttcacaaagcatactgcctgcaaacacatttttaacaaagcacatcctgcacagccctgaattccttaaacctcagtcaatactgtcaggcctctgagcccaagccaagccatcgcatcccctgtgacttgcacgtatatgcccagatggcctaaagtaactgaagaatcacaaaagaagtgaaaatgccctgccccgccttaactgatgacattctaccacaaaagaagtgtaaatggccggtccttgccttaaccgatgacattcccccacaaaagaagtgaaaatggccggtccttgccttaagtgatgacattaccttgtgaaagtccttttcctggctcatcctggctcagaaaccttccttactgagcacctcgtgacccccactcctacccgccagagaacaaacaccctttgaccgtaattttcctttacctacccaaatcttataaaacagccccacccctatctcccttcactgactctcttttcggactcagcccgcctgcacccaggtgattaaaagctttattgctcacacaaagcctgtttggtggtctcttcacacggacacgcatgaaaaatacagcacatgtttttgtgagcacagggttgggacaagagttacagattaacagcatctcaaagcagaacaatttttcttagtgcagatcaaaatggagtttcttatatcttcctttttctccatagacacagtaacaatctgatctctctttgttttccccataatgtattatgtctccataaaatgtataaaagcaagctggagcctaaccaccttgggcatgtgtcctcaggaccttctaaggatgtgtcacaggtacgtctttaacctcggcaaaataaactttctaaattgattcagacttgtctcaaatactttttggtttacaaattggcaaccgatgaaagagactctgagtataggtggcctcaacctctgacaaatctattgatatttagtaccagcttttagctgtctttatggtcgaaaccaacaggacaattggctgagagctgggagccctcctccctccagagaatcctgatctccccaaatttggttgagatccaaagtgtattttgctgtacaactccttttctagagttttacttgcttccaacaaggaaagcaagttttcctgcttccatgacaatagaaggcaggtaactcctttctggagttagagctcacttccaacagagaaggcgaatttgagttttcctgcttctagaatggtagagagcagtcttcagcctgagacccattcctaggtaagtgactgaattggggtttcatcttggttaaagttatgatgcagctggtcgtagtttctccttactgttatagcgctcagtaatcatattgttgggtttttgttgttgtttgttctggtctttctcccatcagatttgaccaattctgcctgacttagtcaaatctgaataaaaattccaaattgtagggaacaaggcctctctgaattagctaaaattccttgctgctgcaaaagaaaaaaaaatcaatttctggttgcttcctgtctttaaaaaaaaattgttctttcatttacttttctctaccctattcctccttccccactttgccatactcagtacgaagaaaaatctagagatgactcaaaccccttaaagaacacagaacaaaggcaccactcaccccatttgggggtgttctgttttctttgtggagtttcaagagtcatgggcagattcttcttaggtctaaagttctgctttcctgtattacattacctcacctctttggcttttgtgagtagcagagattaccttgtactgtgagaggattttaccttgatgtgtgtactggcggatgagagctacaaagttaaagctgactgaggacagtttacaggaagcagtcttcactgttttgttttttccacctaggaagttgtttaggatcctaattctaattcagaggtgcattctacagagtcttctccattgcctttcctctcaaaattaatcttgattggcttctctgggcatttgcgtgaggaactgaaactcattttcatagataaatgagagaatgagtttcctcagctccctaaagggcattttgcttctcccagctgaaaggctcccctggattactaggggctaagtgggagtgtctagtgggttgacccccagcaacgtgcagcagccctacagggaatccccaacaaaattagttttaaaaggcttgtccaagaaatgaatataggagctggtcattccatgctttgagccctcctggaggtgctagacctctggagacaaaaatgactcagtggataacacgctatggagtcctgccaataaccagcacacttcaacccattccactaaaccctaggcctttaaaaaaaaaaaaaaaaaggtgggaaacaatctaagaatgggaaaaacaaggagaatgactccctttcaggcactctgttggttttatggcacctctgcttgcaagtgtttgtgtaaaatggtctttatggtctttttgtgcacaattacatcaaggaaatttcagagcccaaaggtcaacctgcaactataaggttcctaagttatctatctctttcttttctgcctgctttaagtctgctgttacttttttgctgagatagaatccactgtttgtattcaaccatttcgtttttgttattgttaattgtttttgcaaaccaatgagtttgtattaatatctcctggctagagttctgaagtaaaagctatagaatctttgtgtgagggtgtatgtgtgtgtttatgtgtacatatgcatattttgttatgtgttttggccacagggaccaaatgtggcttaaacttacagagtactcataaataagcccaaacgcttttcaagttcacgtgacagtaaaatctttttttctttttctttttcttttttttttttttgagacagagtctcactctgttgcccaggctagagcgcagtggcatgatctcagctcactgcaaactctgtcgcctgagttcaagcgattctccttccttagcctctctagtagctgggattacaggtgcctgccactgtgcctggataatttttgtagttttagtagagacggggtttcaccatcttggccaggctggtcttgaactcctgacctcgtgatccacccacctcggcctcccaaagtgctgggattacaggcattagccaccacgcctggctgacagtaaaatctttaatctagctttaaaattacttgtaaagtaatatgagaaatgtcttaagaattgtcagcatacatttttgtttgcatttattgatcaagagatttcatacttatccctgctaaatactataaggtgtcaaaatttggcataagcattattaaactataaacccagcccaaaacagaatgatctttgcttgtgtgttttttttttgtttgtttgttttgttttgtttttttttgaaacatagtcttgctttgtcaccttggctggagtgcagtggcacgaacttggctcactgcaacctctacctaccaggctcaagcgattctctgcctcagcctcttgagtagctgggactacaggcatgtgccaccatgcctggctaatttttttatttttagtggagacggagtttcaccatgttggccaggctggtctcaaactcctggcatcaagtgatcgacccaactcggcctcacaaagtgctaggatttacacgtgtgagccaccgtgccagccgtgctgtgtaatttttgataaagaagacattgatattagtttagtgaaaataaccaaatcttgaattatgtggtaaaataaacatatatttaatgttaagtttcttacttaggtaaacacctgaaattcacagactataaaatggttgacagggaaataactttaaatgacgactatttgcagttttcataaataggtaaacgattaaaataaaataattagttaaatgtaatggaataaatacttatagacaaacttgtcataatttagaatgtaaagttaaatacatatttcattaaatgtttggatattttccaattaaaaaattatattgtaggaaaacattgtttcaaaaaaaaaagtatgctcttattaaaaggtaatttttgtctaattcaaagctttaaaggttatgtataaataaagaggaaccagcaaataagaaagaagttatataatcaaagaggtatttttggtaagaaagctaaaagaaaaatatgtgagaaagagtcttttatggtgaatttttttcctaaaataaaatgacagggttgtttaagaaagaaggatatgtaggacaaaccagaaagtccaagcatgtcgtgaatgatctaggtcataatacagttagtaaaaagggaatttataaaaatgttatgtgattaattgactataatgaaattataatagtttttctaaaaaactggacttcagtattaaaaatacactcaataattggttaaaacaagatttcattagaaaaattgtgttactcttagtgcaagaagtttttaatttttaaattcaataatctgtttctttttgaaactactcaaatatctcaagcttaataatctatagaagaaaaattttgaaaagcaaatgaaaaatcttttggttctgcttttgtctgcatgtctgttatatctatgattatatgtgccatgtggaagtggtatttcgctgttaaactctatgaaagagttctaatttgacttaaagaaatgtaagggcttggccgggcatggtggctcacgcctgtaaccccagcactttgggaggccgaggcgggtggatcatgaggtcaagagttcgagaccagcctggccaagatggtgaaaccccatctctactaaaaatacaaaaaattagctgggcgtggtggcaggcacctgtaatcccagctactcaggaggctgaggcaggagaatcgcttgaacctaggagatggaggttgcagtgagctgacactgcgccactgcactccagcttgggcgacagagcgagactctgtcccaaaaaaaaaaaaaagaaaagaaatggaagggccttcagactgatacaagctagttcagatgccttttaattcacatgacttcggcagtctttggtaagattaatttggtaaacttaatctcaaaattctctgcaatagtttaaaatcttaaaatcatgttaagtaaccttgatttttttcactaggaatttgggttactaagagttaaaatagtagtaatattaaagaagtaaaaaagtataaaagaaaatgtaatttttttcctagttaagaggctatttcagtcgttttaaattaaagagaaaattatactgtattagttcattcttacattgctgtaaagaactacctgagactaggtaatttgtaaagataaaaggtttaattgactcacagttctgcaggctgtacaggaagcatgaatgggaggcctcaggaaacttacaatcatagcagaagtcatagaggaagtgagcacatcttcacatgtggaagtgtgagagagagagtgcaaaggggaaagtgcaacacactttcaaaaaccagatcttgtgagaactcactatcacaagaacagcaaggggaaaaccacccccacgatccagtcacctcccaccaggtccctcccctgacattgagtattatgattcaacatgagatttgggtggggacacagtgcgaaaccatatcattcacaaataacaatacatggataaaaagaaaaattaagccagggcaacaaaatgtacctccaagacctgtggttaccaagaagatagttgatgcatgggaaggattaaaccaagtaactattaaaagcgaagagtatgatgtaaaacagttccattttatagattggtatcattagcttcttgagaaatctctaatggattgtaaaaatagccactgtaaggacaaaattttttattttaaatgctactgaatgaaagagcttgtttgtattgatgcacgacccacagctcactattgaacaatccctgatgagtatatgtgatccaaaggcataggaggttattcctgagataacaaccagcctagtagactagataaatgccactgtaaggtctgttgtaaggtctatttgccctgaaaaggagacttcctaactcttcctgtaaaacaccaactggagcaccccagatgaagcagttgatacgcttcttatgcaagccatgtaggactacctttttgaggactgggatattctcccactgaatatgcctataacccaggtcatggcaaattttgggctgagaggggcaccttttacatgggtacccctcccacagaatcatatgactgtttgagaagctttatcaaatttgctgtccctcatgggtgtacagatggttaataatacataggggtaattgggctgtgtccccacccaaatctcaacttgaattgtatctccccgaattcacatgtgttgtgggagggacccaggaggaagtaactgaatcatggggtccagtctttcccatgctattctcgtgatagtgaataagtcacacgagatctgatgggtttatcaagggtttctgcttttgctccttccttattttctcttcccgccgacatgtaataattgcctttagcctcccatcatgattctgaggcctccccagccatgtggaactttagtccaattaaatttttttttcttcccagtctcgggtatgtctttatcagcagcacgaaaacagactaatacagtaaactggtactggtagagtggggcactgctgaaaatatacttgaaaatgtggaagcgactttggaactgggtaacaggcagaggttggaacagtttggaggactcagaagaagacaggaaaatgtgggaaagtttggaacttcctagagacttgttgaatggctttgcccaaaatactgataacgatatggacagtaaggtccaggctgaggtggtctcagattgagatgaggaacttgttgggaactggagtaaaggtgacttttgttatgttttagaagagactggtggcattttgcctctgccctagacatttgtggaactttgaacttaagaaagttgatttagggtatctggcagaagaaatttctaagcagcaaagcattcaagaggtgatttggatactgttaaaggcatttagttttataagggaagcagagcataaaagtttggaaaatttgcagcattactatgcgatagacaagaaaaacccattttctggggagagattcaagccagctgcggaaatttgtgtaagtagcaaggagcctaatgttagtccccaagaccatggggaagatgtctccagaccatgtcagagaccttcaccacagcccctcctatcacaggcccagaaggaaaaagtggttttgtgggcctggtccagggtccccttgctgtgtgcaacctagggatgtggcaccctgtgtcccagctgctgcttcagctgtggctgaaaggggccaatgtacagctcaggttgtggcctcagagggtggaagccccaagctttggcagcgtccacatggtgttgagcctgcaggtgcacagaagtcaaagaattgaggtttgggaacctctacctagatttcagatgtatggaaatgtctagatgcccaggcaaaagtttgctatggggtggggccctcatagagaacctctgctagggcagtgtggaagggaaatgtggggttggagcccccacacagagtccctactggggcactgcctagtagagctgtgagaagagggccattgtcttctagaccccagaatggtagatccactgacagcttgcaccatgtgcctggaaaagctgcagacactcaacgccagcccatgaaagcatccgggagggaggctgtaccctgccaagccacaggggcagagctacccaagaccatgggaactcacctcttgcatcagtgtgacctggatttgagacctggaatcaaaggagatcattttggagctttaacatttgactgccccactgaattctggacttgcatgggacccgtaaccccattgttttggccaatttctctcatttggaatggctgtatttacccaatacctgcacacccattgtatctaggaagtaactagcttgcttttgattttacaggcccataggcggaagagacttgccttgtctcagatgaaactttggtctgtggacttttaggttaatgctgaaatgagttaagactttgggagactgttgggaaggcacgattggttttgaaatgggaggacatgaaatttggagggcgcaggggtgtgatatggtttgggtgtgtcctcacccaaatctcaactcgaattatatctcccagaattcacatgtgttgtgggagagacccagggggaggtaattgaatcatggcagccagtcttttccgtgctattctcgtgatagtgaataagtctcacaagctctgatgggtttatcaggagtttctgcttttgctgcttcctcattttctcttgccaccgccatgtaataagtgccttttgcctcccgccataattctgaggcctccccagccatgtggaactgtaagtccaattaaacctttttttcttcccagcctcaggtatgaatcagcagcatgaaaatggatttgaatacagaagcctaatcaaatttgctgtccctcatgggtctatagatggttaataaaacattggggtaattaaccaaaaaaaaaaaaaaaaaaaaaaggaaagcaaaaagggagccaaaggactagccccagaaggatgatagaaatttggggatggttattcaccatttgccccagattggaagattaaggggaaaaaaaaaatcagaaggcagagtttatcatgagaaagctgacattgcctggggcaatgctgaggccaattaagatgaaaattgataaaaattaacaaaagagccttagtcccttggctcgactccctgctgggaacctaaactttttttaaccaggtaaggtaaaatggtctgggggtagaaaagttcctgggaccaaaacattaaaaacatacatgttaatagaattataaatttcctttttttttttttttttttttttttgagatggaatctcgctccatctcccaggctggaatgtagtggtgcagtcttggctcactgcagcctccgccttctgggttcaagctattctcttgcctcagcctccggagtagctgggactataggggtgtgccaccacacctgcctaagtattattattattattttgtattttcagtagagatggggtttcttttcttttctttttttttttttttgagacggagtcttgctctgtcactcaggctggagtgcagtggcacgatctcggctcactgcaagctccgcctcctgggttcacaccattctcctgcctcagcctcccaagtagctgggattacaggtgcccaccaccacgcccggctaattttttgtatttttagtagagatggggtttcactgtgttagccaggatggtctcgatctcctgacctcgtgatctgcccacctcagcctcccaaagtgctgggattacaggcgtgagcccctgcacccagtcgagatggggtttcaacatgttggccaggctggtctcaaactcctaacttcaagtgatccgcccatctcagcctcccaaagtgctgggattacagcagtgagccaccacacctgtcaaattatgaaatttgagatgtttaaacagactttatgtaaggtagttgtgactcctttacctgtcttatgaaaatgggtattacatcgctgggcacggtggctcacgcctgtaatcctagcactttgggaggccaaggcagatggatcacctgaggtcaggagtttaacaccagcctggccaacatggcaaaaccccgtctctactaaaatacaaaaattagcctggcatgatggcaggtggctgtaatcccagctactcgggaggctgagactggagaattgcttgaactcaggagacagtggttgcagtgaaccgagatcatgctactgcactcctccctgggcggctgagcgagactccatcttgtgggagggagaaatacacacacacacacacacacacacacacagagagaaaagaaaatgggtattatatctaactgagggatgtttcccctatctagtgctataaaactgaaggcatgtaaatctgctctttgagaaatgttaattggacacactaaatgggaactagtaagattgcctgagcccacaaaatatgggttagaagctgcagtgctagttgggacaaatcctccacttcatagccttttgtggagcatttactggggcttatggcaaaagactgtgagtacttcccagtgataactactggactagagaatttccacttgaggggcatgtactgtcttgctatggaatgttaactgaagccacccctatgctaatggaaataatggtgcccaagagttccatggtaaaataaaagtggtttacatagatcttgctacctggatgttcaaggaggacaatactcatgagcagggagcttccttttaccctaggactgtttctaactgtatgacgggctgctagattccacagtgcctgatggttctcatgagctgtttggctcgtgaatggcagttcaaaggtaaacaaacaccttgtttggaaggctgctgctctggctaacgaagggtcaaaaaaatttatttttcctttatttccagtttagaacatttgggtgaagtatatttttgtaagcaaaattacatttctgagttctccaaaattcagattgtgattttatgacagtatagttgtttgcataagtttagtaagagtcttttagaacaaaacagttggagacactggttattttaccaagactttcactagaatagcatatttttaggtaaagttccaacaaagccaacttaagagcctatatagtcaatgaattcttgctgcactttatgtaaatcatcaggcaaagtataataagcttagaacttattttgcacacaaattggtcttactacaatttctctttaatagaaaaggagggctagagagaaattgtttcaaaggaaaaatgtaatgctttatactagatttcacccctaacttttgtttttttgagtgcagattgaatcatgaattatatcttggctacagtaatctctagagagtatcagattataagattataactttttcatatctttagttggtgccctaatggaataggtttatttttctgccctgacacacaaataatctttttattgtcaaaatattaatgttatttatttctccttgttttactttcaaggaaaccaaaccagtctccctcctttggcatctcactgggcctgatttgttttttactgcaaatgccctactactaaaactgtttttgggggggaaaaacactggtttttgtcacacaacccagataatttaggcatgcggatacattgtagggtgagtagggcagggttcattgagtgaaaagggaaaaaacgggaaacaggaaccctcagcaaattgagagagtactgctatcaggtttcctaactcacagattgaaacctaggttaccacacaagaacaggagaggccaggcttctcccctctgcaaacggcatggacttcctgaggctccatcctgtcctcctggtgcgcaggccagtcagagattctccagggacccctttttacttagtctcattcacccttctaaagaaatacatttaactgccattagaaggataaggataaggatgaagaccaatcttaactgcttcctgctgacaggaggtgctgttttgggaaaatggcagtcagatctccttcagagaccaatctaagggtccctagcaaaaggggccgtcgtccaaggctccagttcataaccacttggagtgtgatggtctgaaggcaagaagagacaaaccgggttcttagaaaacatatatcaaaacgaaataagtggcgaagggtaaggacctctcaaaaatcctgaggccttttataaaccagtttgcacagggacagaggggcccaaagcctgactggctaaaaaaaacacttacccttttgtcagcatgtcaggctcctgggttcccttcccctaagcccaatgctaagctaacaagtttaaggtttgggaaattaacccttcccagtttggagggtgcatcctggggaggcatcctgtttctatctgtgaagaggatagaggaggaaaaagaaaaaagagacattttttcaaaagagtcccagcggtttcatacacattatagggtgagtagggcagggtttgttgggtgaaaggaataaaaagggaaacaggaaccctccgcagagcgaaagagagtcccaatagcagttttcccacctcacagatgaaattccaggttaccacacaggaaaaagagaggccaggctcctccccactgcggcacaaatttcctgaggctgcatcccatcctcccagtgtgcaggccagttggatattccccggggacccctttttacttgactgtctcaaaactatgcaagcaccctccctctagggccaaggactatcacaggagaagtgggcgtgtgagattgtaagggctggttttgagggatagaattaggtcaaggtcagaccctccaaatcaaggatgggtacaaagatgccgaaacagctgataaaacaagggactttgcctcctgagctattgtgtggcacctttctatccacttcagccataaataatttcctgcttcctgtagaattaaaacaattactgaagctacccctatactaatgaaaataatggtgcccaaaagagttcagttactgataggataaagataacttgcgacaaagcctgctgggttaataccctcagttatgagaagtgcagatagttctatatgtcttttaaaaatttttcaagacaatgcttatgttttgtatagctaattgctctgagtctatacaaccgagactacagtagctcagtgcatacaagttaaaaataagtcagttttgtaacttcgcctttggtttttttgattgttggctttctacttaaaaaaaaataattttaaggggtaatgaatgcctggccatgtctagcccagtctgacctagaacagtgaattgtctgtaagtcttgctgactctaacacccttgaccatagggagtcccaccgagggacaggatgggcccacggcaggctgctatgccacaccagcaacactatgggacagaattaaaatttggtggccattgatgttgcctctggcaaatcttggccagaagtgagagaatgtaaaccaaaaataaaattcaaagtgtgttccacccacccacccacctacctcccacaatcatctgaatagactccctccttggccagggtaccgtaaaatttaacctgggagactggttcaggccatgatgagaaataggggagttggggtaggacatgcctcattatacccctccagcattaacatcaacacagaccttaaatctgacaaacatttacaatctattctctctaaagcctgatacttggaggcttcatctgcatgataaaacctaggtctctacaaccccttgtcttcacccagacattcctttctatgcataactgtctgaaccatttccaatcagaaactgtttaaatctacctatgacctggaaacaccacccaccctgacacctacccctaccccacccacgccttcgagttgtctcgcttttctagactaagccaatgtaaaccttaacatgtattgattgatgtattatgtctccctaaaatgtataaaagcaagctggagcccaaccaccttgggcatgtgtcctcaggacctcctgaggttgtcatgggtgcatccttaaccttgcaaaataaactttctaaattgagacttgtctcttgtctcagatactttttggtttacagcttctaactcattgaggagagagcccgttttgctcagtaacaattctggcaacccaggtgggatgaaacctgtctgaagtactgtagccccttgatggggtacaggccctcttcaccaaccctgagtagtcacctagaccattttgtccagaggcttggcatagggcttctgcttgtccaccgaggctcccttggtactactctttttttcagaaaagaaactgcttctggattagatatctttctgataagtcaaagatgttaatcataatagctgccgtttattaaatgtttatcataggccggcgcagtggctcacgcctgtaatcccagcactttgggaggctgaggcgggcagatcacaaggtcaggagatcgagaccatcctggctaacatggtgaaactccatttctactaaaaatacaaaaaattagccgggcatggtggcgggcgcctgtagtcccagctagtcgggaggctgaggcaggagaatggcgtgaacccagggagcagagcctgcagtgagccaagatcgcgccactgcactccagcctgggtgacagagcgagactgcatctcaaaaaacaaaaaaatgtttatcatatactaagcattgtgttagttgtgtgcccgatatcatttattctttaccacaaactattaaaaacagtattttgtcagatttactttaaagatctaattgactttcattagcagtccatgaatgggatgcctctcatttaagatttaggaaaggcactctgatgagctgagcagaagaggttggctttgtaggcaggaaatggttgaagaaagcagaaacagaacaaagggcagattggtcatttaaaagttacctatggggttaaaacagaggggacccccctatcacgcctgctcaggtaaactgggtcccttctgattggttgctgtaaatctcctggttttagggggaaactggtttcaaagtacagtttgtgaagtacatggcacctagaataagtgactccattctggtttggtctggtttattagtcctaatacaccctatagctcagtccaaaacagttatttcccttaaatttcatttagaaaaagcaaagatttattagccttctttatagataaggaaattgaagttaaagttaagcaatggccagtgacttgctctgggttacatagctaagtagcaagctaggactggaactcaatgcttattcagtttcaaaggcccatgcatttgaacacttcatcttcatatatttttaagcattttcttaaattgaggtgtaacttataaacaataaagtgcatgaaacctaatgcagttcaattaatttttacatatgtgtatgtaacaaatatccagatcaaaacagagaacaattccagtgctttagaagatgtccttatgcaccccttcctatccagttcccacacaagagtaaccatgttttgacccatgctgtctcttttgtgtcttttttctcttagtattatgtctgagattggtccatgttgtttgtatcagtaactgctgtatagtatttcattatatacatagactttgattgatttatcccttatcctattaatggacatatgggttcccagcttttggttatgacaaataagacaaaacacattctattttaaaagattttttttaattattggatttaagtttataaaagttggaatttttttccacatagttatacacatttgtgctacatgaccaaggtgtgtgttttaacttggaacttagggtaatataagagtcccagatttcttcaatataaaagatcaagtcaaagtctaatacatttaagatccttcataactatgttttaagtgagagttcactcataactagtaaatgtatttgatgctgtctagctttacataaagtagctctccaaaacaaatctggtattactggaaattatttgtcagaaacataaatcaaattctattaatgccatatctgagggcatttctgattttctaagttgtatatctgcaaatacttacgtttcaataaatgccaaatccttataacaatgctatttattctcatatcaggtagagattaatacttagtagggttctcaattttgctattcatatgtaaagatttttcctttttagaagaaatatttcttttaaacaaacataattctatcaacctaaaataatcaaaagtcagaatgtagtttaaaagagaatttatttggccaggcacggtggctcacacctataatgccagcactttgggaagccaaggcaggcagatcacttgaggtcaggagttcgagaccagcctgactaacatggtaaaaccccatctctgctattaataaaaatacataaaaattagctgggcatggtggcatgtgcctgtggtcctggctactcaggaggctgagccatgaaaattgcttgaacccagaaggcggaggttgcaatgagccaagatcatgccactgcactccagcctcagtgacagagcaggactccacctattaaaaaaaaaagagtttatttaagaacagaagttgaggactgcagtccaggacacatttccagtttgccttggggagtactccagagaacaagagaggctcaagttttaaagaaaaaagacaaatgaggggcagggacaattacaaaagttgttcttcaggaattctcattggcttacagaaatggcattagttagtgattgcctatacattgttgagctatagggtgtaacgcattttttggctacttggcctcagtctagagcttgcatagcaagtggctttaagcggtaattatttagctcaaggtggaatgacttctgggtctgctaatttaaaggggcttgcattcctcagataagttttctttttctttctctattttatcaaatcttacttcagtttactgtgtatatgcagttacatgttaatgacctttatatgaatatacatgttaatgaacatgtatattcatataacgttccaatgactttaaagtggaaaaacagaatgatagcgtcttaatgttagtgcctcaagtaccattagcgtgaaaatcagcttccttaatcctgaggcaggatatatccctgacccctttgcgggactcacaacagggtacctcctttactcagcccaccgttctcaactcctcgcaggagggagcacacgagcgaatgaggtgggaactggagtgcacgagcactggagctgactggctgcttcagagctgatgggatcaaactccactcagatccactgcattccacccctcgtggagggaatgcacaggtgagtgggtacaggagccaaagcgagcgcttttggacaccggcaggagcaaactctgtgcaggccctgcagcaacatctaggtgggggtgcttgtgacccccaaagccccagagggtgtgttacagtgttcatttcgctcttccatctgcaaacagcttaagtgttaacagatcagtgggccctctgcctttttgcatgaggcaggtgtcctccaccagggcagtgtgaccgccttttgtatccacactcgtggctcccaagctcttgtccagcgtccaggaaaaatgaggtcgcttgaacgaattgaagggtggtaaatgcaggggattttattgccaatgaaagtggctctcagtggaaaggggagctgaaaaagagatggggcaggtaggtaagcttcccctgaagtccagccatctccaaccagattcttttccaaagttaggccatcaagctgtccctctgaagtcaagccacttctctccagtgtccagccgtagtccctgacatctagctgcgtctctctgccagctgagtcaggggtttttataggcacaggatgggggctgggcaggccatggatagtttaatgaaaggcaatattctagtggaaaaacaagttctcactttgggccacgggtttcaggcttttccacttcaaggtggtgttttattggggacccacccttttctgcctagaatatctctacctccatccctatcaatatatgttgacacaagcaaaatgtcattttatataatagagtcctgatattctgtttcactgtggtgggattctcataataacaatttctacgttaaaattaaaatacacattatctattttcatgctcataatccaagtactccaatttaaggaatgtgaaataatagctctttaattctagggaaaaaatagaagataacagcctttattcacttgaatgtataaaagtacatgctttaaactaagatacttatttccatttaatttaaaaacaaacttcttgatgggctcagtgacacatgcttgtaatcccagccctttgggagaccagggtgggaagattgcttgatcctaggtgtttgagagcagcctgggcaacgaaaaatgaaataattaactgggtgcagtggtgcacgcctgtagtcccagctactcaggctgaagtgggaggaccacttgagcacaggaggccgaggctgcagtgagccctgatcacaccagtgcacagcagcttgagtgacagagcaagaccctgtctcttaaaaacagaacaaggccaggcacggtggcctataatcccagcactttgggaggctgaggcgggtggatcacttgaggtcaggagttcaagaccagcctggccaacatgatgaaaccccgtctctactaaaaatacaaaaattggccggctgtggtggcaggtgcctgtaatccaagctactcgggaggctgaggcaggagaatcgcctaaatccaggaggtggaagtttctgtgagccaagagcatgccactgcactccagactgggcgacagagccagactgtgtctcaagaaaaataaaaaataaaaaatcttacttttaattggtaagtctcaaaagtaccattttacctctgcagtatacactttatatttctgaacatctaatgcagtcatgaaaatgttgtcatattgaggtataggagtgtaaagcgcagctgtttcaaatctatacttgacaaatacagtgatttgttgccaactttgtagtcgagtgaggaataaatgccaattgctttgtagtattgacttttcaagagatatgagaaagaaaccataactgagaagaaaacatgtctgatgcccagggctttttcgttttcttttgttttaagcagaaaacatgacagagctttgactttgctgcctaaaatattatgactattaagaaaataaatactttgtgcttctgagtgaaaagaaaaaatctctgagataccgagaaaggaagcaaagaggcagagcagttgtgaagcactctccttccttctgtaagccgttgatatacgtagggtccatggatgtggttaatgtgtgtgctaatagtttggcagtgtggcttctatttgccgtatggttctctggcagtggaacatagtgcattgttaaaaagtgaacagagggtattcctgaagtactcagagttcacactagggtactatgttactttgtttttgtagttttcttgttttctcagtctttttttctgaggacaaagtaaatggaatctgactagaggacaccaatttggtttataaactatgacaaagcatggtaatttttattactggaggacaaacatgtcaccctttcttgcatagttcatttagcatttagaaaaattgcttttttattccttgtgatcagagtcagcttttactttttagaaatcagctattgtcttatttttccctcctcttctcccttagtaatcttgtaaatctaaaaattagaatcaaaatagatttggccacatgaatattggttacatacaaagtcatatttgaaatttgtgtgatttagtagcagcctttctggggatatttgatacattttttatgcattgcatgtattaatgccctaccagacatcttttttttttttaagagaaaagcaaacagaagtttattaacatgattaccttgtgaatacatgggagataactcagaaatgagaaaatctcaagagtagatctcaaagaggtggcttcaacttcagacttacacacttcattccccaacacaaagaatgaagggtgtaggccagacaaccctcattctctgttaagactacctggtgaagaagtgcagggtaaacaaaagtgaggtttgttatgcagattgaacttgtgctttttgtgttgataagagtttccagtgatttaggcctttaatcccagcacttagggaggccaaggcaggtggatcacttcaggtcaggagttcgagaccagcctggccaacatggtgaaaacctcatctctactgaaaaaaatataaaaattagccaggtgtggtggcaggcaccagtaatcccagctactcgggaggctgaggcaggagaatcgcttgaaactggaaggtggaggttgcagtgagccgagatcacatcaatgcactccagcctgggcaacagagccagatcctgtctcaaacaaataaatgaaagtttccagtgatttagtcatccttctcttcctggtacagaaaggaagacactcttacaaatgtagatattctttataaaataaatttctcttacaaaaatacaacttttactgttttcagagcttctcctgtgtctgtttcccaaaataatcagtttaaagtaatcctgtgccaaagaggcatatttggaatggcatatactggtgtcctacagacatattttggggtgtcatgtcctgaactctacagttggctccctccgccttatggaaatgtaaataaaatctttggagaccattggtttccactgagctccttcatcagctccaacagaccaaaccaagttagaggtccctcctgctaaagttcgacgtcaccaatctaagttatctgacctgagaaatcaggagaaagagaaacaaaagtcaaatccccaaacaggctagttttagctggcatgataagggagtctcctctgctttaacccttaaaaggaaagtaactttgaaactactgatttactttttgttccttatttctgctttcttcagccttttacccatcccaaaatactcactacccacattgcagagatgagctctctcaacttcttgttctgaaggttacgtgactggtgaattgttctttgctcaaataaactgttaaatttatcttggcagactctattttgatccccaaatttgatttagatttggggccattaaatttcactatttaataataaccctactggatgagaataagtgtttctcaatttctggtgatatggtttggctgtgtccccacccagaatctcatcttgaattatattccccataatccccacgtgtcaatggcaggaccaggtagaggtaattggatcatgggggcagtttcccccatgcatttctcttgatagtgaatgaatctcatgagatctgatggttttataaatatctggcatttcccctgcttgcactcactccattccactgccctgtgaagcaggtgcctgcttctcctttgccttccgccatgattataagtttcctgaggtttcctccctagcattacagaactgtgagttaattaaacctttcctttataaattacccagtctcaggtgttttttcatagcagtatgaggactgatatatctgggtacttaacattggttttcgtctgtggtttttttacatatacttagggctgccatgtacagctatatgtacttcacgacacaattgcagggagagccattcatgtaaatgacaatgtctgtggttctccctggagctgtgcagtgaggcagcctactacacttatcatcacttctgtggtgctggttagtttaattggcattactatttaaattgtcttgattcaactgagtatttaagagtctcatgttaacttccaagagaattcctctttagcctctgtgccatgaaattttgtgtctgtgtggattaatttggatatatagaaaggggacagatattcagtcagtatttaaaacatgaaaaacatacaatttaagatttaaatataccatcaatttggaaataacattcttttttttttcatgcttaatctctgataattagggattatcagatagcaactgggcattctacaattcagtcatattgtgacattactcagttaacatcaaactctgtaagggctcactcagtcccacaaaactgccctcacttcaggcaccaatcacaagtcctgggtccccaggccaccccacctctgtctgactttgctaccaattcagggcttcccataaccttctctgaggtttgataatttgccagaatgactcataaaactcaggaaaactcttcgcttgcattcactggtttattattaaaggacacaattcaggaacaaccagatggaagagatgaataaggcaaggtgttggttggtgggtcagggagtttccatgccatctttagcatgctgccctcccagcactttgatgtgttcaacaacccaggaactcactgaatcccattgtttaggggtttttatggaggtttcattacataggcgtgattgactaaaccattggccattggtgatagaattcaatctccaacaccgttcctgggaggtcaaggggtatggctgaaagttccatccctttaatcaaggcttggtctttccggtgatcagcctctgtcatgaagctatctaggtcctcctaccactagagtcaccttagcataaactcaagtatgattgattggggcttattatgaataacaaaagatgctcctattactcaggaaattccaaggatgttaggagttttgttccaggaatgagggacaaggaccaaatatatgtatttttaattatatcacatttgaatattctgaaaagtttgcagtagtataatgttttaaaaaactagaaaaactcaacaatagaggattgatattaaaataatgaaataatatatatccattagaaaggagtttttttttttttttttttttttttagacagagtctctctgttgcccaggctggagtgcagtggcgccatctcggctcactgcaaccaccaccacctgagttcaagtgattctcctgcctcagcctcctgagtagttgggactacaggcgcctgccaccacacccagctaatattttttgtattgtcagtagagacagggtttcaccatgttggccaggatggtcttgatctcctgacctcgtgatctgcctgcctcggtcccccaaagtgctggaattacaggtgtgagccactgcacccggccagaaaggagttttaataaacagttttgaacttgattagcaatttcagcagtttccaaatggaagtattcgttggtagaaaatctaccagcaggagaagagaattatagaaagctgccaacacagtacaggcagtctgcaatttatgaaagagttgtgttctaaaagttggctgtttgaaattctgaacactttcccaaagaaacaatgttgtaaatactctgggcccaagtcaggctagaacagccttaattttacccatggaattcttggaatacatgtagtatccacacttctatttatgacagttttgagtcaactgcgtcttcagtttcagctagaaccatctaaaactgatcttccttcagtagagttgcgaattcggagaatatgttaagcatagcatagcttcagatattaattaaacttctggccaatggcaacctgttaactaaatcttcagaacagaagatagatttctacacctgcccttaactccaagattataggatggaaataagatttccttcagaagttaagaactgcttgtgattgtcttatttatttatttatttttaatcctaaaagcaatacatatccatttaaaaataattaaaagtagaggtagtatgctccacttgctgtgaaatcatttagaaaattgtttttgtgtacacatacaacacagctagaacaagtgtggctaaaaaaagcaatgcagttggtaaataaagatgaagtttgttaggttgttcatattcttttaactttctgtaagtttgaaaatttcaaaacaaaatggtggcgattttttttaaagtaacaggagtattcgcttatcttccatccccaacctcattctcctctccagagttaaaacctctgctagcagtgtatatagattttcaagtgtcttttcaagcatgttttttaaatccatttacagaaaattttttttgcacaaacggaatcacagtatatacagaatcatactacagtcaccagtcaagggattttgtccaagaccccaagagcaggttcttggctctcatgcaggaaagaattcagggcaagtcacagagtagagtgaagttaaaatgatttactacagactactgaattacagaatagggcatcctcagagagcaagaggagggtgcacccatttcaatataatgctaatatgggttattaagaaaagtgtactttggccaggcgcagtgctcacgcctataatcccagcactttgggaggtcaaggcgggcggatcacctaaagtcgggagtttgagactagcctgaccaacatggagaaaccccgtctctcctaaaaatacaaaattagccgggcgtggtggtgcatgcctatagtcccagctacttgggcagctgaggcagcagaaacgcttgaacccgagaggcagaggttgcggtgagccgagattgtgccattgcactccagcctgggcaacgagcgaaactccatctcaaaaaaaaagaaaaggaaaagaaaagtgtgcttgtgaccagcttgtgacaggctgttagtgttgttactttcctatgttactattgattttagcaagaatttatgagtgtactaatatttttaaagcaaaacctattcttaaactaagaatgctttttgttcttaaagtactgggacatttccataagtcctgggtcttcagttagttaacatcattaacttgttctctcaaacataaatgccttgtgaccaacagtgcccagtctccgggaacataacacagcagatttggctttatccagcctttattcaagatggagtcactctggttagggtgcctctgacactgttgactgatattctacttgcttttaaaatttaacagtatttattagttttctcttgctgctgaaaaattaccacaaatgtagtgccttaaaacaacacaaatttattaaagttctgaggtcagaattccgaaatgggtttcactgggctaaaatcaaggtgttggctgggctccatttcttctggaagctccaggagagactcgattttcttgctgtttccacctcctaaaggtctcctgcatttcttgtttcatggccctttcttccatctttaaagccaatggaatagcatcttcaaatatctttttcactgattcctctgcctctcttataaggactctgtgattacactttacccgcctggataatccctagctcaagatccttaatcatatctgcaaagtcccttttgcccttttgccaagtaaggtaacaaatagagtccggggattaggatatctttggaaggccattatttcgcctaccacataggatattgtggccgtcttgctttatcagtatatatgaatctgacattctttttaacagctggacaaaactgatataaaccactgatgtaaccactcatgatgaatatttaggtttcccttttatgctgaaataaattatactgctatgaacatttttgtatgtatctgaatatgtgagagtatctatgggataaatttctaaaactgaaattgctgagtcaaaggtggtaaaagataaattttggcacattaagattttaagaagtgtatgtgagcagacagtgcttcatgagtcaggcagcatcaaaccagaagtggttggggctctactaaaggagcatggggaaggcatttatagggtgaatatagaagtagagcaaagaaattctttcattaaaatttgagcagttgccttattttggtcatgcctgtgggaagttcaagaagatgtaactgatgcccagttggctgcctgtgattggctgagctaagcttggtgatcttttaaatttacttttggtttgcttaagtataaaaccctgagccttaaagccacctcagtctaagggcctctcattttgttatcttaattatcttgataatacggccaagttgccctccaaactgttgtgccagtgtaccgtacattcctacagccggcttctccactctgttgtcaaatattcagtctttttaatgtttttcagtagatgggtaaaaattatattaattcaaattgcatttccatgattaaaaatgagattaagcattgttgtactactttttttttttttttttttttttttttttttttttttttttttttgagacggagtctcgctctgtcgcccaggctggagtgcagtggcgggatcttggctcactgcaagctccgcctcccgggttcacgccattctcctcctgcctcagcctcccaagtagctgggactacaggcgcccgccactacgtctggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtactactttttttagaattttctgtattaaactttttggaccctaaagagaaacatatttcatgatgcatcatgagaattggggtacataatgtttgtttatttaaaaccatgtttatttcatacaaaattcattttaaataaatatctgtacatcaaaatttaatgattttcaaaaagattgtttagtaataattaccaggactccttatgataaatactatatatgggactttggtattgattatataaaatataattatttatttttttacatttatttttggtgttaaaaaataattctgaattggtaacttttttaactctaaaattgccaacttcataacatcatctttgaatttgtgtgtatcttacctcattgtcacatcctgccttccctcacactttagaaaattgtccaacaaagcaaactgggatgaaacctgtatgataaatatatagagaagatacagagaaatgtaactggaggttatttatgcctcaccttcagttaatttttttttttttttgagacagagtctcactcttgttgcccaggctgcagtgcagtggcgcaatctcggctcactgtaacctccacctcctgggttcaagcaattctcctgcctcagcctcctgagtagctgggattacaggcatgtgccaccacacctgactaatttttatatttttagtagggacgggatttcaccatgtcggccaggctggtctcgaacttctggcctcaagtgatccacccgcctcagctcccaaagtgttgagaattcaggtgtgagccaccgtgcccagccaatttttcagttgattttaaatgatctctggaagaaaagttttactccttaatctaaacttttaaagagttcttctaaacggaaaacgttgattgcttctggagatgggagcagggactgggtagctggggtggtgatatcaagggtgggaggcagtcttttttacagtcctttttttttttttttggtgtctttaaacattttaaatatggaattggatcacctttagaaataatcacgaattggccgggcacagtgcctcatgcctgtaatcccagcactttgggaggccagggcaggcggattaccttaggtcaggagttcgagactagcctggccaacgtggtgaaaccctgtctctagtaaaaatacaaaaaaaaaaaaaaaaaaaaattagccgagcgtggtggcacacgcctgtaatcccagctactcaggacgctgaggcaggagaattgcttgagcatgggagacagaggttgcagtgagctgagatcatgccactgcactccagcctggctgacagagtgagactgtctcaaaaagaaaaaagaaaaaaagaagaaacaatcatgaattttaaattcagtggacaaaaattttaaatcatttttaaagcccttttaccgttggctttcctgtgattcaagtggcagcttgatttcattgaaatgtggaaagatgagccatcctatttttccacattaaaggattggttccaaaagtgattctgggctcaacttggggctcctttgttggacctctcctactcaattcagtaggctgttggttttcctcagggccctgtggcttcaattaccatctgtttgatgacagcccccagatatcaatctgcagttcaatcaccaaccccactaccattatgcacattaaagtttaaccgaccttaaatcagaaagtggagaaaggcttataaacttttcctccttttactgctttttttccccctcttccatgccataggtttgctgatgatatcaaatgacattatacagtgtggcttatcccgacttctgtcattcagggtttaaaagcatttttacctatcagaataaaatgcttcctttggtcaaccaccttttggctaacattccttactattttaggttgaattctcttacccgcccctgattccaggagatggacatgacagccacactttacctgaagaatggaagtatttgcccttccttgccttaccagatggcgcacacaactaccaggaaggtatgtaacaagacagtgaagcagttaggtgccatttttgaaaaaatttgccaagatatcttaggttctaaatacttagaaattaaaggccttcagcctgttagaactatttataaaatatttacatgcttgtttggagataactagtcattcactagagcacctctaaaggagtgccaggcttacattggctgtggctggtgaaccttggccacgcttctgccaagtgattagccagagcaggacagccaccactggaagcacttcctacatctatacttcatactcctcagaggcaaatcagggggcttaccagcaccagctgtacattgcttgggactctagctgcatacttgcagtactaggttatcactccagtgcccaccttagaaacagctgagattgtttttgtgcctctggaaccattgctgtcacaagtactctgcttgcaaggttgcttgcttgcatgcggagcatgttaacaccctcaaagaaagcagggctgtgaagttcttaccgaatctcttaccaccctataactgagtactttgcctgacttaatgaaggactgtattttactatggtatttgatgctctacaaaaatgtttttgttgttactgttgctattgattttctttctttctttctttcttttttttttttggagatggaatctcactatgttgccctgttgcccaggctggtctcaaactcctgagctcctgagctcaagcagttctcctaccccagccttcccagtagctgtggttatagacgtgagccactatgcctggctctgccaccatgcccagcaaaaggactgctacaaacatgtgaattaagattatagcaaatgttctacagattttctttatatttgtgtatgtgtataattttgtctgtactatctatctgaaagtcagttgcaaacattgtgacactttaaatacttaagatctgagaatgagatcattccccagtgtaacttccagtaccattatcacagctaagagatgtaacagtaatttcataatactatctaacatccaatctgtgttcaaattttctcagttgtcccccaaatttcttgtattcattcaaggttcgtgtgttgctgttggcttttatgactgtctactttcttttcatctagaacgattccctaaagattaagtattttctgtaattgtagtctcagtttgacctgttataattcagtctcttgggctttttgtgatgagtatttaccataaagcaatgagaaaaattctaggaaaccattggttgtggtgctacaaataagtatgatttggattccttgttttatcatcatttttgtgttaatgactgcattatgatagcttcagattatactacttattaataagggtaattcacctcactatttacatttttctatgtatctcttagatactgtgttttttcacttgccacccagaaatggaaatggagccacagtatttggtatctcttgctatcgacaaattgaagccaaggtacgatagttaatagtgaaaaacaattccaaagtcccttcttagatgttggacacttaaacacagtctttatttttcagtggtgcctgtaatgttgttttagatttttgtatacaatttgtagctgttttttcaatagtgccagtttattcacagaaacattttattaagttgacattggtggctatgcttatatttgtatcacaatattttgtacattgcttttagatagtgatacataaattatctatttgtcttttaaatactgtatttacatttcaagatgtctttgaattttctgtttctagtgtttggcatataacttagaaaaattgagtggtaatgcttgtgtgttttttagtttttttatttttttaaagacagggccttgctattttgcccaggctggttttgaactcctaggctcaagggatcctcctgcctcagcctgctgagtagctgggactacaggtgtgcaccactgtgccttgctttttttttttaagcagcatttcagaagtagtggaacgtgcttagaggggctcccaactactcataagctgtcctatttatctctaagatttctttttttttttttttttttttttttgaggaggagtctcactctgttgcctaggctggagtgcagtggcacaatcttggctcactgcagccttgaccctgagctcaagccctcctcccatctcagactcccaagtagctgggatacaggtgtgtgccaccacacccagctaatttttgtatttttttatggagacaaggtttcaccatgatgcccaggttggtctcgaactcctgagctcaagtgatctgcccatctcagcctctgcaggcatgagccactgtgtccagccttgattattcttaaactacctgctagcttaatgcctgacttactataatagctctaattgataaattcaaataagccaagatggtggccccacctttcatggtttgcttatgtgtagcactgttttttttgtggtggggataatcttgatgagtaaaaagctctttcctctcaaaaggtcattaatactctaaagtagtgagtggttcttagtctcagctgcacattgcaatcacctggagagctttaaaagctaggatgagtgggtctgcccccgccccaaaagattctgatttaatgatctagacatgggaggtgggaatgttttaaaagctcgccaggtgatttttctgcctagtcaagattgacaaccactgctctgaaacaatgatttttaactagaattacctggagacttttttttttttttaaatatctgtacctagcttttcctcctagtgactgaattagaatcgctgggatttgagcctggacaattaaaagttttaaaagcttcctcgggtgaataattagtaaatctttttctaacttgttatgaaggaaatttcaaatatgcaggtaaatttaaaacatagtaccttgagtacctgtgtacccatcacctagactcatagactgtgtgtctctttttcccctgacccacttaaatgtaaaccatgggtgtaaattccaggatacccaaagtaggtaactaccatgaagtaaccctctaagcacagggcctggaacctggaacacccatgttatgtcatgaataactgaatctaaagctaaagatattatgtcaaataataacatacaccttaaatgtatacaatttttgtcaattatacctcaatgaagctgagaaaataaagagaaaagaggctggaccccggtggctcacacctgtaatcctagcactttgggaggccaaggcgggcggatcacgaagttaggagatcaagaccatcctggctaacatagtgaaaccccatctctactaaaaatataaaaaaattagccaggtgtggcagcgcacgcctgtagtcccagctactcgggaggctgaggcaggagaactgcttgaacccaggagggcagaggctgcagtgagccgagatggcgccactgcactccagcctggcagcagagcgagactccctcaaaaaaataaaaaaaataaaaaataaaaagataaaagaaacctgagagtaagagtttgcctgacagctttgagcagttgatgttttcatatactattgtaatcgaacccaggtttggctgcatgctgctcaaaagacaggagagaagagagttgctgggaggaaaagcagatttatttggaaagccagctagatggtgagctagcattctaaagtagcatcttaaatttttcagtctggctggaggatttttatgggagagggatatggggaagaagaggaagttggtatcaagaggtgacacacagacatctgggtaccagcgagggtccaaggaatttggatacttctttgtcattggtcaggccacaatgctcctataaatctttaacaaaacatagttagttgtttacatactttttaaatcccagagttggttttaaaacctgcatgattgccatttttgcatattatcttagtgctctaaaattatccttgcctatgtgcacaaatagggaaacgctgcctaaaaaatggagttagttatgttcttttgctacttcactgttacactattatctttacatacttatatgtgagatgaattgagctgctgtccgttcttggaaatctgttccttttaataccttttattacccgtatgtcatgtaagcactagtaaaattatttctaccaagtgggtcttatccctcagtgctgttttaacagccctcgtgctctgcatagcctttaaatactgcctgtctccccactccctggttctgacccactcaggagtacattagagttgcccattttcccagtgattgctgtccttctcaatagataataggcaatagaagcagacagataaaccaattattggagggaccttgagcctggaagaaagacttcaactcctttcgaatgaagataagacagtggatgaatccaatcaggaggaaggattctactccacagctaatttaaagtctgttcatcagtcatcagttgaaaacatgggggccccttggtcctcaggacagatccaagaaggtgtcaggcagtacactagaggaggaagtctttcttacttccctcacagccttgcctgaggttaatcaaatgaagatttgctctctactagaagaggactgtagaaatctcacatagtcatcctcacaatcactgagaaataagttatgtgcttgtgtttggtgctgggcgccaatacaagtgtccaggcaacatggaacaactaacttaacaaaattgctggcagttcttccatctctggagaacaagctgtctgtttttgtcatctcttttttcttttttttttttttgagacggagtctcactctttcgcccaggctggagtgcagtggcgtgatctcagctcactgcaacctctgcctcccgggttcaagcaattctcttgcctcggctttccaagtagctgggattacaggcttgtgccaccacacctggctgatttctgtatttttagtagagatggggtttcaccatgttgaccaggctggtctcaaactcctggcctcaggtgacccacccacctcagcctcccaaaatgctgagattacaggcttgagccattgctcttggccttttgtcgtctcttaaactagccccttctcaccagaaacaatggtctctgaaaggactgtccatttataaccagaatcaacagtgattgatttgcattgaatggctgatttgggcctggtgacttatacataaagtattttccatgagattataaattccttgagattcgggattgtccattcactattatattcccagtgcctcccacagattctggcacataggcccaaactgacatttatttgttcagtatttcctgagagtcttaataaaaaactttttgaatttaactgaatgtaagaaatttcttatatataatttctatttttatgttgaaaaaatatttttgaaatattgctatgaaatatttctgataaattgctctttgttcataataggcactgaaagtaaggcaagcagatatcaccagagagactgttcagaaaagtgtctgtgttctaagcaagctggtaagagacgaagtaacttgttcattatgttaaaccttcatggcagatctttctttaaggataaggcactattagaataagaagagatttaaatgacatattaaaattatttatgccctagcatctcctcattctctttccctttcagcagttttcatttgcacctctacccaagacttggtaagagaaaggagatcttatagctattggaaagtaagttgacacataaacaaaatgaggtagctgatatatttcatttatccattttggttttgtccaaaaaaaaaaaattttatatatatatatatataattttttttttttgagacagagtctcactctgttgcccaggctggagtgtggtggcgtgaccttggcttactgcaacctctgcctcctaggctcaagcaatcctcccacctcagcctcctgagtggctgggaccacaggcatgcactaccatgcctggctaatatttttgtatttttggtagagacgaggttttaccatgttgcctacgctggtctcaaactcctgagctcaagcaacccacccgcctcagccttccaaagtgctgggattgcaggagtgagccatcgtgcccagccaaaatcttatttcatccaaaataaaattttgaggatgagaatatttcttccaagaagtaattttatacataaggcaagaatagtctcctagaaaaggaatggctgtggccgggcatggtggctcacgcctgtaataccagcactttggaaggccgaggtgggcggatcatgaggtcaggagtttgagaccagcctgaccaacatgctgaaaccctgtctctactaaaaattaaaaaaaaaaaaattagccaggcacggtggtgcacccctctaatcccagctattcaggaggctgaggcaggagaatcacttgaacccaggaggtggaggttgcagtgagcagagatcagccactgcactccagcctgggcgacagagggagactccgtctcaaaaaaaaaaaagaaagaaagaaaaaaaagaaaaggaatggctattataaaagaccccaatgtcagaaaattgatcaattattcatctgattcctgtacacacctttgagaagagtagcctgaaaaatatacatgagtgaatagcttttttatactggaccagatgacagaagagtaagagtaccagatattaaaggaagtgcaacatgttaagaggcttcctgagtaatcattcttcaaaggacgattacaataataatagatgccatttattgagtgcctatatatcaggcattaattctgtaccagacactttttatatgtaattgtcatttccatccttataacaatattgagacatatttactgttctcattttgtaaataaaggcatatctcagaaaaaatgtgtaattctcacagacatgtaactactaagtgataaaattggggtaaaaaaatcgagttttatctgtctctaaagcagacacaagggatgggaagagggtagcttactcagaaaggtctggttgtggtttttctggtctatgtattgaagtctatgtataaatataaatgattttatactttgatgggaatcatgatatattaacagggatactgggaaagagactcttccagtattacttgtttttaattaattagagtatatatacatcattggtcattacatcctgaaatggacatagaaatgagaaaacatctagaaaagaacattacaaataaaaagatgaaaatggtagaagattctaaatagagaaataagcattaagggataactttgctcaaatatataaaacaatattatgataaaggacacaaactagttgttgtgagcctccacagaggacaaaaaatgtaatcatgaatgttcaaatagatataaaaacaagctgttataaggatgattaaatgtcgctacaggccagcaaaaaagtgtgcagaattagaatatgttttaaatcatataatagtaatcgctaatgtttggatactttctatgtgtcagatactttttaccaagtgcttttacctgttatttaatccttaaaacagtcaagtaagaggtactattttcatatgcccatgttcagatcagcaagcagaggtggagaggttaaattcccagagctgagtgatggagccaggcccagcaagtctgagcccacactcttaagcactgtactcagtgtttcaggtacttttcacttgtagccaaagaacagatgacttcacggctttcaactatgaataatacgcactaaagttgatagttactaacttttttctccaaattaaaaagttgtggggttctgtttgttttactattatcaaccaattttactgttatcaactaattattaatcaatggtaatttctcttttttcctttaagcctctgtatggtttacttcaagcaaaacttcaactcattacacatgcatattttgaagagaaggatttttcccaaatttctattctaaaggtaactttatacccctctatagatgtgtttggctgaagatagactcatgaatcaagtaaatattgtcagtaatactgtgaaggataattattaccttaagaaagacattctaatgtgaaaacgcatttgcattaaaacattgaaagactaggaatctgcccaaatactaaatttaaccaaactttttttttttttttttttaggaaataatgactacaaataactataactaacagtaatgtttctcttagtggataatagcccttttgctatggcattgcttctgtaaatttgcttatcttattaataaactgcacagtatttttatatattaggtttctggttcctagttcccaatacatagatcagaaaaaccacatgattattttattgaaaatggacagcatgttttcctcagtgctgccattcatgtaaagaatatggatctctcttggattctggtgggagtaggacatctagggacttagcaagggagcagaggggatttatactaggaattcataccactatgtgaatgaaccacgctctaaaatgtagagggagaaaggaataccctgagtagcttttcatactcaactgcccacgtctcttctgatactgctcatatccagaagagaagaaatgagaactggcaaggttgcagagaggcttgattgtttttaaatttagcgcctagcagaacaaactacctcaattaaggaatcagcttttttctgatcaatatatttctaattcagatctaaaatgatagtaaaatgtgctaaattcaatctatattttataggagctttatgaacatatgaatagttccttgggaggtgcttcattagaaggatcccaagtatatcttggtaagtaactgacttacaagttaaaagagatcccctcatttctatttgtttagcaaactgagttgcgtgtaaaactttgattagaattacatctctatatgggatctaaattcttcaacatttgatgctgtttcttccttaaatatcttcttagccagtgtttatactgagaagagtattagaacataccaggtttacaactattaacgtacaaggtgaatttctgccttttttttttttgagacaaactacctcaattatcattgaaaatggatagcattttctcacccaggctggagtgcagtggtgtgatcatggctcactgcagccttgacctcctgggctcaagcaattctcctgccacagcctcctgagtagctgggaccacaggtgcatgccatcactcccagctagttggtattttttgtttgtttgttttgggttttttttgtagagacaaggtgtccctatggtgcccaggctggaatttctaccttctaggatagtaatggaagttttttattgttttttcttttctttgcgttaatgctgaccagcttaattccctatcataacagatgaagcaagatagaaagctgctcagctcttttataagattcttcaggttagggatttttgtttaatttatactatcttgacaacccagaatatccactggtagccaaaatattcaatgggcaactcaataaatatccattttgtgattaaaactttttaatcacatagtggtttatgctcactcaattccaatttcagcatgcagttgccaattgtggtagtttatgattgcaatcctctgtgtaatgtaaactattattctgcataatatgaggtcctattctgagaacatatttttgtctaaattattttctcttgtactgtgttgtttcaggcaggtgatagactgtgtttcagaaataataacatatgaagtgccatgaccaaaaaccttgtttaatcattgattgccactataatataagctatatcatttctaaacttgtgtagtttatgtttatagaatggggaaatgtgttaaacctgcactgtccaaaacagtagctactagccacctatagctgtctacatttagattaaaattaataaaattttaataaaacttaagtcagtttgtctcagtcacacatgccacatttcagttgctctgtattggctactgtattggacaagacaggtttaaaatattttcatccttgcagaaagttgtactgaacagcactgtttctgagtatatgtgtacctaatcaaacattacagaaatatttggatatttgcatattcctacttttttttttttttaacctttctttctgttaagggggaaataacctttctgcagcaaaaacattacattgtagtcacacttgagcttttttgttaacattgtaggtctgtcacctcgagatcttgtccttcattttcgacacaaggtatggtaccttatttaaataaatttatgatgtacagtactaaaatggccaacactgttcttagtgtgctcatttaactgccaaattcagtgtgctaaattgaatgcagattgtggcataccatgctttagttcttctaagatgtacttggccttataactatacaaaattaaaagtgttggtagtgcttgtattgtagaaatttaaaagagcacaaatactgtttacttctttgcaggatagggtaattttttctattgtttttgcaatttcatcgatcatgagattagagtggaaagaaacatgttttgatcttgcagaatattttatatgttgccctgagaatggagcatttttcaataaaacatctatatatacttataccttctgatctttattattaaagcagatgttgactaggatataaacacattgattatttatttaacaaacatttactgagcacatgctatgtgaacactctggacatccagaaataaagtatttatttaaagagcagggtcccctttaaagagcttacagatacttcaagcaaaaatggtaccaccccttcaagaaaaaataatttcagttagagatttaagtgattctcacatttaagagtacacaggtaatatttaacttctcagtataagttcataatttttcatgtactttttaaagtgctgtatttagtattactgattatggttatgttttaggaggggaaaagatgaattataggcgtgagtctctcatttcaatacaacatttttttttccttttgcaggtcttaatcctatttaagctaattcttcttgaaaaaaaggtacgatcctaagggatgaaaggaaagatggagtatttaacttttattcacttttttttacattatttcataaaattgaaactaatgataaagtattaagatactttttgcctatcattgtggtaagctgaagcacattttcttgttctctgccgtaaaaatataaattcatgcagcttttctgtaggtaacatacaactcaattttaagctgacttaaatagaaaggacatattggctcactttggatttcaggatttgactcagtggctccatagtgtaattaagtgcctaggttttttccatctctttgctctacagtgcacagtgctagcttgttccagggcctagtttccctggtagtatagggaactgccgacagtaattgggttatttgcttcctcagtcataactgctggcagaaataatacctcctcctaaacaatctaataagaattcttggccgggcacggtggctcacacttgtaatcctagcactttgggaggctgaagcaggaggatcacttgcgctcaggagtttgagaccagcctgggcaacatggtgaaagaaaccccatctctacaaaaaatacaaaaattagctgggtgtggtggcatgtgcctgtagtcccagctacttgggaggctgaggtaagaggatggcttgagcttgggaggtagagattacagtgagctgagatcgtgccactacactccagcctgcaaacagagccactgtctcaaaaaataacaattaaaaaagcaataattatttccttcaatttgtttgggcctattacaggccacacacatggctactcctgtggccaaatacatgtttgccctgattggcttaaacttgggttcctgaccactccctaatacaaagggatgggtttgccatgattggcttagtcccaaggccaaatctgacctactacctattgttatacataaaattttattggaaatcagacccatttatttacttgctgtttatggctgctttcacactgtagtggcagagttgagtagttgtgacagaccatatggcccgcaaagcaaaaatatttatctgaccttttagagaaaaagttcaccagcctttggtttagactaatcaggagccatccttggatctgggccagttttatacaccgtattactgtgcctagtggagtcggggttgaaagaatgttggggagtcgaccatgcacaatatccactttagttcattaccttaaaaatattcctttgacccagtaattctcctgttagagatctattttccaaaattaatctgaattggacacaaagctctaagagagtctatcacagaataataaattataagtgagtaactattagtttatcttgtatgttgtatagaatttcagacaataaaaaagatactaagatgtttttattgttttaaagattttcatggcatgttaagtgagaaaagtttgtctacaacaagtcaagcctatgatcccattttataaatgaatatatattaattgaaaagggactggaagtaaagatatcaacctagtttggtgagaacataggttattttttttaaagggaatatttttctgtatcctatttttctataagaaatatatattccttcaggctgggcacagtggctcacgcctgtaatctcagcactttgggaggctaaggtgggtgatcacttgaggtcaggagtttgagaacagcctggccaacatggtgaaaccccatctctactaaaaatacaaaaattagccaggcatggtggcaggtgcctgtagtcccagctactcaggaggctgaggcaggagaactgcttgaaccagggaggcagaggttgcagtgagccaagatcacaccactgcactctagcctgggtgacagagcgagactccatctcaaagtaaatgaatgaatgaatgaatgaatgagtattccttcaaacagaaaaaaagataaagttttttttttaaaaatgaacccagcatattagtgtggtatttcaaaaaattttatttaatttctaaaattgtgataaaatacacataacatacaatttatcatcgtaaccattttaaggtgtacaattcagtgctattaagtacattcatgttatgcagccatcatcactatccagccacagaacactttgaattcctttttattttttgagacagggtatagctctgttgcccaggctagagtgcagcggtgtgatcatggctcactgcaacctctaactcccaggctcaagcaattcttccacctcagcttcctgagtagctgggaccacagtgctgggattaccagcatgagccaccacacccagtctgtattcctttatatatgtccattttttcccctgaatcataataccttgaaagtaatttgtagacattatggtacttcactcctaaataaatacttcaggatatatttcttaagaaaaagaaaatattcctacataatcggaataccattttcacattcaggaaatttaacattgagataataagagaaatctgacataagtccattttcaaatttccccagatatgataatgtcctttgtagctgatgttttctttttttattattatttaattttttattttaaagaatagagatagggtctcgctgtgttgcgcaggctggtcttgaactcctggcctcaagtgatcctcctgcctcaatctcccaaaatgctgggattacaggtgtgaaccaccacacctgacctgattgttgttttcagtctgggatccagtcaaggatcatgtactgcattgctagctctcttttatttcaaaaaggtattccacctttgtctctttttttgtttgttcttttctttctatattttgtgacactggcattttaaaaataatcaagactagtgttctagggtgagatttgtttgttttgttgtggctagtttcagattaaacctttttagcaaaaatcctacacaggtagtggtgtgtctctgtcaggacatgatatcaggaggcccataactatttgtagttagtagtattggtgatgtgaagttcgatcatttggttgaggtggtggttgccacctcaatagctaatccgtagaatgataaatttcagacattgtgactatcctgttgtttcacagtagttttagcatctgttggtaatttgtacctaaatcacggtggatgctaaatggtgatttgtctgttagtacttctatgtttattagctgttactcttttttttttttttttttttgagacagagtcttgctctgtcgcccaggctggagtgcagtggcgtaatctcagctcactgtaacctccacctcccgggttcaagcaattctcctgcctcagcctcctgagtagctgggattacaggtgtgtgccaccatgcctggctaatttttgtacttttagtagagacggggtttcagcatgttggtcaggctggtctcgatctcctgacctcattatctgcccgccttggcctcccaaagtgctgggattacaggtgtgagccagccaccaagcccagcagctgttattcttctttttatgagacagagtctcgctctctagccaggctggagtgcagtggtgtgatcttggctcactgcaactctgcctcctgggttcaagtgattctcctgcctcagcctcctgagtagctgggaccacaggcgtgtgccaccatgcccggctaagtttttgtattttagtagagacggggtttcaccatgttggccaggatggtctcgatctcctgacctcgtgatccacccaccccggcctcccaaagtgctgggattacaggcatgagccactgcgcccggccagctgttattcttatataaggaatttttccctcttttttatttgttatcattatggacggcttcatgggtcttctaatttgattttgattgactccattccaggttcttttttatatttctccagtgaataaattggtgggtgcactgatgactgtgttatccctttttccaggtaagaaaacagcagtatctactctttcttttgtttaacttgtactggaacctaaacttttagaaataaagtttcaaagataaattcgttagggttatcctttctattttaatatgacgtcttccttttggaaataggtttctctcttttgtctgggcttctttctgttctttttgtttttaattaaaatgtgtacaagcatagcttattaaattttataggggagtctactaatatatagctctcaggttcttccatattattataagccaagctgttctttgatattgcatattttaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaaggtaaagtgtaatattttttatcgaattccttaaagaatttgaaaaatcctttcggagtttaacttttgaacttttggtattcaacacattttcaggtggaaaaatttccttgaaaactgtaaagtacaaccaaatacatagtactgtggcatccgtgaccatagtataagtctatggggaagtatataggggattttgattggtaaatgttttgaaacttagtagatatgagtcatatgcacaatcactctcttgggtctatttttaattattcaggtttctccttaaaaacagaattaaggaagtccagacagccttgattgcactcaataaatacaggcacacctcagagatactatggttcagttacagaacactgtgataaagcgagtctcaggaatttttttgtttccaagtgcatataaaagttatgtttacactatactgtagtctattaagtgcgctgtagcattatgtcttttttttaatgtacatatcttaatttaaaaatactttaggccgggcacagtagctcatgcctataatcccaaaactttgggaggctgaggcaggaggatcacttgaggccaggagtttgattagccagatgtggtaactcgcgcctgtggtcccagctgcttgggaggctgagattaggaggcttggttgagccctggaggttgaggctaaagtgagctgtgatcacaccactgtactccagactgggtgacagagggagactctattattttttaaataataaatgtttattatttaaaatttaataattattttaaaaaaacaacaaagtgaataaaacttaaataataatgttaaaagcacaataaagtgaagtacaattaattattaaataatttttaatttatttaaatataaatgaataaaaatcctttgttgtcatttcaacaacattcaccacatcttcttcactaggagcagactccatcacaagaaaccactctccttattcatccctaagaagcagctcctcatccgttcaagtttttatcagtagtttgcagcaattcagtcacattttcagattccacttctaattctaattttcttgctgtttccaccaaatctcccccaaggtcttgaaccccccaaagttattcatgacaggggtatcaacttcctccaaactcctgttaatattgatattttgacctcctcctgtgaatcacagatgttcttaatggcatctagagtaatgaatcttttccagaagactttcaatttactttgcccagatccatcaaaggaatcactatccatggcagctatagccttatgaaatgtgtttcttaaataataagatttgaaagtcaaaatgactccttgatccatgggctccaaaatgaacgttgtgttcctaagcatgaaaaacattaatctccttgtacatcttcattagagcccttagatgaccaggtgcattgtcaatgagcagtaatattgtgaaaggaatctttttttattttcttctgagtagtaggtctcaacagtggccttaaatatacagtaaaccatgctgtaaagagatgtgctgtcatccaggctttgtttttccattctagagcacaggcagcagatttagcataactctgaagggccctaggatttggggaatggtaaatcatcactggcttcaacttaaagtcaccagctgcattagcccccagtaagagtcagcttgtcctttgaagctttaaagccaggcattgacttcttccctacctacaaaagtcctagatggcatcttcttccaatagaaagctgttttgtctttattgaaaatctgttgtattcaaaatctgtaatcaccttcatcaatgaccttagctagatcttctgaataacttgctacagcttcttcatcagcacttgctgcttcaccttgcacttttatgttatagagacggcttcttaaacattgtgagctaactctgctggcttcatacttctgcatcttctcagctctctcagctttcatataatcgaagagagttaaggccttgctctagattaggctttggcttaagggaatgttctgtttggtttgatcttctatccagaccactcaaactttctgcatatcagcaataaggctgttgtttcactttcttaccatttgtgtgttcactggtttaaaaaacaaaacaaaacaaaaacaaaaacacttttagtagcacttttaatttccttcaaaaacttttcttttgcatcgacaacttggctaactgtttggtgcaagaggcatagatttctgtctgtctcagcttttgacatgccttccttactaaacttagtcatttctagcttttgatttcaaataagatgtgagactcttacttaaacacttagaggccattgtagggttgttaattggcctaatttaaatattgctgcatctcaggggatagggaggcctgaggacaggggaagagacaggaatggccagtcagtggagaagtcagaacacacacaacatttattaagtttgctgtctatgtgggcgtggttcgtgtcactcaaaacaattacaatagtaacatcaaagatcacggatcacagatcaacataacaaacacaataataaggaaaacgtgtgagatgtgagaattaccaaaatgtgacagagacagggaagtgagcacaggctgttgggaaaatggcactgacagacttgatgtttgcagggctgccataaaccttcagcttagaaaaagcacaataaagtgaagtacaataaaaagaggtgcctatgtatattaaaatactacagttttaaaagaaaaaagcttagatgtctaacttatatcacttataagtgaggtaagttataactaacaaatacaaatattatacatatgtatttactaagtatacttaacacatacacttattaactgtacttatattagtaaacttcatttgaatataactgttttggctaattgttctaaccctattttttaatctttttataaaaaccattcagaatgtatttgaaattttttaataacttaaatgcaatatagtaaatcaaattgaatctttaattcacagtcttttcaggatatcatttcttaatgtcagtaatgcattaagatgaagcagtcaacttcactgggtcaaaagttacactggactggacatagcatctcacacctgtaatcccagcactttgggaggccgaggtggggaggattgcttgaaaccaggatctagaaaccagcctgtgcaacaaagcaagacgtcatctctacaaaaaagtaaaaaaattatctggacatggtggcatatgcctgtagtcaccgctacttgggaggctgaggcaagaggatctcttgaacccaggactttcaggctgccatgagccatgactgtgccactgcactccagcctgagctttacagtttagagtaagaccctgtctctatataaaaataaataaagttacactgatgctgagtcacttacatagattggcatagtatttgcatataacgtgtgcacatccttccatatatggtttttgttgtgttttgttttgtttttgatacaaagtcttgttctgtcccccaggctggagtacagtggcgtgatgtctgcttactgcaacctccacgtcccaggttcaagcgattctcctgcctcagcctccctagtagctgggactacaggtgcccatcactctgcctggctgatttttgtatttttagtagagacagggtttcactatgttgaccaggctggtctcaaactcctgatctcaggtgatccacccaccttggcctcccaaagtgctgggattacaggcatgagccactgtgcccagcctctcccgtatactttaaattacctctagattatttataatacctaatgcaatgtaaatgctatgtgagtagttactatgctggggttaatttagtattattatttttctcaatatttttaatccaaggttggttgaatctggtatgtgggaacccatggatgtggagaaccaactgtatttcttgcccttccatgagccagacaccatactagattctgaattcttgccatctgtgatcttgcagtctaccatgaaaggcagtctaccaccttttcagttactagaacaaagtattctgtttttccctgaatactgtctggtatccatgaagtggtattccacttttatgtggaaaagaaagatgggtagtgttggcttgaacaatgtatgtattcctctcctatattattcgataaattatttctgggtttacccagctttgcaaaaatgtacttgcccagagtcattgttggtgaatagttaatacagaatgccatctttgttcattttgtaacctgcttgggattctgaaattatcttaactgatttcatgattaaatcaatgcagtttcttaaaactggaatttaagaacttgggagaaaactcgggtttctcagactactggtaaagcaagtagccacaaattgcgggctttctgagctgtgttatgacttcctatacctttcggagccctgactttgctatttcaccgacctgccctctaatttttactattgtgaagatatcaagagggaaattaactgtagagggatttaggttttgtcaggttgctgacaaagcaatgtaaagatgtattttgtgtcttgtcaataaagcatgtttagcggaatattagatttgtgtgccgtatacaatatcagtattaaatacgtgatgggcttactaacatccctataaaatatttgtctttttggttttatgttttttgagtgtttggatgaaaatctaatttctttaatcacagtttcaaatgccaatgctgactttttcatgtcagtaactttggaatataaaatattcttaaaaccgaattgtctttaggcttttttctcttgaagatcttaaaatccttgtacagaaggaattaggttagcaaaacattttgaaaataattttagaaatagccggagagaagcctgggtgcctggggaatattgctgaagtagagtagttatcatatgaataaatggaaacaaatttctacataataaaataattatttccggaagaaagtcttcagcttaccaactttctaatcctctctctggtacttgaacttgcctgaggttgatgcctttcatgtcagtttcagagaggaggcttactatgtaaatgctgtgaatactagcttctaaaatatccttctcaggaaagcctgagagctgattcaggaagtgtagagaagaaacagctgctaaggaataagaggcggggctagaggcagctgtggggtaggctgcctatagggtgatgggaaggcaactgggacactgaaggagaagtacgaaaattagaggatgatttgtgcctgtgtaatatttgtgctctgctgctccatcactttctaaccagaggaacattgaagtggaatgagggaagtggaaaaaaagataacgaggaagatacagtagctattttctgatgtgaaaagacaatcctgagggcttttcttccattcttccctgattttaagtcttcccatcttgttactgaaagtgttctggaattggctgcacattggagcaaaatagttagtggaggactggccagaaaggactggagcccttggagctcggagtcccacctgacttaatctcatgcatcaattttctccctcttttctagttacgagattattgccattatttagtaaaattaattgagtcactataatagaactctatttagaaattacctcaatgcgactgggcgtggtggctcacgcctgtaatccgagcactttgagaggccaaggcaggcggatcacctaagatcaggagtttgagaccagcctgaccaacatggagaaaccccgtctctactaaagatacaaaattagctaggtgtggtggtgcatgcctgtaatcccagctacttgggaggctgaggcaggagaatcgcttgaacccaggaggcagaggttgcgatgagtggagatcgtgccattgcactccagccagggcaacaagagcaaaactccgtctcaaaaaaaaaaaaagaaagaaagaaattacctcaatgcaattattgtcgattaaaaaactttaaaacagccaaggcagaagaatcacttgagctcagaaatttgagaccagcctgagcaacatagtgagacctcagctctactaagtaaagtcaaaaaattagctggagccaggtgcgacggctcatgcctgtaatcccagcactttgggaggccgaggcgggcacatcatctgaggtcaagagatcaagaccatccaggccaacatggtgaaaccccatctctactaaaaatacaaaaattagctgggcgtggtggcatacgcctgtagtcccagctactcaggatgctgaggcaggagaatcacttgaacccgggaggcggaggttgcagtgagccaagatcgtgccactgcactccaaaaaaaaaaaaggctgggtgtggtggcatgtgccagtagtcccagctacttggaaggctgaggtgggaggatcacttgagctcaggaggtcaagactgcagtgagccatggtcatgtcaatgcactccagcctgggcaaaagaccaagacctcatctcaacaaattattattattttaaaaaaattttaattattattattattttttttttttggagacaaggtctcaccactcttgcccagcctggaatgcagtggtgcaatctcggctctctgcaacctccacctcctgtgctcaagcgatcctcccaccacagcctcccaagtagctgggactacaggcacctgccaccacgcccagctaattttttgtggagatggggtttcatcatattgtccaggctggtcttgaactcctgagctcaagcagtctgcccaccctagccttctaagtagctgggactacaggtgtgagccaccatgcccagccaaaataataatgtttaaggctagtcaaatgaagcactggggatagagaataaaaataaaatagtatataaatactaatattttaaaaaagttacctacaatctagtaggccaaacaaatgtgacttttggccaggtgcggtggctcacacctgtaatcccaacactttgggagaccgaggcgggcagatcacgaggtcaggagatcgagaccatcctggctaacacggtgaaaccccatctctactaaaaatacaaaaaaagaaattagccaggcatggtggtgggcgcctgtagtctcagctactccggaggctgaggcaggagagtggcatgaacccgggaggcggagcttgcagtgaaccgagatcgcgccactgcactccagcttgggtgacagagccagactccgtctcaaaaaataaataagtaaatgtgacttttagtgtttgagagatagggaagattatttcaagtattgttctgttttgctgagtcttaaaacttttctaaagagcagtagccatttctttgtttggcttttattatatctggtacttttttaaaaaatacacaattgcctcccccaaaagatgacttaatttataattctcttaagtttcattttatttgtaactttgtttgtttgtttttgagatagagttttgcttttcacccaggctggagagcagtggtgtgatctcagctcactgcagccttgacctcctaggctcatgggatcctcccacctcagtctcctgagtagctgggaccacagatgcaggccaccatacctggctaatttttgtattattggtagaaatggagtttcaccgtgttgctcaggctggtctcaaacttctgagctcaagcagtctgcccgccttggcctcccaaagtgctgggattacagacatgagccaccacacctagcaagtaatgctacaattttaaagctgttttgaactattttaaataattgtataaatatgtaatgtttccacttagttcaatatttgaaagatttcaaagcatcgctaataaaaagtctcccttccatttcatcccctgctatccagcagccctctccagcggcagccaacattgtcactgtcttatgtttgttttcttctgggggtattctatgcagaaacaaatgcatattttcccctccctttttacaaatggtagcagaatgtgcccatttttgccctttattttttatttattttattttatttttatttatttatttatttatttttgagacagagttttgcccttgtcacccaggctggagtgccgtgatatgatctcagctcactgcaacctccacctcctggtcttttcaagcgattctcctgcctcagcctcttgagtagttgggattacaggcactcgccaccacaggtccagctcatttttatatttttagtagagacagggtttcaccatgttggtcaggctggtctcaaactcctgaactcagatgatctgccctcttcagcctcccaaagtgctgggattacaggtgtgagccatcgcgcccagccctttttttaatttaatttttcttttttctagacacagtgtcttactatgttgactggccattctggaactcctggactcaagcaggcctcccactttggcctctcaaagtgctgggattacaagtgtgagtcatcgcgcccagcccgcttattcttttttttacatcatattcttttatttatttatttttttttttttgagatggagtcttactctgtcgcccaggctggagtacgatggtgccatcttggctcactgcaacctccacctcctgggttcaagcgattctcctgcctcagcctcccaagtagctgggattacaggtgcccgccaccatgcctggctaatttttgaaattttagtagagacagggtttcagcatgttggccaggctggtctcgaactcctgacctcaagtgatccgcctgcctcagcctcccaaaatgctgggattacaggcatgagccaccatgcccagcccataatattctttggagatgaatatcatcactgtttatggctgcaggttcattgtatggatgaacatttatttagtcccctattcatgaagagtttggattcgagttttttggtattgcatttattttcataaatataatatcacatatgatataatatttgtaggatactgtaggataaattacaagtagaatgctgggccaaaaggcatacatatttataaatttttaaaggatttttaaacatttcttgaaagctttgacctactttttaaaaacatactttttagttttgttattattatgaaatataatactgattctgaatgaggagcctgggttgagaagctctatactgagcatctctaatgcaaaggtatagatttatttttgctgcttctgttagggtctgatcaagcaacaaaagacattttcaagagtaagaatataaccaaattaccagacatatattccaacttttggaagtcttccctttcatgttaagtatttaacaaccacctgttagttacacacaaagcgctctcctagttggaataaagaatatcaagttgcaaagcggatatcccctgccttcagagagatttgtctcatgatgtaaacacgatattatccagatgacataattctgtgttttaaaaagtgatgagatgtaaaaaaataaaacttatagaacttgaggctgaaaacaagttgaggggctcagtgagtctgccttcctggctgtatatacaagtcatgccacttgttgaaaacccattctgatttagaatctttcagcagaaattgcatatcttccttcagtcaatcattccagtgttaacacttgtactctcaggaagtatgctggattttttctatacttagatgcctgctgcagtttagcaattccactgtaatttttggagcaatgctgttttcaaataaaattcaaatggaaattaattaaatacacagatactaccagtgtcatttttgctttaaatatttagtaacaaatatcttgaaatctttttgcatgatttttaacataggacggtataacaaatgctatgtagtaccttgctgttctcctaatagtgcttcggtggttatgtgcagatgcatgtattttaaatttttaacagccttctactaaacaacgtacttactaacaggcttaatgcttcatttcctaagtgaaaaggttcaattcattagttactgtggagacttttaaattgaatgagaacaaagtgatcaagaaagacaaccttcatattaaaccaccttgccaagatttgaccattcatggagacaattagctaatcattaactggacttactgtagtcaagacttgaagttcccctggaatattattttattgagtcaaagattagctgacttacagacagggcaaggaagaatggaagtttcttttcctactgttagctcactaagtttaaagagaaaggtaaccttttacttttctgatattttctattactcttctaattcatagggatatctgtgtttgccttacatggcattgcagcagcatcatcttctctccgatgtcaccgttcgggggtttgttgctggagctactaacatcctttttcgacaacagaaacacctcagtgatgccattgtggaagtacgtttatgtgtgagtgtgtgtatttggccctgctcatcccagttttcctttcttaactacaattatgaatacatagtaacaacattagtaatgataataactgcatactgtatgccatgtattctaagtattttatgtgtattaactggtctaattctcataaaaacacagtcaatagcactgtcctatccacattttatacctgcagaggctaagtaacagagagatgaagtgatttgtacaatatcaaacagccagtaaacaggtaaaccaggattccaacctgggcaactgggcctaccactacctcatgatttttaacatgtgtttgttgtttaagtaatttcaatccttctagcctgtttagaatgctcttgataccaagacgaaagctaggaataaatatttgacatcaatatatacgaaattcaaatcatttgttattttacaactgaaataatcttttttcttttttttttttgagacagtttcgttcttgttgcccaggctggagtgcaatggcgcgatctcggctccatgcaacctccacctcctgggttcaagcaattcttctgcctcagcctcctgagtaggttggattacaagtgcccgccaccacgctcggctaattttttctatttttagtagagatggggtttcaccatgttggccaggctggtctcgaactcctgacctcaggtgatccacccacctcggcctccccaagtgctgggattacaggcgtaagccaccgcgcccagcctgaaataatttttgagaaattttatgaggctcggcgcagtggctcacgcctgtaatcccagcacttggggaggccgaggtgggtagatcacctgaggtcaggagttcgagaccagcctggccaacatggtgaaaccccatgtctactaaaaatacaaaaaaattagccagacatggtggtgcatgcctgtagtcccagctactcgggagggtgaggcaggagaatcacttgaaccttggaggtggaggttgcagtgagccaagattgcaccactgcactccagcctgggtgacagagtgaccctgtctcaaaaaaaaaaaaaaaaaaagccagctgcagtggctcaaatctgtaatcccagcactttgggaggctgaggcgggtggatcatgaggtcaggagttcaagaccagcctgcccaacatggtgaaaccccgtctctactaaaaatacaaaaattagctgggcatggtggcaggtgcctgtaatcccagctacttgggaggctgaggcaggagaatcgcttgaacccgggtggtagaggttgcagggagccgagatcgtgccactgcactccagcttgggcgatagagtgaaattctgtctcaaaaaaaaaagaagaaaaaaaattcacccacactaaggtttttgtagtttctgacagaaagtatgaaaacatgtttcttgggtgaatggttataatataatgaaagtccaggattcaaagatgtatttattataatcccaaatttgaagaagaaaaagtacattttccaagacaggaggatacagatgggaggaccataaagctgcttcaacattattggttacattctagttctgtagttggttggtgggtgcgtaggaattttttttattattatacttcaaaactaacctgtacgttacatgtattttttagtatatcaaatattacataataagacattctaaagtatctggccgggcacagtggctcacgcctgtaatcccagcactttgggaggccaaggtgggcgggtcacaaggtcaagacatcgagaccatcctggctaacatggtgaaatcccatctctactaaaaatacaaaaattagctggacatggtggcaggtgcctgtaatcccagctacgcgggaggctgaggcaggagaatcgcttgaacccgggtggcagaggttgcagggagccgagatcgtgccactgcactccagcttgggcgatagagtgaaattctgtctcaaaaaaaaaagaaaaaaaaaaaattcagccacactgaggtttttgtagtttctgacagaaagtatgaaaacatgtttcttgggtgaatggttataatataatgaaagtccaggattcaaagatgtatttattataatcccaaatttgaagaagaaaaagtatatacattttccaagacaggaggatacagatgggaggaccataaagctgcttcatcattattggttacattctagttctgtagttggttggtgggttcgtaggaatttcttttattattatacttcaaaactaacctgtaagttacatgtattttttagtatatcaaatattacataataagatattctaaagtatctggccgggcatggtggctcacgcctgtaatcccagcactttgggaggccgaggtgggcaggtcacaaggtcaagacatcgagaccatcctggctaacatggtgaaatcccatctctactaaaaatacaaaaaattagccgggcgtggtggtgggcgcctgtagtcccagctactcaggaggctgaggcaggagaatggcatgaacccaggaggcagagcttgcagggagccaagattgtgccatggcactccagcctgggcgacagagcaagactccgtctcaaaaaaaaaaaaaaaagaatattctaaagtatctgcacgcaaaagaaaaagtatttaaggaattatacttgttaaatgtgttcatttctgctagtgaaataaaggtgatttttacatgtatttctatattttcccaaatatttgcaatctaggtgagtaattttgtaatttaaaatactatatttatgtgtgtattttctaaaaacagaaaatgagcattttataaatagaaagaaaacttcagtgtacaaacctctttcttagactcaccttttgagaatgccattattcatattttttatttccagctccaccttccccgtagttactctgtaaagtgtggcatggatgtctgcgtgaatgcccagactctgacttgtacctggataccctctaggtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacactgcaattaggtaagaaaccacacggagcctacagctacctgttttattataatttttcattttgtaacatttatgagattttggattgcacaataaatacatattccttatagaaaaattaccagttattccctcatacaaagatagccacttttaacgtctttagtactttatagccttgcaaatcttttcctatgcatgtattttggattttggttttatggtacttttggtggtccttttacaaaaatggatccctttatacatgttttctgaaactattactttataatagaaacaacacataccaacataacatgaacatatatcatcacttttacatgactgcttcatattcatcagtatttggcagctgtttgtgaatactgccacatgttttttaagatgtataaagggagaaagaatataaaaaatagaaatcattgaaaatcgtgttgtaaatgattaaatcttcaaatttataacccattctaagaaatattattattcgtattaaatggttaaaatggagcaggtaaacatggagttactcctgcattaaaactatctcattctccttgggaaagaaatatataaatagtgaaaatggagctctgcagtgagcttttcaccttggacatttggcagatatttattagagttgttaaaaatgtgttgagcttgtgtttttgtttcagttaactaaccattatttttttaattgtgatgaaatacacatagcataaaatttaccatctttaccatttttaaatgtacagttccacagtggcattagatacattcattgttgtatcagtagatttttttaatcaacaccaccaccacatgctcccaggttagttgtttacagtgcacataggagttttaaagtaggtttcgggagagtttttcatttgtaaaagacagctgaggaacaagccctcgtttgttaatgagatatttttaaatgtttgccaccactaacaatgtagcagctgagacaccaaaattaaatcctttaaccccaaatcatttggtaatctagaaagaaaacttcagtctccactgccatgtagcttaattaatttgcttttaagcaaattaattaatttgcttttttaaaaatatttgcccaggaggctgtaagcactgaataatagtagctcacttttttttttgaacattaaatatatgcagggaccagtgttctgagcactttacatctagtaattcatttcatccttacagcaatcctgaaggtagggaccttgtcattgccttttacagaagagaaaatgaagctcacagaggttcataagaggcttaggtgggatctgatcccaaacagtttggcttaggcccatactcttacaagtaacaaggtcaaaagaggaaattcagcccaatgaactgcttgaggaagtgttcttagaacaacttctttatgctgtgtatggaactgtgtatctcattcatttcctttcctagcaacaaaaggtactttgtatttcaccttcaaagtaaacaacatgcaattaatatatgaagtaatagccatttgtatcagttctccaaaccatttctaatcttccaagcggaggaaacacatatggatgctttcccatggtattgataaagctgaaaactttatcagttttcagtatattcttttaagactttttttgttttgttttgttttgttttttgagacagagtctcgctcttgttgcccagtctggagtgctgtggcatgatgttggctcactgcaacctccatctcctggtttcaagtgattctcttacctcagcctcccgagtagctgggactacaggtacccgccaccacgcctggctaatttttgtatttctggcagagacagggttttgccatgtcggccaggctggtctcgaactcctgacctccagtgatccgccctcctcgacctcccaaagtgctgggattacaggcatgagccactgcacctggccttttttaagtgtttttgacagtgaaatgctaggaaattcaagaatgaaacaccaaataaagtccaaaggagagaacatcatgactgaaagaaccaatttgtgtattcattcttaatctttttttttgtagaaaaatgacatttataaaaaagtagaaagatatcccaattgcctgtgccatacatatcaatcagtatgtttattcactgtcaagcatacagtttttgattaattaatactatcctcataatggtaaggagaatatggaaatattttggagttgtaaggaaccttggaaaatatctggctcaaccctcttattttccagttaggaaaatgaagttctgagtgattaagtgacttgccaaaggccacatagctccttaacaggatttctggaactagacccaagtttcctgacatctggtaggctatctccccacaaatatgggagggcaaggggataaagtcgttcctttaccctttttggttataatcttcacatccctgaatggctacagcccagctcaacttctttcaaacatttacttgacagacaatgaaaagatattatcggactatgggacaacttttgttacagcatggaagaatactcacaactacagggtgtggaacagcaacaagcatccagcacttgcagaaataaatccaaagtaagcgcgtcctctgaagattgatagtacataaatggttggtttacgagtgcccaatacagagaaaaatctattttaactttgatattgtgaatatcctcaagaatccccttaagtaggtcataaaaaggctcccaaatatagagaaacagcttagaaactgcttccatattcagattgttatacaaaaagcatgagcattatgggaagcactaacatttccctggctctcgatgtgattcagagaggaagtccctggcacttggtgatgctcagtacacaatgattcttctctttctccctggagctgttctttaacagaatggttcaacaagatagaatcctagaaggaaataccactggtttactgcatgagtaaaattaggaggcaattttaaaacatgacatatgcgaaaccaattaaagttaatatctgaagctgggctcatgcctgtaatcccaacactttgggaggccgaggtgggcagatcacctgaggtcgggagttcaagaccagcctggccaacatgctgaaacccatctctactaaaaatacaaaaaaaattagccagacgtggtagtgggcgcctgtaatcccagctatttgggaggctgagacaggagaatcccttgaatccaggaggtagaggttgcagtgagtcaagatcatgccattacactgcagcctgggtaacaagagggagactttgtctcaaaagaaaaaaaaaagttaatatttggactcctggatatatggtcatacctggtttccacatcagactctaaaattcaacaaaacttaatacctgctgtaatactgaatgttgatgatgaaggctttatcccacataggcataaaaggccattgattacagccattatgaaacaataacatctgagtgtgaatacaacagagagcattgaaggagatcagttgatatagtgtatacaggaacttgttttctaaattaaaagataaggccaggcacagtggctcacgcctgtaatcccagcactttgggaggctgaggcgggtggatcacaaagttaggagatcaagaccatcctggctaatgatgtgaaaaccctgtatctactaaaaatacaaaaaatttagccaggcgtggtggtgggtgcctatagtcccagctatttgggagactgaggcaggaggattacttgaacccacggtttcgaggccagcctaggcaacataatgagaccccatcttttaaagtactaggttcaacaccaattttggtgaatttaatcatcatacttggctatagcagaaacctatattgccatttgaatatagtaaaaacagaattaaaaggcaaaaccattttaatagtattaaatgaaagggctgagttcaaagtgttctccctcactgacaacaaagtctctattctcagcgtgctgaagggaaacagatgtggaggtgcttagcagggtggcactcacagggtggtgctgggaaggcaggtcggccttgactgtccaagcagtcaacatgcagagccatcctagtctcctccctgggccctgcactgggaggcctggtcagatctttatctgtcactacatctggtgcttttaacttgaaccagctctatagatgttagtgcaggtccaaaagagacttagctgaaatgagttttaaaaggattatgaaatagtgcttagaagaacatgtgaagaagttgagcctatttagattgaaaagaaggctgaagaaggacttgttaactgaaatatataggtagggaaatcatgcagatatgatagtgcaggccaagggagaacttccctttcatcctctgaagggtcactggaaagtcagctgacaaaaggcagattaataggagaaatggcatgcaaatttgttaatgtgcatgagggagagctacagggtgattggactgtgtacccaagctcgtgtacccaacccgccaacagggtacacaagtttatatacataccatcttcaggttacagaaagaattgggggcttggagcatggccaaaaacaggttatggtggtaagtcaggttatagtggcaagacaggttgtgggagggagaagaaaggaggcctggctagcagagttggtcttgttatagagataaaacttcacaggtagcagccctcagagagaattgatggtaaatgtttctttcagacctttaaaggtgtcagacactcggttcatctttcctatatcttgatattggagggcctcagagcaaaccaggctgcattaatgcagattttctctacagatgcaaatctacccccaaaaagacagcttttcagtaattcttgcatttccagcctttctgaatagccatcttgaaatacatcaaagaagtatattttggggtgaaatagtttagttttcttcaatagcaaattttcaacatttttaccaaattaaaaataacaaatgtggccaggcctggtggctcacgcctgtaattctagcactttgggaggctgaggtgggcggatcacgtgagctcaggagttcaagaccagcctgggcaacatggtgaaaccctgtctctactaaaaatacaaaaaagtagccgggtgtggtggtacatgcctgtactcccagctactcaggaggctgaggcaggagaatcgcttgaacctgggaggcaggttgcagtgagctgagattgcgccactgcactccagcctgggtaacagtgagactctgtctcaaaaaaataaaatgaatgctagacgtctgttgttatcagagggtgtcatttagaaatatttcaaactaattataacttttgagaagtatgaaaccctttaactcctaaagattagggaaggcagcattctaacttaacaagcagcaggtgtatttcatcccttaaatacagccatgccaggaacacagagaatgatcaagtgatgtgtccgtatttcaatcctgtgattcaggaatccaagaagaagaagtgtcacatatacttactttgggccatgaagagtagtttgttatcatttgaagaaccattaattttataagcagctatggattttactagggtcactttctttgttagaccttgacagagggacccctgagataagaattggatatttattgacccctccattttatgtggttaagttgcttgatttttttcctactgcctgtataattgcagaatgcctgattttatatatatatatgtattatatatattatatattatatatattttatataatatatataacacatattttatataatatataacatatataatatatgttatataacatattatatgttatatattatatataatatgttatatatataatatatatattatatataatatattatatattatatataatatattatattatatataatatattacatattatatattatatattatattatatattatatattatattatatattatatattatatattatattatatattatattatatattatatattatatattatatattatattatatattatatatatataatacacttttttcttttaatataatggaaatagggaagtctgaataatgtattttcttacaaaaataatgatagtgctgtttttttttaagacctgccttttgagttgcttttctaacagaaagtagagattttgttgatccatccacaaatctttgcataaccaatagcacacatttataagatggccaggatcaaggtatgatctatgaccatgtcctaaaaccagtgactcaccttgactgtcctggggagcttgtaaaaaatgtgttgatgtttgagccccacccaagacagaccaaataaattagaatgtcaggatagcactaaaacaggctatacacacacaaaacagacaacacacctgttttacaagtgaggaaactaaagctcagaggggttaagtaatcttttctggatgtcgtcactgtaagtggagagctgtgaccaaagccaagtttcccgataccaaacacagcactaccacccagctgtgttgtccatgagaagtttactaatattttcttgtgataactctttttgcagcctttttggtaaaatactgatagtttaaactcaaactttttttacagccatccatttcaaggccaatactcagtatcagacatgaagttaaggttctcacagtaagtacttagagaaaatactgggaaaattcttaagtctgaatttatgccatgtgtttcattgctaattgggaattgtttttctctacttgatagacttatgcttcaaatagtaaccaaatatgtgcataacattctttagctcagcagtgtgtatgtttcaaagtgagaacaccactgtttcatacaggatggtgtgaactaataacaggatttaccatttttattttggtgaagtgcttttagcaagccgtggctgtcggagagatgcagccatacatacatccttatgtcctcaccactttttggttcatctgtatgttcttctcgtgtattctgaaaatgcacatgcttaaaaggttaataaattaattcataacaaataataatttagcttcttttctcagtaattctaattttggatggttacagagtgactattgtgtgtgtgtctatatgtgtctgtgtgcgtgtgtgagatttttttaaaattgtacctaacacttcttttatcttatcttttacccagttctgttcagaatagtgaacgtggcaaaaaaattggaaacgtcatggtcacaactagccggaatgttgtacaaacaggaaaagctgttggtaagacatgcctttagccaggaacaaattggaatcacaacacatccattttctatctttaatatgtaattgataaaacaaacataaagttgtaaagatctgtgttatcacatagtaatacaagagttttttaaatttttgtcatattcatttgaaaaattccaaattccaaatggtcaaactccattatctaatagagagtgacaaaattttctgatgaagtcactgttttgctaccaagattcaagctgcaccagagttttcttcccccattccctgtgctgtccacagttctttataaatggcagagactcataataaaagtaggtattaggaactgctatcctctaaggtagtattacacaataaagaaaatgaagccaacagttggtttttcaaaaagatcaacaatatttataaaatctggtaaagataaaaagaaagaaggtacaaattaccaacgttagggatgaaagagggacattactgtagctcttacagaaattaaaagaacagaaaataggggaatattgtgaacaactttatgctaaccagtttaacaacataaatgaaatatacaaatttttttaaagattcgcattaccaacacagttgcaaaaagaaaatatgaatagccctattatctattaaagaaattgggccgaatgcagtggctcatacctgtaatcccagcactttgggaggctgaggtgagaggattgcttgagtccaggagttcaagaccagcctgggcaacatagtgagaccccatctctaaaaaaaaatttaaaaagtcagtaggcatggtggtgtgtgcctgcagtcccagctacttgaaaggctgaagtgggaggattgcttgagcccaggaagtcaaggctgcagtgagcagtccagcctgggtgacagggcaagagtcttaaagaaagaaagaaattaattgaatttaacgtgaaaagccttgccataaggtttttaatttaaaccaggctgcccaggtggcttcagtttgaactctgtcaaatgtttaaggaagaaatactagttttacacaaaatctttaaataaggtaatactccccaactcattggatgaggccaatattagtatcaaagtcagacaaatggtagcatgctcttctgcacctagctgttttcgcttaaaatattttgaatattgttccacatcagttctaaaatttttcattccttttctatatttttaactttttattttgatgtagtttcaaacctgaacattgcaacagtgcaagaaactcccaattatcttctgattcaccaattatttacattttgccccatctgctttgtcatacaatgtgttgtaaaaatagggcattactacttccctagcttctgaaagaggttgactaaccgttactgaacacaattcaaaagccccagaactaagtaatctttgtgtaggtgtccttatatccctagttttctgaatacctagagagagacagaaaactctacagactcatttgtaaagacaacacacagcgctaccactagattagttttattgcaaaggaatggaatttagcacacaaacatttatttccaaacaatatgcctttggcttattttgaatttttattttttaatagaaaaactatgctatattatagattattatagatacatcattatacgttattattttttagtgatgctgctactgatagttaaattctaaagccaaatctcttctatactcttctgtccaagaatagtgggagtgtattagtcaacttaaataatttcacttagcatcacctttttttcctgagacagggtctcactctgttgcccaagctgaagtgcaatatggtgcgatcttggctcactgcaatccctgcaacccctggcaggatcctccttcctcagcctaccaagtagctgggactacaggcatgtgccatcatgcctggctaatttttctattttttgtagaaagagggtttcgccatgtttcccaggctgtctcgaattcttggactcaagctaaccacccgtctcggcttcccaaagtgctgggattacaggtgtgagccaccatgcctggcctaacatcaacttttgagatactgttctataaaacacaatagacctggggcagatagagctctatacatctttgtgtaacataacttcattttagatgacaaaagcacatttccctacaacagtctaaccactcttccctgtttagatggttattgattatcaagttggtattgaagatacacaaagcagtttgactttttaagctctctaataattctgatacatagccagtgttgctagcactgagggtattaaagaaacagtttgatgaatactttcagaatgctgaggcaagtaggtgcctacgctaaaaaatcatctatttttccttaagacattcccatggaaagggattgttttgaaactaaaaatttaaatgatattttggctactattaacatattgatgtgttctagtgaattaacatttattggctgggcacagtggctcacacctgtgatcccaacactttgggaggctgaggcaggaggatcagttgagccaagtgtttaagaccagaccctgtctctacaaaaaatcaaaaaattacccaggtgtggtcacacaggcctgtggtcctagctacttgggaagctgaggtgggaggatcacttgagcctaggatgtcaaggctgcagggagccgtgaccactgcactgcactccagcctgggcgacagagtaagacgctgtctcaaaaaacatttttttaaatttttaattaaaaatgtattaattatgttggtctttcactgtctcgtaacaaaagttaagacatttttccttttgtttttctcctctccatccaggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttctgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttttggggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggatatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatgctgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcggactttctattaacatttctagctaagagtttgactcttagtggtcactttactgactttccaacataaaacaagtatctcagaagatacaactttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaacgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcctacagttggacttgacctgtcctagaagtaccctgtgtgttgtccatgtggtttctggcctccttcacagttaaacggcagcttcatttattaagaaaccacacagaatgaactaaagactcatgactcatttactctcattttgacatcgctttgacagtggtgcccagctttcaaggcagtgacctctgcaggaagaggcccttagcttctgtggaatgctaagtgcagagagctgcaaaaagtatcaagcagagcctggtcacaagataatgtctcattaggatattgtcccaagcaacccattttgcacctggactgataagtgtcaaaatagcccttgatattgccactgaagactcctgccacattttcatgtatatgttcatgtactgggttcccttacaactgttctacaaaacaggctttaggatgtgcttcacagaagaagtgacaaacttccttgccccctgggaatgtgtgcttccttgagtgctggtgcagggttaagctggagttaccagtgttctttgatgtggaccgtgagagccctggagctgatgggataacttgaggacagtggagcttcctctactcagggaaaggaaggcatctccttccctttccagatgtccccctcagactgagctctcctgtggggatgtgatgggtccctatcacccaccaaggaagagctgcctacccttcattctgataggacaggagttgcagttattgaatctggtaacatctggaaggagtgtgattagggagcctgttctttccaaggaaagttctttccatccttcatgaagggcttctctctgcctgaggtaatgtacacagggttggggaagccactgcagcaggactgacctgtccaacttcaccatcaacagatcctcacatggcacgcatagacactttgtatgatcatgaagatcagaatggtcgtgttctgtgttcttgatcccatgaaccacctgcttttggaaccactgacatcccaacataacataattaagactcaaatgtttttaaacatttcactggactgggctgcactcctggagcacatagatgtaggctaggcccagaaaaattatgaaagccacttactgaaatgctgatcattgctgagggcaagtgatgggtacataagggcttcttagactattctgtttgtgtatgttggagaatttccataacgaagagttagaaactacttgctagccattaaacaacgtcgttacccatgaaaaggcactagttcctgtgcggcggaccctgagggcctgacttaggaactggcttaacttcgtagcttctccatggatgccctggcctccacaagccctctcaccaactgaaaccttggctgctgctgttgccttcccatccctctagttgttggaggagcactattgagagaacccgtagtacacagtaatcaaagacccagcccaacctctcttcctcctgaaagtcttccccaggctactctgagtcctttctaatacctggattctcaggggccagtggctcacacctgtaatcctgaatattttgggaggctgaggcaggaagactgcttgggcccaggagttcgagaccagcctgggccacatagggatacctcgtatctacaaaaaatttaaaaattagctgaaggccaggtgcggtggctcacacctgtaatcccagcactttgggaagccaaggtgggtagatcacctggggtcaggagttcgagaccagcctgacaaacatggaggaaccccgtctccactaaaaatacaaaattagctgggcgtggtggtgcatgcctgtaatcccaactacttgggaggctgaggcaggagaatcgcttgaacccgggaggcagagattgcagtgagccaagattgagccattgcactccagcctgggcgacaagagcaaaactccatctcaaaaaaaaaaaaaaaaattaactgggcatggttgcatcttcctctagtcccagctacgggagatgagggggtgggctcgggtgagaggatcactgaaaccaggaggtcaaggctgccatgagccatgactgtgccactgcccttcagcttgggcaacagaatgagactctgtctcaaaaaaataaaataataaaatacctggattcagtacttactgaggactatgtaaagcggtgcttcccagtcttggagacttgccatacagtgccacacatagtccctgacacgttcagttcctactccgtggaccttgctgttcagcaggtgcgggtgggcggtcactgtagaggggagagagtgctgggtggtgagggagcacgagtggcgccaacacaccacagggggtaactgctttttcacagggaccaataaatatctcttcccctgagtctaagttgaggcctgagggagttttccaggtgaggtgggagtgaggggagagaccatgagacgtaaagggctctgtggcctggcagagcagcacaaagactggaagcagcgcggcttgaggggatgttttttggagtggccgaaaccgaaatggcaaggacgacaggctagagatgaggtcaggaaataaggccatatctggaggagagccctgtcagcccgcggacaggggaaagccttcaagggtttcccacaggcaggtggcaggttggctgggtgttgcctgtggaaagttctttcggtcgtgggcaccactgcttctgctttgccctttgctgtaaagttagtgatgttcctcagctgacctctgaactcaaccaccgcccctttcccttcctcactggccttcacagttttccactgactttaaatcacatttgccccaaacataataaagccaagaacaaaagtctatggcatggccctcagtcaaaaaccagttactgtgagaacactgttttcccgatttccccaggcattaggtccgtggaagttgttgatgaaaagaacctgtcaagtgatggtgtccctgccaggaagccaagagcacagagggcacttgagcatctgtttccattactctctctggctaagtggagacccaggagacatgtggcaccaccgctgtggtgatgtgtttaaacttggagaaaacccgctgtttcttcatgtcatttacaagcacaaagggagtcatttatacattcaaaaagcccatctgccgctaacatctagactttcaattatattcaattcatagaattattttttctgataaaatttaaccacattcatgctctcaggaatgccaaggttaaaagtggggcaatggagaatttctaaagtagcctgtccacctgcctcctcaagctctgccctagaaaaccatcactgagcagcacttcctagaaaccacggagactgaagcaaaattaccccgtccttggctctcacatcctgaattggttctttgtacaggatcatccatctagaaaccaaagctactgtggccttgataaaccactcactctcgctaaatactttccaaatggaaattccaaggtaaagttttaacagatgaagatgaatgagtattttttgtgtcacccattttatggtcatcaaaaccacaaggtcagcaggactagaatttttaaatcttatatattttatgacctttaaagtgtgttttttcattagtgacatatccctcactttgggactcaaagtggaaatcatttttgagtgtggttaattccattcctttgagcatctgggcttaatccttaaaattttcttttgggaccttattggaaatgaaggattaactagtcaccactcctccggttggaaaacgtgtcttttgtttccttttttgcttttttttttttttaatttttgatctttaaatagagacacagtgtcactatgttgctcaggctggtcttgaactcctgggctcaagcaatcctcctgcctcagcctcccaaagtgctgggattacaggcatgagctaccatgccccgcttgtttccttttaaattgtcaagttaaccctgtgaccaccctcccttgaaggacaggctattgtgtttccaaagcttctaatgtaattcatagggaactcaaaatggatttcccatatggacagtgttgtttatgggagctatgtctcagctcaaaaaaggcagctcaccagacagccagagtagataccaaaatacagtcacacgtcactaacaacattctgcaaaatgcgtcactggataatttcactgttgtgtgaacatcatcgagtgtacttacaatatcctagatggcagagcctactacatagttaggtcatatggtatggcctattgctcctaggctacaaacctatacagcatggtactgttctgaatcccgcaggcagtgttcacacaatggtaaggatttgtgtttctaaacatagaaaaggtacagtaaaaagacagcattgtacaaaattagctgggtggtggggcatacctgtaatcctagctactcgggaggctgaggcaggagaatcgcttgaacctgggagaggaaggttgcggtgagccaagatcacaccattgcactccagcctgggcaacaagagtgaaactccatctcaaaaaaaaaaaaaagacaagtattataatcttaagggaccaccatcgtatatgctgtctgtcactgaccaaaggttcgctatgtggcacatgactgtgtggtataaaggtactagagaactgtgcaacagatggaaacgtgttaagtgacaacctggcagctgaaaccgtaacttccattcgccgcagccccagcagagtaagttaagcttcactcagtcttgtcttaacacaaaaccacttgctatgggtgagggctgtctgggtccagaagataacagattagatctgtacagatacatgatataaagaaagtgatggggctgggtgcagtggctcacacctataatcccaacacttagggatgctgaggcacgaggactgcttgagcccaggagtttgagaccagcttgggtgatatagcgagaccccttctctactaaaaataaattagctggacatggtggcaagcgcctgtagtcccagctactctgaggtgggaagattgcttgagcccaggagatcaaggctgcagtgagctatgatggtgccactgcactgaagcctgggtgacaaagcaagaccctatctcaaaaaaaaaaaaaagaaagatgagtgtgttgagaagtccagtaaagtgccatcatggcaatcttttcgctgggacagtgagagaaagcttccttgaggaagtgtcatttgagctgctgaagtgaggatgaggcagtgaagatgagagcagattttctgtcctccggccttggggatggggccaggggtggcatggcctgagatgcaggggaggagcaggtcagggggagtgaagctctaggaaggggaaaagagtgatgagagaggagaactgaagaagaatacagcctgcagggttgctaaagccagaaggaatctgagaaatacagaaaccagctcctcctgctctgcccctgggagtctgtttctcttgatgaggctacagggactaagggaaagagtgtgaggagggggaaaacccctcttggcaaacacaggaaaaaagagaagagcctgtgaggagcggtctgtgctgaggacatgtgtgtgatgatgtggctgcctttccaggggcaagcatgggaagtaccttccaccaaggaagctggaagggttgggaaagtgcaactacctttatatcaatatcacaaaccaaaatgttttgaaaataaacatcagtttttcttggggaccaaaagatgttttatccacttggaagctgcgacagatttcaaggctaagcagatgttaattaaaatcaactatttcatcttatttaggtggttacataagtatacacataaagtcaagctgtacatgtaagatgtattttaatgttcctaatcattaaaaaaaaatacccaatcatttcaaaatgtaatttacttctcagggaagtatgatcagtggaaggaatatagcttccacttttcagacacatctttgaagaaaactacaaatccaagaggctggtgtttctgacaagtaaaaattccgcataaaattgcctgcatttcatttcactcaattttggcaacaattagcatcactctttgcatttgttcagggctttataataaagtcgggatgccataaataggtcaacaggcctgggtgggaacaccagcacccacacttgcttgttacttgacatctctgaaccacacattctccttcagtacagtgggtttaaatgagatgatgatgcatgtgttgaggctgcacttgtgtatcttcacattcgtctattgttcatcatcctctatggcaagtgaacagggcttttttcctgttttatttatcttcagagcctagaacagtgcctggtgcagagtaagcacttagtggacactggatgaatagaccgatagacaattctgatttgtaaatggagaagaagggagatgttttcttactgggagaagaagcagaacaaaggaaaatgaaaagaatggcgtgagttcctgtggttagaagagaggtcatcagaaaggaatgacataattggatatgaaaaggaagtgtgaacttatacatactcaaactggcattatgtctaatatatggttgactctgaatacatatgcgctattactatttttttttttttgagagagagtctcgctctgtcacccaggctggagtgcaggtggtgcagtctcagctcactgcaacctccgcttcccaggttcaagcaattctcctggatcagcctcctgagtagctgagactataggtgcacaacaccaaacatagctaattcttgtatttttagtagagacaggggtttcaccatgttggccaggctggtctcgaactcctgatgtcaggtgatccacccacctcagcctcccaaagtgccaggattacaggagtgagccactcacccggcctgctattactattatttttaattctttatttaattttttttttcttacagacagtgtctcactctgtggcccaggctggagttcagtggtgcaatcatagcttactgcagtcttaaactcctgggctcaagcgatcctcccacttcaccttcctaagtagctggcactacaggctcatgccaccagacctagctaatgttttttattttattttattttttttttgagacaagagtctcgctctgttgcccaggctggagtgcagtggtgcaatcttggctcactgcaacctccaccttccaggttcaagtggttctcctgcttcagcctcttgagtagctgggactataggcgtgtgccaccatgcccagctgatttttttgtatttttagtagagatgggatttcactgtgttagccaggatggtcttgatctcctgacctcgtgatccgcccacctcggcctcccaaagtgctgggattacaggtgtgagccaccgcacccagcccttttaaatttttttgtagagaaatgaccttggtatgttgcctcagatggtcttcaactcctggactcaagcgatcctcccacctcagcctcctaaagtgctggggttatgagtgtgagataccacaatggcctatttttgattctttatattaataactgaagagacccaaaagaatttttatcaatgtgtatgatataaaaaataataaaatgaacaatccaccacccagctctaagagtgtgtctctcatccctcattttgcttaaaaatttgtccaggcattgtggctcacgactgtaatcccagcactttgggaggccgaggcagctggatcacttgagcccaggagtttgagaccaacctgtgcaacatggcacaaccctatctctatgaaaaatacaaaaaaaaattagccaggcatggtggcacatgcctgtggtaccagctactcataaggctgtggcaggagatcacctgagccaggggaatcaaggctgcagtgagctgtgattgtgccactgcactccagcctgggcaacagagactctgtctcaaaggaaaaaaaaattatgatatatttcccttctcaacaacagattgtttagtgtgtcagatttttgaactttatacaagttgaatcatacatacatattaccctgtgacttgctttttcttgcatattaagtttctgagcgtcatgtcgctttgtctatctgtagatcattttcactgccaggaagtattctattgtgtgaaaatactgcagttcatttccacactcaattgttcatgagttcatgaacaatttttttggtcttcccctccccaatcgatgtttgctattatagtaggcccccctcgagcatcatgtgcctggaatttaaaaaaaaaaaaaaaaagaaagaaagaaagaaaaagaaacaaaaaatacagtagtcccaccatacctttgaaggttacgttctaagacccctactacacacatgaaaccacagatagtactgaactctatatattactatgtttttttccaatacgtacctatgacaaagtttataaattaagcacagtaagagattaacaataactaacaataaaaatagaggctggacacagtggctcacacctgtaatcccagcactttgggaggccgaggccagcggatccatgaggtcaggagatcaagaccatcctggctaacacagtgaaaccctgtctctactaaaaacacacaaaaaaattagccgggtatggtgatgggcgcctgtagtcccagctactcgggaggctgaagcaggagaatggcgtgaacccaggaggcagagcttgcagcgagccgagatcgcgccactgcactccagcctgagctacagagtgagactgtctcaaaaaaaaaaaagaacaattataacaatatgctataataaaagtgatgccaatatgatctctccctcaaaatatcttatttgtactgcattcacccttcctgtgatgatgtgagatgataaaatgcctacatgattaggtgaatgacacaggcattgtgactagcgtcaggctactattgaccttctgatgatatgtcaaaagaaggaccatctgcttcaggtgatcctggatcattgagccataatgatgttgatggttgtgtgtcaggaggaaaccaaattgatgactaccaaccaggtcaacagtgtagatctcaaggatgcactggacaaagagatggaatgtcctgagtgggacagagaaggacaacctgagatttcatcacactactcagaacgccaagcaatttaaaacttacaagttgtcctcagcaaatgcaaaagaactgaaatcataaaagtctctcagaccacagtgcaattaaattagaactcagggattaataaattcattcaaaaccacacaactacatggaaactgaacagcctgctcctgaatgactcctgggtaaataatgaaattaaggcagaaatcaagaagttctttgaaaccaatgaaaacaaagagacaatgtaccagaatctctgggacacagctaaagcagtattaagagggaaatttatagcactaaatacccacatcagaaagctagaaagctctcaaattgacaccctaacatcacaattaaaagaactagagaagcaagagaaaacaaatccaaaagctggcagaagacaagaagtaactaagatcagagcagaactgaaggagatggagacatgaaaaacccttcaaaaaaaaaatcaatgaatccaggagctgatttttttttaaaactaacaaaatagatagaccactagctagagtaacaaagaagaagggagagaagaatcaaatagacacagtaaaaaatgataaaggggatatcaccactgaccccacagagatacaaactaccatcagagaatactataaacacctttacacaaacaaactagaaaatctagaagaaatggataaattcctggacacgtacaccctcccaagactaaaccaggaagaagttgaatccctgaattgaccaataacaagttcttaaagtgttattggtttaagttttttaaacccaggaccagatggattcacaggtgaattctaccagaggtacaaaaaagagctggtacattccttctgaagcattccaaacaattgaagaggagggactcgttcctaactcattttatgaggccagcatcatcctgataccaaaacctggcagagatacaacaagaacaaaaacttcaggccaatattcctgatgaacattgatgtgaaaatcctcaataaaatactggcaaactgaatccagcagcacatcaaaaagcttatccactatgatcaagtccacttcatctctgtgatgcaaggctggttcagcatatacaaattaataaacctaatccatcacataaacagaaccaatgaccaaaaccacatgatcatctcaatagtgcagaaaaggtctttgataaaatttaacatcccttcatgtaaaagctctcaataaactaggtattgatggaacagatctcaaaaaaataagagctatttatgacaaacccatagccaatatcatactgaatgggcaaaagctggaagcattctctttgaaaaccagcacaagacaaggatgccctctctcaccactcctatgcaacatagtattggaagttttggccagggcaatcaggcaagagaaagaaataaggggtgttcaaatgggaagagaggaagtcaaattgtctttgtttgcagacaaaatgattctatatttagaaaaccccatcatctcagcccaaaaactccttaaactgataagcaacttcagcaaagtctcaggatacaaaatcaatgtgcagaaatcacatactttcctttacaccaacaataggcaagtagagagccaaatcataatgaactcccattcacaaattgctacaaagagaataaaatacctaggaatgcagctaacaagggatgtgaaggacctcttcaaggagaactacaaaccactgctcaaggaaataagagaagacgcaaacaaataaaaaaaattccatcttcatggataggaagaatcaatattgtgaaaatggccatactgaccaaagtaacttatagattcaatgctattcccattaaactaccatagacattcttcaaagaattataaaaaactactttaaatttcatacggaaccaaaaaagagcccatatatccaagacaattgtaagcaaaaagaacaaagctggaggcatcacgctacctgacttcaaactatactaccagactacagtaaccaaaaaagcatggtaccaaaacagatatatagaccaaaggaacagaacagagacctcagaaataacaccacacatctacagccatctgctctttgacaagcctgacaaaaacaagcaatggggaaaggattccctatttaataagtggtgctgggaaaactggctagccatgtgcaggaaactgaaactagaccccttccttataccttatacaaaaaataactcaagatagattaaagacttaaatgtaaaactgaaaatcataaaaaccctagaagaaaacctaggcaataccattcaggacataggtatgaacaaagatttcatgatgaaaatgccaaaagcaatttcaacaaaagcccaaattgacaaatgggatctaattaaactaaagaacttctgcacaacaaaagaaactatcatcagagtgaacaggcaacctacagtatgggagaaaatttttgcaatctacccatccgacaaaggtctaatatccagaatctacaaggaacttaaacaaatgtacaagaaaaaaacaaccccatcaaaaagggcaaagaatatgaacagccactcctctaaagaagacatctaggccgggcgcggtggctcacacctgtaatcccagcactttgggaggccgaggcgggcggatcacgaggtcaggagatcgagaccatcccagctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaagacatctatgtggccaacaaacatatgaaaaaaagctcaacatcactgatcattagagaaatgcaaatcaaaaccataagataccatcacacaccaatcagaatggcgattattaaaaagccaagaaacaacagatgctggtgaggctgtggaaaaataggaacacttttatactgttgggggaaatgtaaattagttcaaacattgtggaagacggggtggcaatttctcaaggatctagaatcagaaataccatttgacccagcaatctcattactggatacatagccaaaggaatataaatcactctactataaagacacacgtacacgtatgtttagtgcagcattgtttacagtagcaaagacatggaaccaacaaaaatgctcaatgataaactggataaagaaaatgtggtacatatacaccatggaatactacacagccataaaaaggaatgagaacatgtcctttgcagggacatagatgaagctggaagccctcatcctcagcaaattaacacagaaacagaaaaccaaacactgcatgttctcactcagtaggagctgaataatgaaaacacatggacacagggaggggaacaacacacactggggcctgtcggagggtgggaggcgaagggagggagaacatcaggacaaacagttaatgcatgcatgttggacttaaaacctagatgacgggttgataagtgtagcaaaccaccatggtacatgtatacctatctagcaaacctacatgttctgcacatgtatcccggaacttaaagtaaaataaataaataaaaaagaaacatatatttaaaaaaaaaacacccttatgagttgttaatttctggaattttccatttaatattttcagactgcagttgactgcagggaattaaaaccatgaaaccttggataaggagggactactgtacaagcaggttgctaagatcagtctagtgtacatttcctgataggtgtgtatgagagtttctctagggtgcacacctaggaatggaattgctaagccatagtgtatgtatcttcagtttgttaggtttctattatctattactgtataaaacaacccttcccaaaacttggggtctcacagtgaatcataatagggtggtagtgggctcacacctataatcccagcacttgggaggccaaggtgggaagatcacatgagcacggagtttgagaccagtctaggtaacaaagcgagaccttgtctctacccaaaaaaaagcagggcatggtggcaagtgcctgtagacccagctgctcaggaggctgaggtaggaggatcacttgagcctaggaggtcaaggctgcagtgagctatgatcatgtcacttgcactccaggctgagtggcagagagaccctatctctaaaatgaaaaaaaaaaaaaaaagttttaaaactgtggtaatggttgcacaacttttaaaacgtactaaagatcacccaagtgtacacttatatggttgaattctatggtatgtaagttataacataaagttattttttaaaaattacatagcttaaaaaacaataaaagtcatttattttgctcaagggtctggtatttgggcagagattagcaggtatgtttcatctgctcccaggatgaactgtcaattggaggatccaacttccaggatcctcacatgactacaagttggtactggctggcaagggagcctctctctgggactgtgtgggcttcctgacagcatggtggctaggctccaagaacaagtgttccaagagacctaaacagacagaaactgcaggcttcttctgacctagcatttgatgtcccagagtgttacttctgctgcatttttttttttttttttctgagacggagtcttgctccatcacccggtctggagtgcagtggtgtgatctcagctcaccgcagcctccgcctcccgggttcaagcgattatcctgcctcagcctcccaagtatctgggactacaggcatgtgccacaacacccggacaatttttttatgtttagtagagacggggtttcaccatgttggccaggctggtctcgaactcctgacctcgtgatccacctgcctcagcctcccaaagtgctgggattacaagcatgagccactgcacccggctacttctgctgcattctattggccaagaagtccctaagaccagcccacatttaaggagaagggactcaacctctcaatgggaacagcatcagaaaatgtggccatcttcaatgtatcatactgttgtacctgagcgagttagagagaacgccacactttgagacaaattaagagtcctttattagccttagccggcgaccgagagacggctaacgctcaaaattctctcggccccgaggaaggggcttgattaacttttataccttggtttaggaagatgaggggggggtctacttagaacaattttccagaagttaagtagtcaaaaagttaaaaggataaatggttataggaacgtaaacagttccaggtgcaggggctttaagactattacaaggtgatagactaggggctttgggcgttgtcaatcagatgaattcttggggactgtggatatagcttgccacagtatcttatcagttaattgcattcttggatgtgctgggagtcagcttgcacaagttaagtccttgaggaaggggctgccagtgaaagagccaaaatggagtttgtctggttctcttagctaagggagaaacaaggctaggtgaataaaggaagaaacaaggttgggcattacattacaaggtaattccaaatggttttccaagtggtagtaccaatgacattcccactcgcaagacatgctctttgacctcaccaacacatgatagacttaaatttttgctgttcaagtattgggggaaattcagcccccgatatttcacgtgggttattttctattttccctaagtgcccgccagtctgagaaataaaggggaagagtacaaaagagagaaaatttaaagctgggtgtctgggggagacatcacatgtcggcaggttccgtgatgccccctgagccataaaaccagcaagtttttattagcaattttcaaaggggagggagtgcacgaatagggtgtgggtcacagagatcacatgcttcaagggcaacaaaagatcacaaggcaaaaggtcagggtgaaaccagaatcactaatgaacttccatgtcctgctgtgcacgcattgtcaaggttcaagaacagagaaccggtctgactagaatttgccaggctggaatttcctaatcctagcaagcctgggggcgctgcaggagactagggcgcatttcatccctatctacatctgcataaggcagatactcccagggtggccattttagaggcccggccctgggaatgcattcttttcccagggctgttaattattaatattccttactgaggaaagaattcagcgatatttctcttacccatttttggtaataagagaaatatggctctgtcccgcacggcccacaggcagccagactttaaggttatctaacccttgttccctgaaaatcgcttttatcctgttcttaaggtgcccagatttcatattgttcaaacacacatgctctacaaacaatttgtgcagttaacgcaatcatcacagggtcctgaggcgacatacatcctagcttacaaagatgacgggattaagagattaaagacaggcataggaaatcacaagagtattgactggggaagtgataaatgtccattaaatcttcacaatttatgttcagagactgcagtaaagacaggcataagaaattataaaagtattaatttggggaactaataaatgtccatgaaatcttcacaatttatgttcttctgccatggcttcagccagtccctcagtttggggttcctgacttccacaacacaagtgagtataaaagtgttgtggacttattttgtatttcctaatttctaagaaatttgagcaccttttcaaatgtttattggttgttcatatctcatctgtgaaatgtttgctcaagttttttattcactgtattatagagtgctctttttcttatttatttgtaggaaatctttctatattctcaatactagttgtcttagtttgttttctgatgctataacaataccacagattgactaatgtataaacactagaagttttttaggcttatagttctgaaggctgtgaagtccaaaagcatggcacaggatctggcacatgagggccttcatgctgtctcatcccatggtggaaggtgcaagaacaagaacagatgggagctgaacttcacccttatatcacaaacccactcccatgataactaacccactcccccagtaatgtcattaatacatttatgaggacagatcactcattaactaattgcctcttaaaggttccacctcttaatactaccacaatgcaattaaatttcaacgtgaaggccaggtgtggtggctcatgcctgcaatcccagcactctgggagaacaaggcagaaggactgcttgaggccaggagttcaagactagcctgggcaacacagtgagactccatcactacagaaaataaaaaattagccaggcatggtggcacatggctttggtcccagctactcaggaggttgagccaggaggatcacttgaacccagaagttcaaggttttagtgagctttgattgcaccactgcactccagcctgggcaacacagcaagactctgactctaatactactactactaataataataaaacaaaaataaataatttccccaagtgttttgcagaggactttcaaaccacagcactagtccattgtcagttatgtggatgcagatatcttctttcagtttgcgggttggccttctgctttctttacaatatctttggatgaaaagatatacatgtgagtctttttcttccagacaaggtctcactctgacattcaggctggagtagcgtggtgtgatcatgactcactgtagcctcaacctcctgggctcaagtgatcctcccacctcagcctcctgattagctgggactacaggcatgtcccaccatgcccagctaagttttctgagtttttgtagagacaaggttttgccacactgcccaggctggtctcctcctcctgggctcaagtgatcctcctgccttggcctcccaaaatgctgagattacaggcgtgagctaccacaagtagcctgggtccttttcaagatatttcctcccattcctttggtcaatttgactatctctgcattaaagccattctgtctttgttgttgctttataattcaataatttataattttataatgggggagagtttctacaaaatcatatcatctgtgctggtcagaatagcatatctcattgtggaaaaggcaagaataggtcacgtcccagttttataaataaggaaataaggtcaaactcaggactcctgacttttaattgagttttcacttcatctccctaaaaacttcctatcactacataaattaaaagtgttgtttgaggaaaatgaggggctggctttgctgcatgtattcaatcatttctgctcaacaaatattaattccttctttttagcagttatcagatacacaggcatgtagacactctttgtaaagtgctaggtatgtgtaagctattactattattatcattgtggtacaagagatatatgtggggccaggcgcagtggctcacgcctgtaatcccaacactttgggaggccaaggtgggcgggtcacgaggtcaggagatcgagaccatcctaacacggtgaaaccccgtctctactaaaaatccaaaaaattagcggggcatggtggcatgtgcctgtagtcccagctactcaggaggctgagtcaggagaatcgtttgaacccaggaggcagaggttgcagtgagccgagctcacaccattgcactccagcctgggctacacaatgagactctgtccaaaaaaaacaaaagaaaagaaagagatatatctggatcctagcactttgggtgggtggatcacttgaggtcagaagttcgagaccaggctggccaacatgacagaaccctgtctcttctaaaaatacaaaaattagccaggcgtagtagcgggtgcctgtaatctcagctacttgggaggctgagacaggaagaatcacttgaacccaagaggcagaggttgcactgagctgagatcgtactactgcactccagtctgggtgacagagcaagactctatctcaagaaaaaaaaaatcggcaaaagacatgaacagacacttctcaaaagaagacacacatgtggccaacaagcatatgaaaaaatgctctagatcactaatcattagagaaatgcaaatcaaaacaatgagataacatctcacactagtcagatggctaatcctaaaaagtcagaaaataaccaatgttagtgaggttgcaaagaaaagggaatgcttatacgctgttggtgggaatgtaaactagtttggccactgtggaaagcagtttggagatttctaaaagaacttaaaaaaaactaccattcaatttagcaatcccattaatgggtatatacccaaaggaatataaatcattctaccaaaaacacacatgcacatatatgtccactgcagcactgttcacaatagcaaagacatggaatcaacctagatgcccatcagtggtagactggataaagaaaacgtggtccatatacaccatggcatactatgcagccaaaaaaagaatgaaatcatgttctttgcagcaacatggacagagctggaggccattatcctaagcaaattaacacaggaacaaaaaaccaaataccacgtgttctgttttttgttttcttttttttttgagacagggtcttactctgtcacccaggctggagtgcagtgatgagatctgggctcactgcaacctccatctcccaggttcaagcgattctcctgactcagcctcttgagtagctgggattacaggcatgcgccaccacacccagctaatttttgttttagtagagacggggtttcaccatgttggtctggctggtctcgaactcctgacctcgtaatccacctgcctcggcctcccaaagtgctgggactacaggcgtgagccaccaccatggccaccacacgttcttatttatctcactttataaatgaagtccccatggacacagaggggaataacagacaccgggcctacttgagggtggaggctgggaggagagtgagcatcaacaaacttcgtatcaggtagtatgctcactaccccggtaacgaaaccatttgtacatcaaaccccagtgacacgcactttacccatgttacaaacctgcgcatgtacctcctgagctgaaaataaaagttgaaaaacaaaaaaaaaaagaaaaaagaaagctctctttggggaaaaactcacaaatctgccccctccggtgatggctgaccgatataattcaaacagcttcccgccatctttaaggaagcaaatggctttcccattccccttctttctcgtagtgctgcccttctcctggccccaggctgctggagaaaccgaggaaagcagacagggtcctaccttccagaagccttaggaacaccacggccatgggcgtgggaaggatacccttgggattctcgcgaaacattctcgtgaagggcaaagtcgagtgagaccaggatgggagctccaggtagagggacaacagagaggaaggaacagagggtgaaatccctgtgccaggaggcttcctgcagggggaggtgtgaggggctagtggaggtgaggaggagctgtgtggccaggacgctgtaggtgcctggtgagcagtggaggcagtgaagggctgtcaccaggagagcgacataggagatgtgctgttttgtttatttatttatttatttatttttgagacagagctttgctctgtcgcccaggctggagtgcagaggggcgatctctgctcactgcaacctccgcctcccaggttcaagtgattcttgtgcctcagcctcccaagtagctgggattacaggcacgcgacaccatgcctggccaatttttttttttttttttttttttttttgtatttttagtagagacagggtttcaccatgtttgtcaggctggtctcaaactcctgacctcaggtgatccgcccaccttggcctcccaaagtggtgggattacaggcatgagccaccatgcctggcctcgagatgtgctgttttagaaagatctgtcctcacagacgtgtggaagaagctaggaatgaggaagagaagaaatgaggagaaacaggcctgactcctccctggtgaacctcctcccttggcctcccaggccctcactccttccgttcccctcatttactaggagaggaattctgtgtccagagcaccccaaaacctgaaggcagaatgcagtcctggattgttgtggatcttggctgcatttaaaaagagaccttgctgagcctatgtcctgaataaaataaaggaaatgggctcctggtttccaaatatttctttagatgggagactctttgatcaaacgaagtcctgccctgataaaatgaggagtatggcagcaagggggcactcccccagcacgtggcggtccaggctccctcattgagggctctgtgactcagggtttctagcactgtagctggctctcctgcttcaaccgagttcttttatgagtgtatctgaatattaaactaacacttgtttcattgctttgaacaaggtgtgcttttgagaagcatggtcaatacagcaggattgaatgtttttatgcccctgtagcttaataaggagatcataattcatttaaaatggattgactcccatcctaagcctgaccagcattccattcttatattaaagaaataatccaaaaggaaaaagaaaagttataagcatgaagttctctgtcacagcattttacataatagtgaaaactgggaaccaacagagaactgagttacacactgaagcataatactaagtgtgatactcagtgtgatgttggacaactaataaaacaagcaatgtgaggctgggtgcaggggctcacacctgtaattccagcactttgggaggccgaggtgggtggatctacctgaggtcaggagtttgagaacagcctggccaacatggtgaaaccctgtctctcctaaaaacataaaaattagccaggcgtggttgtggccgcctgtaatcccagctactcaggaggctgaggcaggagaattgcttgaaccagagaggcagaggttgcagtgagcttagatggcaccactgcactccagcctgggggacagagtgagactatctcgctcacacctgtaatctcagcactctggggggccatggcaggtgaatcactggagcccaggagtttgagaccagcctgagactccatctctattcaaaaaaaaaaaaaaaaaaaaggccgatgtggtggctggccgggtgtggtggctcacgcctgtaatcccagcactttgggaggccgagtcaggtggatcacctaaggtcaggagttcgagaccagcctgaccaacatggtgaaaccccaactctactagatacaaaaagttaactgggcgtggtggcgcatgcctgtaatcccagctagaggcaggagaatcgcttgaaccaggaggtggaggttgcagtgagccaagattgcagtattgcaccccagcctgggcagcaagagcgaaacagtctcaataaataaataaataaataaataaataaataaataaaaattaaaaacaaaccaatcattgtgaacgctgggggaaggtggaaaagaggaaaatgcagaatacaaaattaggcaaagggacgaggcacccaggagaataggagtcgaactcgcttccatcttcatttcttctctcttcttcctgtattttttctccattttttccacaagaactgtgagaacacgggaaatgagttgatttattagggtgatttactacagtgattttcttctgcttttaagttgttactctttgggagggcgggagcttagaatccaagtgcaataaaaggtagagaagatgctgtgtgtgggtaaaagcagcgcggagcttcctgggccatctcagctagaccagtgcctttttttttcccactgggccctgaatatatctccatcaccttcctgaatgcactggggtaaccatctggttttgtaacaagctgagaggagcctggcatgtagtgggcactcgatgaatatggtgagaataacaaagcattcctttgcaatgcagggctcagttgttatggctttcaaagaaggcaatgtaactgacatactgagatcattaaacagcacaggaactaagaaggcaaaagaaagcagtgctttcaactattcctgttttacagagtacttgttgaaactgtaaaaagatatttagaaccacaaaaactaggccaagggtaagaaaaactcttcatacccaagagaattcagctgaccaaattaagtctgatccagaataaacagcactcatctggaaatctagcagttccagaaagtactgtccaaggggaaaaagacccacaacgttgatctgcataattatataaccctttaacaaagagacaagaagcgctatcgtgctggagtgcatggggaaaatcaaatgtgagcatgagcaaagctgggctcacttgagaaaataacaggtctcagccctcaaagaagaggactttgttactgaagagaatctgggctcatgtgccctttctcatgaacttgaccaacctcagtgtgttttctctgtgttcacccaacatccaaaaccaaaaacaaggtttctattatcaactccctccagcagaaattacttacaaatagtcatgtgaggagcattgcacatgaaggaacacattggaaactaaactgaagcttggctattacaaacaggtcaagactattcatgttggtattttaccaagaaaagcataatcactatccccttaaaagccaattaaaacatcaaataaaaacgaaatctggccaggtgtggtggctcatgcctgtaatcccagcactttggtaggcctagacgggcggatcacctgaggtcaggagttcaagaccagcctggccaacatggcgaaaccccgtctctactaaaatataaaaattagctggctgtagtggcgtgcgcctgtagtcccaggtactcgggaggctgaggcagaaaaattgtttgaacccgggaggcagaggttgcagtgagccgagatcatgccactgtactccagcctgggtgacacagcaagactgtctcaaaaaacaaacaaacaaaaaacccctaaatgctagatgggaagaggaacttaaaacataactttctttctccaacatatgtaaaaatccaggcttgaaattgaaagcgggggcttgaagagagatctgtacacccacgttcacagaagcattttccatagaagccaaaggatggaaataacctaagcagccattgacaaatgaatggataaacacgatgtggtgtatccatatgagagggaaattctgacccatgctacaacatcaatgaagcttgaagacgtatttcatgaaataagcaagtcacaaaaagacaaacactattatatctgattctgatgtagagcaggtgagccccaaaattggggcttgccccaggactaaggttcttggctttgcccaagagagaattcaagggtgagctggcggtgtcagcaacttttattgaagtggcagtgcacagcagcagtagcagaggcactgctccttgtggggcggggctacccccataggctgtgtgcccagagtaacagctcagaggcaggtctgcagtcatattcatacccacttttaattatacgcaaattaaggggcagattatgcagaaatttctagaaatagattaacttctgggtcattggctcatgccatggaaatgggtggtaacttccaggtgttttcatggcaatggtaagctgacaatgggtctgtcttatggaaaggtgctttcgcctcttccctgtttcagctagtcttcaatctggtctggagcatgagccctgtctctggagtcgagtcctgcctcctacctcaattccactcctatgtggcaaccagagtagtcaaattctcagagacagaaaatagaatgctggttaccaggaggtagagggagccagaatgggaagttagtgtttaatgggtacagaatttccagctgggaagataaaaaagttctggaaatggatcgtggtgatggttacacaacactgtggaggtactaatatcaacaaatcgtacgctttaaaatggttaagattgtaaattttatgttatgtgtattttaccacaattttttcttttttgagacaaggtctcactctgttgcctaggctgaagtgcagcagtgtgatcatggctcactgcagccttgacctctggggctcaagcagtcctcttgcctcagcctccccagtagatgggaccacaggccggcacctccatactttttttttttttttttttggagagatgaggtgtcactgtgttgcccaggctggtcttgaactcctgggttcaaatgatcctcccacctcagcctcccaaagtgctaagattataggcaccagccattgtgcccggcctaccacaattttttcttaaaaaattcaggtttgattccacagagcctttgtttaacaatgggaaaggttctaattttatgtcttctacttttcctgtggatattatatgttattctctacatgtgttaatttctggtaaaaaaatgactctgttacattctgcttacaacagagaaatgtcttctacttttcctgggatattatatgttattctctgtatgtgttaatttctggtaaaaaaatgactctgttacattctgtttaaaaaagagaaatataggccaggcgcggtggctcatgcctgtaatcccagcactttgggaggccgaggcgggcagaaaacgaggtcaagagatcgagaccatcctggctaacacggtgaaaccccgtctctactaaaaacacaaaaaaattagctgggtgtggtggcagatgcctgtagtcccagctactcaggaggctgaggcaggagaatggtgtgaacccgggaggcggagcttgcagtgagccaagatcgcgccactgcactccagcctgggcaacagagtgagactccgtctcaaaaaaaaaaagagagaaatatatattactcaatacataggagtccacccaaaaaattataaagaggttgttctttccgtacccccctctgtgaacctcttgtaacacctcatgacaataatgagagtagttatgcaggtcaaattccttaccgataatgctccatcttctaaccatcagtgaaaattaatctttttgtttcattcactcatccaataataagttattactaacatatattgaacaattactatactatgtgccaggaaatgtgctaaccactgggcacagtggtgtaagcctgtagtcccagctattcaaaaggcctccaaggcaggagggctgcttgaggtcaggagttcaaagccagcctgggcaacatagcaagaccttgtctcaaaaaaaaaaaaaaataggatcatacctaacatacataattcatcacactcaaatggccatagagctttagagctgggaaatacaattagcgatcttcaaattcagatgccctcattattgtttaccttcttctattatgaaaaatttcaaatatattcaatagtagtcaaagagcataataaacttctttttatactacagtaaaccactcagtgtcaataattatcaatgtatggccgatcttgtttcatatttacccacacttattttcttccatctcatataactttttttgctgtattttttttaactttttatttggaaataatttcaaatttacaaataagttgcaaagatggaaataataaaaagaacacccattaccatttacccagattcacctgttaacatttgtactgcttatttgtacacgctatctccccctgcacaaacacacactcacacacactttttttctgaactatttgaggctacattataaacatcatcatcttttactcctaaatacttaatgtgtatttcccaagaaaatgacattctcttatgtaccatggtacagttatcaaattcagtaaatgtaaactaattcaatcattttattttctctaccatttgtattccaattttgtgacttgacccaataattttttttttctatagagatggggttttgccatgttgcccaggctggtcttgaactcttggactcaagcaatccatccaccttggcctctcaaagtgctgggatcacagatgggagccactgtgcccgaccccaataatgttcttgacagtatttcttttccctccattagaggatccagttttaggtcaggtattgcattcaattgtcagattttattatttttttatttattttatttatttttattttattttattttatttttgagacagagtctcactctgttgcccaggctggagtgcagtggcgtgatcttggctcactgcaacctccacctcccaggtcaagcaattcttctgcctcagcctcccaagtagctgggattacaggtgcgtgccaccatgcccagctaatttttgtatttttttgtagagacagggtttcgccatgttggccaggctggtcttgaactcctgactttaggtggtccaccagcctcggcctccaaaagtgctagaattacaggcatgagccactgcacccagcctgtcagtctcttttaattaagaaaatttcggcctggcacagtggctcatgcctgtaatcccagcactttgggaggccgagacgggcagataacgaggtcaggagatcaagaccatcctggctaacatggtgaaaccccgtctctactaaaaacacaaaaaaattagctgggtgtggtggcgggtgcctgtagtcccagctactcaggaggctgagggaggagaatggcgtgaacccgggaggcggaggttgcagtgagccgagattgcaccactgcactccagcctgggcgacacagtgagactctgtctcaaaaaacaaaaacaaaaacaaaaacaaaaaaaaaaaaaaagaaaatttccagaacctttgtcctttatgacatagactttttggaaaaataaattcctctttcttcttttaagatgttccttgtgtggaggctgtctgctgtttccttatgattagattcaagatgtgcacatcttgacaaggtgactctagtcagtatactgactaggtgatattgtgtccttttcagggtatcacatctggaggcatatgatggccagtgtcaatactgatcaccagttaaggttgttgcctgattcatccctgtacaattactgtttttttccttcttagagataattaacagtctgtgggacaacactttgagatcaagaaatatcctgcttatcatcaaaatttcccctagattcagcatctgtaattagttacccactgctattatgccaaatcttagtagcctaaaacaacagatacttatgaactcagacagttcctatgggtcaggaatttggcagtggcttggctgggtggttctggctcagggtctctaatgaggttgcatttaagcgccagccagaagctgcagtcatctgaaggcttgcccagggctggagaatctacttccaagatgattcattcacatgcctggcaagttagtgctagaactgagaaggcctcagttccttatcacatggaactttccatagggctacttgactgtcatcatgacatgacagctggcttctcctagagaaagagatctcagagagaaagcaaggagaaagcagtgcctcctgtgacctactcttggaagtcatacactgtcatttccaccatattcattctatttgcccacttgattcaaggggaaaattaagcattaacttttttttttttttttgagacacagtctcactctgtcgcccagaaaataactagaaattgctttaaaaattattttgattagaaattaaatatcataaaacttaacctttaaaaaaatcacaaatagacaatttgtaagatacattaaaaagtactatatacttctaagaaaaatttagctttaaaagcattgatcagaaaataagagaggtgaaaacaacagagctaagcatttcccttgggtatcagaagagaggaaacaaaaagaagtgagaataaggacaggaattggtgacaaagagaaacacaataaaaccaaagaggactaaaaaaaggtataactttaaaaatattaaaacaatagacctctagagcaagtctaatgaaggaaataaaagatgcaaacaaaaagcaaatgaaaaagggagaaataactatggactcaacataattaaaataagaagagtaggctacacaatttgctaataaattgtaaaacctaggtaaaatggatacatttctggaaaatcataaaacaccaaaactggcacaaaaagaaatagaaaacttgaatagaacaaaaagcattcaaatatctgaaatagaaatcaagtattttccctcccaaaaagccctagaatgagatggttaacatggatgagttattaaacttttaaaaaaatcttttccaagttgccaggaagtaggaaaaataaaaaaaaaaagaacaccaaaaacaaacagacacaacagctcttaataggagaccaatattaattccaaatccaaataaggagacgtcaaccaaagaacaaaagatcacttcgcaaatacgcatatacacaaaaattccagtaagaattttaactgactaaattcaaaaggcattatccatttgatgacatatataaaatgggcaaaattcctctaaggacataaactaccaaagttcactccagatgaactggagagcttcctaatgaaattgaatttgtaataaaaaacctacccacaaagaaagctccaggccgtgagggcttcactgccaaattctaccaaacacttaaggaagagataataccaattctacacaaaaatctctctgaaaacaggagacagaacacttgcaaataattttaggagatgacattaccctgaaaccaaaaccagacaaaatcattacgagaaaagaaaactacaacaaatattcctcatgaataatagacgaaaatccttaaaaatattagccaaccaaatacagcaatatagaaaagaaatactacatttgagcaggtgaggtttatcccaggatacaagctagatcaacactcatatatcaaaaaatgtgtcgacttccaaatatggccgagttaagaaactggtatctcccattctccaaaacaactttaaagttggacaaaattatttaaaaaaacactcatatagggttctagaaattaaccaaaaggaagcaacaacgtgggaagcattgattcataaaaaactgagaaactctgggtaaaaacagtgggagtctgtggcatttttacctagtttgctcccatccacctcggcaccacccccatctcccccatactgttagtgaaatagttcttttgaagggggcaggatggagtatgactagtcataaaaataacctttactactggagcaggctgacctgatttggggcagacagctaaaaacctacactcagaggcactatcagtaaaagtagagaactcagtaggaaatgaaaggctgggtagccttgccactctcttcctttaaccaatgtcaaaattaagaatttatgagccaatgcccttgatcaaagttacgtatttctaaaaatactaaagttacaactaagttatttctaatttgcaaataacatagcttatagcattttttggccctggcataattttaggctatgacagaaaatgacaataatcgctttaacctgaattaataccttaactggttcatgttccccagtgaataaaacagattccataaatgcaggactagggttatttcacttgtcttcctgctcgcactctgcatactggctgactcacccacctttcagctctcatcctcagagctgacttccaggatccttccctgatgctcctcctgtgtattcctgcagcactctgtacttcattttttatcatagcctttattacactgtattataactgctaagaattgtttctattttccgaattttccgctagaccataccttaatcagttttctatctctaggatactttctactatcagacacacaggacgtactgaatgaatgaatgaatgaatacattttcaactatagttttaaagttttaaaaatctttccacagattgtagaccacccatttaatggtccatgtgttttcaatcttttaagcaaaaacaacccttgttcttattaaaacctatatgaaagagattaaggttaaactgccctgggtaaaagagaggctaggagacaggggagtagacagccctcagggaagagtcctgggaagtcgtaggacttcacataacccagtttcaaaaccatagcattaatctagtacagaaagaagaaaatcaccaataaaaataaattataggaaaaaaggtagtttattttttccatgttggttcttgtgctgcttttttaaattaaatctttgatagcctcctgacttaggatgtgctgattaaaacaccaaaataaaataggcaaagcaattatggacagggagaatccttaaaattataagacagacttctccattttatcttcccttctactctaataccaaaaacaaaaatcttctttaaataagactaacttagattaaataatctataaaggcttataaaagccttttacaagtaatgacttgaaaactggggagaaaaaagaatgagactataatacgatctccagttaaggctctaaagatggtgtctttaccagttacaaagaagctagagaaaaacgactgtatagaccttaaaattcgatctttaatctctagagttttcctgctttaaaattttaaaattttagtgatatagaaggaccaataaaataagagattgttttaagaaactaattttggagaacaaaaatctatatacaattacatttactttctattatattaaatacataaaataataggtgaacagacttcatcctagaatttcatttaatagtgatacttgaataactcaatttattcttagcttattagattcttttcaagtctttcaagtttaagcaaaaaatgcacttacgtcatctgcaataccaaaaattttagatgtcaagtatttaagtatgacagttccaaataaccaaaaacatccttgaataacctaaaaaaagaaaacaaaaataactttgatgcttcatattccacagacataggctaggaagaaaaaaataaatgctttaatcatacatgaaatacatattactatctacaagagaaaatgctagaaaatgcatctcaatttaaaatcaagcatgttgctcaaaatcaagggacagtaactaaaaataaaaatataatcatacaatcttatcaaaattaatatattttatagaagatttacacaaccactgcagttaaattccctttaacagtttcttatacatgcactgtttctcagatgaaacatgagtaataaataaaactggaatttttaaactacatacccaggattaactttaacttgtttcataaaaagggcaatttggtacattaaaactgagccctaaaatactataaaactgttggatcccctgagttacatagatcattttcttaaaagtaaaacataaaaccaatgatatattttagagaagaaaaaacataagcattaaaatagattgattctcacccataaactaagttcagatacatttattttcaggaaatgtggtttcattgccagaataccctgagtagagaaaaataacatagtatacacagttaatacttacagacataaattcaagtaccaaaaaattcttctaaatgataagattctcaagtatctaaaattgagcaaacagtcaactttccacataccatccacatgctcatgtctatagtcagtgacttcaaggtatagccctattatccaaagtcaattaggtgaaagcgtgactttttaaagttgaaaaaggaatcaccatatgtaaatgtctatcactgatttgacatatctgatttatctctgagccatgaggtatataacattttcagaattgcatacaggcataagattttcctttagctaaaaattactgactcttagggtaaacaacaaatgaaatgttaatggatcaactaaatacttctcttgtcaaatcttaagtattttcaggtagtaacgctcccaaactgtattacccttggggagctaaaactacttcaaacatcgcaaaaatatgattagagatcacaacataaatacttgaaaccaaattaaatctttttggaagtttctgaataactgagaatacaaaatgtgatacaattcaggtttcaaagtgattaattataaatatatgcaaatatgtttatagttaaatatgcacaaacatgctgtactccctgttatcatttatttttatacaccaaaatatatggaatatacataaatatgcttaattcatatctaagacgcacctcagtgtgaagcatctggcagcatacctgacatacagaactgaagagaaatttcctacaaaaggcacttaaattagattttatttatatgtaatatttgattcagtggtttccttgtccatagtaccaagattcatgtactttatcctgggtgatagcagtacatgacaaagtacatatgtaatatatacaactgagtactttgtcactttgacacagaactgaagaactacacttattaatcccgaagttatgatttttcttgttgttgttgctgaaaaatacagcatcatgctaattgctaatttctgtagctaagtatacccaaggtacaacctgaaaagggtggtggcccagactgggaagaggcatatttttaagaaatgcgtttttaaataaatattatttgtaaaataataaaaatggaggtttcaaatgtaatggcttctagaaattaagaaaccccaaatgatctgagtaacttaattactcaagaagtagaatacattccaattacgacagtgcaatgtgcttttaaagtcatcgggaaactaaagcacatgcactttaaacataaggaataacaagtttgcaaaacattttaatggaaacccaccaaaaaaaaaggcagtctttaaatttcagaagacttttagacttacaaagtcatcctgccagctgggcgcagtggctcacacctgtaatcccagcactttgggaggccaaggtaggcagatcacctgaggccgcgagttcgagaccagcctgaccaacatggaaaaaccccgtctctactaataatacaaaattagccgggcatggtggcatatgcttgtaatcccagctactcagaaggctgaggcaggagagtcacttgaacctgggaggcagagtgagccgagattgcgccattgcactccagtgtaggcaatgagagcgaaactccatctttaaaaaaaaaaaaaaaaaacacaacaacaacaacaacaaaaaaaagtcatcctgccaaatgtagcagaaggaattagatgaccttccatcaatttgttctaattctgtaaaataatctctccataagctaaagctgttcttggtagtgatttagcaatataaaattgaatcatcaccttacttaaaccttctgaataagtccatacaagtagacaaggggcaaaaaacaaaacaaaacaaaacaaaacaaaaaccctaagtaaccaaggccttgatcttctgatcactgtggaatgaagaggggaggctgttgtaagactgcagtttgaggaaaggggttcaaaaagtggagcaggagtaggataaaaatggaaaggaggaagggagaagaaagcatataaatctttctgaaatgatactaatttttcattgttttttttttcctgttttaaaagtgagtacttaaacaccatcacatctagaatattaagtaagacacttaagatggttcctacagaaaaccctcatgaatcctaagccagtgaagaagaaattgttaaaccattaatttcaaaaacagccaaataagtaaggaatatttacccaaataattaccaaagaagcagcataataataacattgagttcccaaacatcacaacaaaacaaagtgcaagagaaatctggaaaaaatccaagaaaaaaatataagtaatgcacataaaacaaaaaacctttgttttttattgtgaaaattgtacatgcccataataaacagaattcaaactgttcaaaagggactataagattaaaacagcccattatccatcccacacttcaagctcccagagataaccatcaacagtttcctgtgcatccttccagacaacatgtataaattctagtttatatattttgttaaaacacaaacggacacttaccccacaagctatactatttcttgcttttattcgtaatatgtttcaaagagctttccatatgcatgcaagccaatctaatacattctgcttaagaactggaaaaagtattctattccacagatgtaccctaatttaactagtcctccgaatactgcaaaacacttaagagctttccacttctattttgttttgtttggatcttcctaataaaaacactgctatgatagacatccttatgtgtataccttatgtacatgtcagtacatttatgaataaattactagaagtgaaactgatggatcaaggatatccacatttttaaattcaatacaaatattgacaaattggcctacaaaaagattgtgccaattccctttcccaccaactgggcaggagagttcctatggatatatattctggcaacactgtattattcttttaaatatctgccaatccagtggggaaaaaatgttacctcattgtttcacttttccattcttttaatagtagatgagacacagcaccttttattctatttgctggttatgttgtcttgtgtgtatgtgtgaactgcttattccaactgcccatctgtctattgggctttcattattttccttaacagctctcttcatatattacagaacatagccccaatatccagaatatacaagggacttaaacaaatttacaagaaaaaaacaaacaaccccatcaaaaagtgggcgaaggatacgaacagacacttctcaaaagaagacatttatgtggccaacaaacatatgaaaaaaaaagctcattatcactggtcattagagaaatgcaaatcaaaaccacaatgagataccatctcacaccagttagaatggtgatcattaaaaagtcaggaaacaacagatgctggagaggatgtggagaaacaggaacacttttatactattggtgagagtgtaaattagttcaactattgtggaagataatgtgacgattcctcaaggatctggaaccagtaataccatttgacccagcaatcccattgctgggtatatactcaaaggattataaatcattctactataaagatacatgcacacatatgtttattgcagcactattcacgatagcaaagacttggaacaaacccaaatgcccatcaatgatagaccagataaagaaaatgtggcacatatacattatggaatactatgcagctataaaaaaaggatgagttcatgtcctttgcagggacatggatgaagctggaaaccatcattgtcagcaaagtaacacaggaacagaaaaccaaacactgtatgtcctcactcataagtgtcagttgaacaatgagaacacatggacacagggaggggaacatcacacactggggcctgttgggggtggggggctaggggagggatagcattaggagaaatacctaatgtagatgacaggttgatgggtgcagcaaaccaccatggcacatgtatacctatgtaacaaacctccacttgctgcacatgtaccccagaacttaaagtatatgtgtgtgtgtgtatatatatatatatatatatatatacacacacacacaaacacacacatatataaagaacatagctccttatcaagtaaacatattgtaaatatttttctcagttcatttttgacctttgtggtattttttgtattatggttattttctaaatatttatgttagcaaatgtatctttcatttcctttaggtctttggatttatctgtcatttaaaaaggcactaaaaataaaataatccatattttcttctagaagttttatttttgatccatatatatcaatttcaatgtgaatttcagaatcagcttgtttcaaaaactaaaatttttattaaaattgctttattcaataacgtatgttatttacagttatatctgttcaagattgaatctttagatcccaaagcaatacatgttccttccatttctttaaatcttcttttacatgcattagcaagtacggttttctttatatagatcctgcatattttcttgagtttattctaaagcatattatttttgctgctgttgtatcaagaatcttcatattttctgtttgcatatagaaaaattatattaaatatgcatcaatgaatatgatttcattgtttctagtagtttatttggatttctcaagtattcaaaatgatatcaactacaaacaatgatatttttacattttcctttgaattatttttcagtcaattgtattagctgacatttctgcaacaatgttaagtaatgagagaggcagtaggcatatttaccatgcttctggcattaatggaaataggaaattgttctatggcttcatcattgtatgtgatactagtttttgttttgaggtgtgggtatcttaaatttcaatgaaatatccgtctatttttacttgattatggtcttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacacccggctaattttttgtatttctagtagagacagggtttcaccgtgttagccaggatggtctcgatctcctgacctcgtgatccacccacctgggcctcccaaagtgctgggattacaggcgtgagccaccgtgcccagcctattatggattttttcaaacttctcaatgtgataaatcatattaatagaatttctaatatcaacacattcctgaattcctggaatgaggcacttagatacaaatttaactatgtaaaaaatctatctgagcaaaactacaaaacttcaatgaaagtaatcaaagaactttataaatacatgaagttattccacatataggaaggttccatattgtcaagatgccagttcttcccaacttgatctacagattcagcacaatcccaatcatgagcctagcaagttaccaataaagtgattctgaagtttatatggagatataaacaacccagtatagagccaactcaatactgaagagcaaagtcagaggactgacactaccccacttcaagacttactataaagttactgtaatcaagacagtgtggtatttgtgaaagaagacacgaacagatcaagggaacaaaacacagagcccagaaatagactcacatatatagtcaactgatatttgacaaaggagcaaaggcaatacagtggagcaaaaattgtcctttcaacaaacggtgctggaacaactagagatccacatacaaaaaaataaatctagacatagactttacacccttcatgaaaactaactcaaaacagacaacagatctacatgcacattgcaaaactataaagctcctagaagataacattggaggaaacctagatgaccttaggtacgatgatgacttcttagataaaacaaaaaggtacaattcatgaaagaaatgattgataagctgaacttcactaaaattaaaaacttctgctctttgaaagacaggacaatgattgagaaaagatatctgcaaaagacacatctgataagggattgttatcaaaaacatacaaagaattcttaaaactcgacaataagaaaatgaaccacccaaggaaaaataagcaaaagatctgaatagacactgcaccaaaaaagatacacagatggcaaaaaaaaagcataataaaagatgttgaaccaaattaaaacaatgagataccattacacatctattaaaatggccataatccaccatgacaccaccaaatgctgacaaggatatggagcagcaggaactctcatttattgctggtggtaatgcaaaatggtatggccactttggaagacagtttggcaatttcctaaaaactaagcatactctcaccataccatccaaatatcactttccttggtattcactcaaatgaactgaaacatccatgtaaaaacctgcatacagatgtttatggcagctttactcataattgcccaaacttggagttaaccaacagttattcaataggcgaataaataaacagtggtacatccatataatgttaataaaatgttaataataatcaagattgaaatgagctatcaagccatgaaaagacttggaggaaacttatttgctttttactaagtgaaagaagccaatatgaaaaggctacatactgtatggttccaaacacatgacactatacaaaaggcaaaactatggaaacagtaaaaagatcagcggctgccacgggttagggggaaggagggatgaataggtggagcacagaagagctttatggctgtgaaactgttctacaagatactacatggttgacacatgtcattatacatctgtcaaaatccaggccgattgcggtggttcacatctgcaatcctagcactttgggaggccaaggcagaaggatcccttaagcccaggaggtcaaggctgtggtgagccatgtttacaccactgaactccagcctgggcaacacggcaagaccctgtctcaaaaaacaaaacaaaacacaacaaccacccatagaaaagtgaggcctaacgtaaactacggattttgggtgattctgatgtgtgatgtaggtttatcaactgtaacaaatgtaccactctggtgcgggatgtcaatagaggggtaggttgtgcatggttgggggcagggggtatgtgggaactctgtactttctgcttaattttgctataaacctggctgggtgcagtggctcatgcctgtaatcccagcactttgggaggccgaggtgggcagatcacatgaggtcaggagttcaagaccagcctggccaacatggtgaaatcccatctctattaaaaattcaaaaattagctgagtgtggtggcacgtgcctctaatcccagctactcggaaggctgaggcaggagaatcacttgaacctgggaggcagaggttccagtgagccaagatcgtgccactgcaccccagcatgggtgacagagcgagatccatctcaaaaaaaaaaaaataattttgctgtaaacctaaaacttctctgaaaaataaagatttttaattaagaaacaaaaaccacagtgaggtatcaccttataactattaggatggctaccatcacaaaagcagaaaataaatgttggtgattacatggagaaaatagaacctcatgcactgtttataggaatgtaaaacgtacagctactatggaaaagtttggcagttccttcaaaaatagatttaccatatgatcaatccagcaattccacttttgggtacatactcaaaataattgaaaacaagatctcaaaaaatatttgttcatagcagcattatttactatagctgaaacatcgaagtaactcaagtatctgtggacagactgaatagataagcaaaatcgtgtgtgtgtgtgtgtgtgtgtgtgtgtgtacacacaatggaatccaagtatccatggacaggctgaatggataagcaaaatctagtgtgtgtgtgtatgtgtgtgtacacacaatggaatccaagtatccatggacagattgaatggataagcaaaatcgtgtgtgtgtgtgtgtgtgtgtgtgtgtgtacacacaatggactattatttagctttaaaaggaaggaaattctgacatgcttcaacatagaagaaacttggggacagtaggctaattgaaataggccagtaacaaaaagacaaatactgtatgatttcacttacatgacatacataaagtagtcaaaatcacaaagacagaaagtagatggtggtttccaggggctgggaagatggaagaatatggactttaatgggtatagagtttcagttttgcaagatgaaaaatgttctggaaatagatggtggtgatggttgtaaaacaatgtgaatgtacttaatatcactgaactgtataattaaaaatgcttaaggtggtaaattttaagttacatgtattttaccacaataaaaaatggaaaaataatttttttggaataattctatatattttttctttttataactataagaatttagaaatttataaaacgataatggaagaagatagaaaatagtaagtcatataataaagtatgtatcatttacccaaggtaggttttacggctaactacgctgtgtaattttataattttataactaaaactttgagtcaaggccctcagccatagttgtctatgtgaccagccaactctgaaggcttaacatttaatctgatttatactacaaaataaaaaactattttaaatagtttgggaaaaaataagccgcatctaaaaaatacataattactgtctaacacattcatgaacaaggatgtaaaaatcctatcaaaatgacagcaaactgaatccagcgacatgcaaaaattgtgtttagcccagaaaagcaagtttatttaacggtagaaaattaattaatgttaattcattacagtaacagattaaagagggggaaatacatagaatcatgtaaacagatgtacgaaagcatttcatgaaacttaacatttattaatttctttttaaaagtgctcaaagcatgatgaggacatgttaaaaggaaagagaagtcagcttgaatagttggacaagtgtggaacaattggagcatcaacataaataacaaaaataatggattacactgcactgactaaaatagatgtcattttcttttggacacaagacaaactggtaaaagatttgaataggaatttacaacagtggaaacatgaagggcgtacaaacaaaccaaaagatgctcagcttcattatgaatcagagaaaatgcaaattaaggttataagataccattttacatgaaccagattaataaaataaaaaaggatgtagaataacataagctgctatatattgctgttggaagtagtccaatcattttagaaaaacaatttggtatttataaagttgaacatgtacataatttaccacccaacaagtttactactaggtaaacaccctagagaaactctcaacataggtgccctaggagatatgtgaagaatgtacagcattatttataactaaaataagaagttggggagagaggagagaacctaaatgtccttcaacaagaaaatgaataaatgaattacgctttatttatatgatggaaaatataaagcagtgaaaatatttgaattctagttacatataagtagcagaaatctgagtgaaaaaatagtacttataaaatgccatttgtataaaccttacaaagaatgtgaacatttaataataaaaatttatactatttagtaatccacatatggtaaagttataaagaaaagcaaattgattacgattcaaaaagtcagaatagcggttacctctaggaacagtgaggggatgagctcagggcatacaggacttaaaagtaacaataaggttctattttccatttggagagtaggctcccggttgtttattttatgactgtgtttataacttccttgcacattataaatgttcttttatatgtataaattgttaagaaaatgaaaatgggatattatgacagttgtaaaattatcaggaaaagaaaacatcaatataaaaactaatgagagagaagacaaatgtttgtttttaaaggataaccattcaagaacatcaaccaatcggctttagggtctttattctagctgttccaccaacctaggtatcagtttctttgatatctacttggctaactcgttctccttcttccaatctttgttctactcccccttttcaagaagacctgccctgaccacctcatttgatttttccatctcctaccccctgatcttggtgctcctgatctgccttacccttaccttttctttcttctaaaatctctttttgtaattttttatagagatgggggtctcacccaggctggtcttaaactcctgggctcaaatgtcctcttgtctcagcctccccaggccaccatgcctggcctaaaatccttatcaccttctaacaccctacaaaatttacccatttactatgtttattatttatcttctgtcttccctccttcccccactctgttagaatgtagtaatatgaatgctggtgtattccacatgcctggatagttgacactcagtaaatgaactttttttcttttttgtagagacatggtcttgctatgttgcccaggctggagtgcagtggcatgatcatagctcagtgcagtctcaacctcccgggctaatgcgatcctcccacatcagcttcctaaatagctagtactacaggcatgcgtcaccgtgctaggataattttattttattttagtagagatgagatctggctctgttgcccaggctggtttcaaacttctggcctcaagtgaactccaccttggcctctcaaaagtgttgggattacaggcataagccaccatgttaggcccttctacttcattttaacagacagctcctggataatatatcagtcccatgtttccgtttcataaattatttcttttactgataatgcataagttgggaacaacttcaatcagataatatgacccaaattaaatttttgtgagtggtctatcaaaacaaggtctgttgattatatcacaatgtttgaacaacatttgttttagttatgaaattgttacaactagtttcaaccatgaacaaatcaaatattaatcaggagtttaagggcaaactaaatggaaaagaacaataaaaaaattattaccatgtgtatataaatgatcttccataatttacatatatcaatgtacccgacaacatacactgcaaataatgatgcaatctgaaatttaaaaagaaaatagaagtaaaaaagataaaatgaatagctacaagaatgaagaatatatttattgttgtttcaactgatttatatctacacacagagtgagttcttttgttttccttttatctgccaatttattattaaatatagtcaatatattagtatagaaaatattggttgatttttctctctgacacacagctctctcaatcatgtgaattgtctactttgttgattgtccaaaacaatactcattttaatttcaggtcaaccctactgtcaacacgtacaattaaaaagtaccttgtccaatcaaaaaagatgaaaacgtaattataacatgacaactaatacataattggggaaggtacatttaactgaaaaataattatgcaatgcatgtgtgcataaaaatacgttaatttctgcttgctagtcactctttacaagtatctccattagcgttcttccattaatacaaatattcaagagttagttataatcaaatttatcaatttcaaattaagagtactttcgctgcaaaggtatttttaactttcttttccatttggaagaaaattatatgttatatatcaataattctaagagtactggaattatttagatgaattgattaaatgatgatacagtatctcttacatggaggtaatatgtcagacaatgcctctacacccttcctcatagagaaagcaattcaaattaaattcttcctgtcctactacaaaagcatagcataaacagattgcaaaatagctgaatacttaaactataacttgtttcattcatcaagtttttttatctctaaagcaatctacaacaaattttttcattagtgagaaaaacaactaagtttccctttattcagagttacccatggagaacactgcatttcttagggtgcctgatatgacataacaactgtggggaagtgtgtgttattattcaatgtaagccccacagggaggcaaaatacctcccctgaccctcacctccacaaaaaagcaggcagtctccactatcaggaagcaatgagaatgctcccttttcaccccaagggctaagcaacacacagtacatttacagggtagaattttcaagagacaatctcagagacaattttaaaccagaaactgattgaaaatgtcatcgaactaagttagacaaaggagtctacaagacaagatcaaagtaaaaagtaagtacaaatagagcctattttaaaaaataatgataaaaccaactaaccttactgacacctactaagtaccaggtactgtgttaagaatcatatacattacttcatctggtcctatccgcaacccaataaagtaggttcttttattatctctatttcagaaatgagaaaacctaaactaagaaaagttaactactttatccaagttaagaggctactgaatagaattaggactcaaatccaagtctaacttcatttctcaagcaagacgttctaaaaaatattaaaaagctgccaggcgccgtggctcacgcctgtaatcccagcactttgggaggctgaagcaggcggatcacgaggtcaggagatcgagaccatcctagctaacaaggtgaaaccccatctctactaaaaatacaaataattagccaggcatggtggcatgcgcctgtagtcccagctacctgggaggctgaggcaggagaatcgcttgaacccgagaggtgggggttgcagtgagccgagactgcaccactgcactcaagcctgggcaacagagcaagactccatctcagaaaaaaaaaaaaaaaagcaactcttcaactgctttatacaaatataccagtacaataaaaaaaatagtaggcagggaaaaaaatgagtatataactcatttttttttttgagagtatgtaaccctctctcaacaaactacctccatttatagtgggcatgagtacatggaaaggcaatagataaatttccagactggtagagagaattttataagagatgaactggttagctatttatcctgtaatcctatgtgtctgtattttacatgcaagaatgtacacaactattcataaaagaaacattttacgtaagagaaatactattgttaacttaagagaaatacttaaagttatagcactagtcctcttttaaggacattaacaatactgaataacaaagataagcattcttacaaatttgagttcaataaatgcattatgttaggaagtaaataattaacaatcatttataaataatcctacatatttctctaccctgaactttcttttgttcaacattcctaaaaaatgttttagaaaaacattttttctgttcctgttttagaaaaacatttttcctagaaaatgctttagaaaaacatttttcctagaaaatgctttagaaaaacatttttcctagaaaatgctttagaaaaacatttttcctagaaaatgctttagaaaaacatttttcctagaaaatgctttagaaaaacatttttcctagaaaatgttttaggacttagaatcatagaacatctcagttataattttatgcaaataagttcatagtcaaacatgctaagcttaaaacagcttaaaatataatcacctcacctgagtaagaagtacaaactgagcaaactgccaaggaagcatgaaaaataaattggaaatgcagagtgcaatcaaacttcctctataaagttttgtagcccttgaaaagataaaataagtgttagtaagtttaaacacgaaatagtctagcatggctccaaactgctgcaaattagaatctcgaaatatatatgatctggttataacacaaacctaaacataaaatgaaccaatgggttagaaattatacctcctgatactcaattacaacaattttctttgaaaggtaaatacccattattgctaacaataacacagagagaaggagggtggctgggtcagtatatccacgaacatttttttcaaattatattttggtgaatccatgactgaatatttaaaaatactgattcaacagattcattagttagaaaggcagaagatgcctatgaaaagataatagcagcatattctaagtgctaagtattatgcagacaactactgcaagaatgcagaataagagctaagcggctgagattttataagcatgtgagataaaaagttgggtctggcacaggcaggataacacagaaaagttaagtggaggaaaagatatgggggccactctgaagcaatctttagagatctcattttggtactgacttgtaatttaggagatttttaggagggtaagatgattttatcctctaaatctgcgagccaacgcaaagcccccacacatgtccatcttcacagaagtggagtgtgcatgttaatatactgaggtgatgaagtataggcagctcggatacagtaaagacatcctggttagataaacctacctggagcatagagcaccattatgaaatgcctttcttcacttccccaagtatcccttctccaaaggacatccctctctgctattttaatccaacaaaagtacttttaaactccagataaccttttaatgagttatgaaatcaacttatggaataaaattcagcatttaaaaatggagatcagcagagtgaaacagaatatatatgactatatcctatttacgaggggttctattctgtaaaacttttgtttcagttgtgtgcatccatgtatgtgtatacaaagccacagtgtaaaacatatttcttatttcttatagatcatagtccaaaagtttgaaagccgctgtctaaaataaagtacttctctactgcttttgaatactaaatatgattttcattttatgggtaacgagagacattaagatttctgagcagaatttaataccaatctggcagttgggtaaagaatgcactatggggagataggaatgaacagaaaacaaagaaaattcaattggtgatcaaaatagctctgacccaagaaaacagaaacagaaacataaatattgccaagaataattaaaaaaagctaagaacaatcaagaaaaagctaagctgtgctagtattaggtgactatataaactgaatttctaaaaatgcttaaaattcaaaactggacaaaaccaatttgttaaaatataccactaaccttatttataaatgattcctagcattaaggaatagtctcttttccggttttataacagtatcctcagcactgcagcctgcatcaacactgctcagcttcttcttggctcccccaagccatcaccacccaccacctccctctaatgtcataatatgtcaactacaggtagaactcaagaactaaaggaaatggctgctcttccaaaggagacaatgtcagtaataaggatgaaatatcagaagatgaagatggccaatagagagaaggttactatccttcagaaaaaagacaagatgtctgccaaagcttcaagaaaggaagtttagcaggttttccctccaaaaaagactgcagtgtccaagaaagcaaaatgaaagcccacacttccaagcaaccagtcatagccacagcaggcaagcagggagccatgacaactaaggggcatagccaggaaagccgtcgcaatcagaactgataagctgccaatgaagatggcgaggaagatcaagacgagatggatctgaaccaggagtggtgaaaacaacagctgattcagcttcagatgaccaggaatatgagaaaggaaatgtcaactagaatatgaacagagacaatgaaaaaggctctaaagaaaggaaagttctctaaaacttttcagcaaaaagtaaagacaggtatgaacaggtgggtaaggctgaaaatgacaatgataagaggctaaagaagacacaaaaagcttgccacagaagcacctggagccaaaaacagagaaggacccaatagaaggcagcccttgaaggcaggaaacagcaactggagaggccccatcctggtaggcagaataatggcctccaaaaacatgtgtcctaatccctggaacctgtgaacatgtcatgtcacttttatgtaccaccacaggatacataaaagtggaagagaggctgaagagaaggttggagtaaactgacaaagaaggacccaatccagcattgctggttttgaagatgaaggagccacaagccaagaaatgcaggcagtctcccaagaaatgcaggcagcctcccaagaaatgcaggcagcctcccaagaaatgcaggcagcctcccaagaaatgcaggcagcctctagaagctagaaaaggcaagaaaattgattctctcccctcccactctgtgccttcaggaagagtgtagcacctccagtaccttgattttaaaactaaggagctagaaaacttcaaggtagtagatcccagtttgtggtgactggtacacagcaacaggaaagtaacactaccttctatggtacagacggactaaaggaagcagcactcagtcaccggagcagcatccccatgcccacttagggacagatcagatcagtgagtgaaagaagaatcaaaggtttgccttcgctggatttaagacaggagcagaggtagaaaagcaggaaggaactagagactgatgggcagtctgctgtctgcactatactggagaaaaaagccacggtcaagaatgtgaatgtggaaaaacagcatctgtagtggtgaatcaaagactcctacagcacaacacttcttacagagatgtttgagaagggaccgttgctcaaggtgcctcagaaccaacaaggcagagctaaaggttacgaattcatagaggttcaccttatttgaaggtgctaaagaagctttaaatcctataaaagagtttaggggacagcaataaagctggagctacacagactttaaaaagctaatgcaaaaacattacccatcccatgttctatgaagggtctgtctaaagacactactacataggagactaaaagccatgtgatggttctatacttgctgtaacaatcagagggaaatagattgcccaaagagtttggcataacagacttcaacaaagttcttccaaattcggaggatcactgaaaagagttatcagtctgagtcatcttcagatttttatcatgctttgttccatttttccatagcccccattttgtttcatttttaccctctggagcaaggcagctgtattcaatatttgtcagcagaaagggagagaagtgtgaattctgtgaattacactttgccccaaaggattgcatcttacaggatacactatagcataaccagccttcaccttctttctactcattttcaggaagttatagtggtaacagaagaagacttgagaaagtggaaatgacagaagtgaaagcaatttgttccttctcaagcagtcactgtggaccaccaagaaaaaggaagaggaacagaaggctgatggaggaaatgtttttggtactatttttaagttatactcttaaaatatttttactaataatggcatcatactggtaaattattttattatgttgactttattatggaagcttaagaaattctagtttaaattatttaatgcaaaaagaaataaggttaagtcaaagttacctgagaatatgagtcacaagcaacatctgaagaacaagaaatggatatgagaagctttcgcggagaggtggtgtccacattacacaggtacactgaaaaaaaaattcgtagtatagtatacttgctaaatttactaagacagacattccaagtaaaaattgctatttataaataaaataaaattatttttaacaaataatttaaatggtatgttgtaaaacaaactactggactttatcccataaacagcaaaactagcatgtgagaaatattactgacagagacacatgtggcttaagatcatgtaaagcattaatatgaattgtcaacaagaaaataccaaaaaagatgcaactacatcttaaaaggaaagggaggaaagtaccagcaaaaaaacgttctgtcaaatttcagaatattttgaattgattatttatctattgtttgtcttctttcccatgaatttcagcaaaactatccataaccagcacttgagaattcttgtagtcatcaattttagtattttcattcacagtgctgctacaaaggaatattccatttttggttttacttctttgcctaagctaccctgggttgcaaaatatttaaaagtaggtggcggaatcaaattaagtaacaaaagtcctaaaattgtgaagtataaacctttctgaaaagctcactttggacataattaagcaatgtactatcgcagttgtaataatgtcatttttctgtatatatactaaatacattagtaagttcatccttccatcgacagaaaaccgcatagaattaaatgcaagcaatctgatattattaagtcacactaaaataaattatgtctttcagtgcaagcaggggtacctaaaagactccacagaatgacaaagaccatgtcagaaataagtgtttcctatattttagctctacctcagactactgaatatttctagtactgctatagaaagactgagtcaatttactcctcttttctaccgagcccaccatcctctatgaaactgacatacatatctatttatgaatgaactactcacacaagggaatgctgaaaagatctgatggatactcttgttactcaatattactgaatgtctgttgataatgtatactgttgttaccagaatgcaatttttaaaagctgttagtttattagattaactggagagttcagtaggattgacagtaagatacatgggcaaaccacgtttcattgccctttaccatgcttcacagataaggtctgtcacaaactgaaggtttgtggcaaccctgcatcaagcaagtctatcagtgccatttttccaatagcatgtggtcacttcatgtctctgtgtcacgttttggtaattttcataatatttcaaccttttctttttttttttctttttgagacagagccttgctctgtcacccaggctggagtgcagtggcacgatctcggctcaccgcaagctccacctcccaggtttacgccattctcctgcctcagcctcctgagtagctgggactacaggtgcctgccccacgcccggctaatttttttttttttttttttttttggattttttttagtagagacagggtttcactgtgttagccaggatggtctcgatctcctgacctcgtgatccgcccgcctcagcctctcaaagtgccgggattacaggcgtgagccactgtgcctggcctatttcaacctttttcattattactatatctgctatggtgatctgtgatcagtaatctctgatattactattgtaattgctttaggtgccttgaaccatgcccaataagatggcaaacttaatggataaatgtgtgtgttctaactgctccaccgatcagccactctcccatctctctccctcccatcaggcctccaaattccctgagacacaacaatattaaaattaggaaaattaataagcttacaagggcctctaagtgttcaattaatagaaagagttgttcatctctcactttaagtcaaaggctagaaatgattaaacttagtgaagaagacatgtcaaaagccgagagaggccaaaagctaggcctcttatgcctaacagtcagaaatgcaaaagaaaaattattgaaggaaattaaaagtgaaacaaccttattgctgatatgcagacagttttaatattctggatggaagatcaaaccagccacatttccttaagtcaaagcctaatccagaacaaaatcctaactctcttcaattctacgaaggctgagagaggtaaggaagttgcagaaaagtttgaactagcaaaggttggttcatgaggtttaaggaaagaagccatctccgtaagataaaagtacaaggtaaaacagcaatgccgatgtagaagttgcaagttatccagaagatctagctaacataactgaggcaggtggctgcactaaacaacagattttcagtgcagatgaaaaagccttctactggaagaagatgtcatctaggactttcccagttagagagaagtcaatggctggcttcaaaacatcaaaggacaggatgactctcttgttaggacctaatgcaaccagtgactaacttgaagccaatattcattgaccatcctaaaaatcctaggacccttaagaattacactaaatctactctgcacatgatctacaaatggagcaacaaagcctaggtaagagcaaatctgttttagcatgattcactggatattttcagcccattcttgagacctactgctcagaaaaaaagattcatttcaaaatattattgctcattgacagtgcacttggttacaaaagtgctcgggtggagatggatgaggtgattaatgttgccttcatgcctgctaacacagcatctattctgcagcccatgaagcaaggagtcatttcaactttcaagtcttattatttaagagatatctttcataaggctctagctgccatagtgattcctctgatgagtctggacaaatgaaatttaaatcttctggaatggattaactatttcagataccattaaaatcattctgattcatgagaggaggtcaaaatgtcatcattaataggactttggaagaagtttatttcaactctcatgggagacttagatgggctcaagacttccgtggaggaagtaactgcagatgtgatggaaatggcaagataactagaaatggagactgaagatgtgactgaactgctgtaatctcatgataaaacttaaaggataaggagttgcttcttaaatgagcaaagggaatggtttcttgaaacgggatctactactggtgaagatactgtaaacactgttgaaatgacaacaaagaatttagaacatgacataaacttagttgctaaagcagtggcagggtttgagaggactgactccaattttgaaagctctactgtgggtaaaatgctatcaaacagcatcacatgctacaggggaatctttcatgaaagaaaaaatcaatcgatgcagcaaatttcatcgttaccttaagaaattgccacagctatcccaatcttcagcaacccctctgtcagcagttgtcaacatcaaggcaagaccctccatctgaacaacttgctgaaggttcagatgatcgttggcagtttgtttgtttgtttattttgagacggagtttcattctgccacccaggctggagtgcagctgtgcaatttcggctcactgcagcctctgcctcctgggttcaagcgattctcctgccacaacctcccaagtagctaggactataggcacccgccaccacacttggctaattttttttgtatttttaatagagaaagcgtttcaccatgttgaccaggctggtctcaaactcctgacctcaggcgatccgcctgcctcagcctcccaaaatgctgggattagcaacttatttttaaattaaggtatgtacattgttttttagacataatgctatttcacacttaatagactatagtacagtgtaaacataactttgatatgcactggaaaaccaaaaaatttgttatgacttgatttattacgatattcactttacaatatctctgaagtatgcctgtatgatcaaaatttgcaaagtcatcagtctgtacaaaaacaagtattcaaacaagcaagtattcaaactatgcaatgtacaatttgagaattttcttcatatggacggttcccccacatttgttacccacattcaatgacgttatcattcctccgaaattcgttgcatttaatagctgaagtcactcagttcaacaaaactgaattacatcctctgaaagtagggacaagaaaacccaattacaggactgtaatgaagggcaaggtcttctccctccaaagttctgagtatatgaattcaaatgtccatgaaagtgctttctattgtttctccaataacacaatgtgttttactagatctggtacaaacataattgccattccagataatctcatataatctgaaaatagtgaagagatttggtttagtcatgccttacgtttcaacaaataaatattttttctttatctctaattttaaatgcaaaataaaaagtgtgacagtttaaaatgccaatgctttttaaaggcattattttgaaatttgagaattaaaggaaatatacatgtgaactgcttcaaaaaaggcttatacaaatgtatgttgtctctaagtacaagaaatccatttattgtgaaaataaattcaataaaaatctcatgtttcaaactgctaacacctagtatataatttttatcacacatttcataacactgattatattgcaacataatactgtgtagatattaacaagaggcttttcttttctgcttaataatttttaatcaatcactcaagaatcaataactaaggaatctcaaaaatagcttaattttccaatctctattttcaaactattaacttataatattggaaatacagcatgatctaattgatttatcttcataacttcaaaataaatagaacacctgactagtgagttataaattgtggttaatattagtatcaaacagatcatgtttaagatttattccaagagtttttactagagttgctatttgctggatcaatcctaacttgttactataatgtttaggtttaaaacaaattacccacctctgactgctgcttttctatattgattacactattgctccatattgcttaatattaactataataaggctttaaacactatatttatgagtgcttccttaaaagactgctggcaccatgaaggttatgctacctctcttcagagaatgttacaggtgttaagaatcctgctatccacatagtaaccataagaatgctaggtttaagagacatggcttgaatatctcctgtttgatgctacttagggcagtcccattatttaggaagacccttagtttggagtaggctttgtgcatctcagggcactgtatcttgataacaggtaagcctggttgctttcttggagttttggtctatttttgtaccatacacaggttgagtatttctcatccaaaatgctgggactagaagtgttttagatttcagagtttttcaaattttggaatatttgcattttacttactaactgagcatctctagtccaaaaaaccaaaatctgaaatgctccagtgagaatttcctttgagagtcacgttggcgttcaaaaagttttggacttttcaagtatttcagacttcagattttcagattacagatgcacagcccgtactgataagctgctcaattaaccagttacatatttcaatctgaacttataatacaattttggctcacacagggtttaatgtgtcagtgatacgtaaatgctattttaaactttactatctttataaagaatttcagctggttgtatgacagaaaacattgatctttttgtctctgaaaatctaagatatcagtatatcctatcctaaatttacaaaaaacctctgtgaaagcagtcaactttgttgaaaaagcggtgagtacacctccatgtttccatccattgttgcaatgactcgaacttgaccattgcttattcatctaaaatagaaaatatatctggcaagatgttatcagtatcaactctaccacctttatcatgtggttataaactacactgctcaaggttatcaacataaccaaaattctgactataaaatgaaagcattagccaagatataaaggcaatataaatagaaacagaaacaaatgattcaaattgcactatcaaaatgataatacaatgtggagaaataaaaacaattcaggttgcttctaaattgtttaacttttatattctgactatacctccttagtagaatatactcttaggagaaaaataagtagagaaatactgaaccatactttgtaggattgttattggtaatgacattagtgtagtaactctgaaactattttgtgtgtattacagaataatttgtttctggaacctttttgtgtttgaaaggaagtgtttgtctgaacacaatgagatatatcaaaagggcagaaaagagtgccaaaatcataaaatatctagagattaataaaatatgtgcaaaacataaaacattgctaagagaaattaaaggagacgaatataaatctatgtttatggattggaagatttagtatgttcaggaatgtccattctaaattaacctagagatctaatacacaaccagcaggttgtgtatgtgttgaaagagatgggagtagtgacaagctgattctaaaatttatatggaaacacaaaggacctggaacagctatggcaatactgacgaaaaacaaggttagagatcttcattatcagatatcgaacttataaactacaatatttaaggcagtgtggtactggcttgaagataaacggacaaatagaacataatggagagtgtagaaataaatccaaaaatatatagtcactttatttatgacacaaggcccactacaattcagcggggaaagaattttctttttaacaaatggtactgggttaactggacatcctatttggggtggggtaggggaggaagaaatctggaacttatttcatactgtatacaagattctagacagattataaaccaaaatgtgaaagctacaccaagattttcccttatattttcttcaagcttctaaaagaaaatacgagaaaatctttatgacctacagtaggcaaagactttttaatcagacacaaaaaagactacacataagagattgctaaatggaacttcatgaaaattaagaacttcatcaaaaaacctcaaaaagatctgtgtacaaaaagatacaatcacaaaatccaaaaagatgaaaaggcaggtcataagtggtgagaaggtacttgtagaacatatattctacaaacaactccatggaattgacaaagagttcccatatatgaataaaataactcaaatatttgttaatgggtgaagactcagataggtattaaagaaaagagaatatctaaatcagataagccatattaagaggtactcaatatcattactcatcaggaaaatgcaaactaaacccataataaggtaccatttcactcatcagaatgactataattaagaggactgccaatgccaagcactgacaaggatatactgatagaagaaactggaattctcatacattgccaatgggagtgaaaactggtacaagcactttggaaaacaatgtggatatatatcacagacatatgttgagagaaagacatcggacataagaaaatatgattccactatatgaaaccaccaaataggcaaaactaatcaatagtgatagagatagaagagtggctacctcttttgaaggatggagaaggatacagattggacaggaacagaggtgagcctgcttgggggctggaaatagtctatacattgatctagttcctggatacaagactgtatacatatgtaaagatccactgaacagttaaaatatgcaaatcttaatgtatgaaaattatatataattaaaatgtggggagactactaccggctaaatgtgtgacaatgagaacatcaaaaagatttgcaacagattataaaacattgaataaattttaaaaaaacctatgcatatatagtaaaagaaaatggcgggacaggggatttgtctttacagaacaccattaaatgtagattaaatggcagaattagaaaattaccatttgcaatggctaatgtaataactaattcaggcaagtatcatcaatggatgcataatcagttggtaaatgttatagaggaagagggtattggtgtctcaaagtatcatcccacatttcacttattaaaaggaaaaagggcatttttataatagagaaatatgacaccaccacttaactgtgtgatttaatttagtaaattcgattatgggacaaattggttttatgtgcctccagatgtaatgcaaagaaaaggacacaacatcatatgtgccatattcttcattaaaatgtccaatctggctggacataatggcttaagcctataatcccaacactttgggaggccgaggcaggcagattatttgaggccaggagttcaagaccagcctggccaacatggtgaaaccctgtctctaatgaaagtataaaaattagctgggtgtggtggcacatgcctgtaatcccagctactcgggaggctgaggcacaagaatcgcttgaaccagggagggagaggctacagtgagccaaaactgtgccactgcactccagcctgagcaacagagtgagaccctacctcaaaataaaataaaataaaatggtctaatccgaatctattaatgaagaaacgatcaggcaagtccaaaatgtcagacctctacaaaataattagttcagactcctcaaaaatgttaatgccatgaaaaaaaaagagactgagataaacttttctaaataaaatgacaactaaatgcaatgtacaatccttaatcagattctggatccaaaataaaagcatcaaagaatttataggactaaactatgtaaataagaatatgggctgtattaagatattattatataattattagtgtgaaatttctcaagtatgataacagtattgtgattatgtaggagaatgtcttgcttttaggcaatatatactgaagtatttaggggtgagatctcatcatatctgtagctcattttcaaacggattagaaaaatgtctgtgtcggtgtttgtataagagagacagcaaatgtgtcaaaatattaaaactagtaaatgaaactgaatctagagcatttctgtaagtttcaatttgctcaaaataaaaagccggagaaaaaacagtagagaaaaatgtacttttcttgtactgcctttttagtacaagatttacaggggaactagacatagcccaggtgaagataataaaacagttgttggctctaccttcacacctgagaacaactgcgtaatttatgtaaggatctgccacaggcagagagtctttgctggaaccaaacagcttctaacaatataaacaagaatctgaaaaagctacaaacacaaaaatgaatattttttgtgacagccacccctcccccaacctgggacacacataaacatacacacacatgaatctggcagataaagaggagtaggggaaagtcagaactctgtgagatcacaatctcacacagcgcttaggttccagggtcttgccacggctgaatctggagatggattaaaattaactaaaaagctgaaaactaaccccttcccagtttaaagagtggtaagatcaaaggaatcccaagttgagcatctggaaagttggggactgagacaaagaaaaaagagatcactgtagttcatttgaaactggaagtaaactaaaacaaattaaaactatactactgccctgcttggcagggcttcatgtgggatccaaattctcagtctctcttcctaggtgcttgacataaaagaagatgttccctttctagggaaattgaggcaaaaatgattatctagttcaatctttattattcttttacagaagttgtcttgcataaaataaaaagctatgagacatgcaaagtagcaggaaaacatgatccacaatcgagagaaaaaaacagtcaatggagttaaattcccagataatgtaggtgttggcattagaagacagactttaaaataactatgataattagattttaaaatgtatagaaaaatattagtgagatgaatgaagagataggaaatttcaacagaaaaatggaggctctaggaaaaaaatggaaattctaagaagtaacgaaggaagaaagggaaagagagagggagagagggagggagggaaggagggaagaaagaaaggcaagaagggaggaaggcagagagggagggagggaatttaccagagagtgataatagcagactgcatgcatcagaataaagcatccatcaactcctagacatggcaagagaaaatactcaaagcgaggaatagagagaaaaaaaatggggaaaaaaaaaaaaacagtgtcaaaaatctgtgatagtatttttaaaaagttgaacatacatgtaattaggatccccaaagaagaagagagaaagaatggggaaaataaagtatttaaaaagaagatcttggctagaaattttccaaaactgattaaaaataaaaactaacccacaaaacaaaagcgttcaatgaacaaagcacatctaggttcaccaccatcaaccaataaaaaacaaatatataatgaaaattctcaaacaacagagaaaagacacattacattcagaggaacaacaacaaaaattatagctgacttcttataaaacggtagaaaccagaagataatggaatggcatctttaaagtgctgaaaggtaaagctatcaacctataattcttatgcagcaaacatatacttcaaaaatgaaggcaagataacatttttagacagacaaaaactaagggacttattgggatatctttatcacaatgctaaataaaattcttaaaactaaagagaaattatgtcagatggaaatccagatctgcaggaagaaattaagaacaccattgagatgcaaactgaaatgctcagttgtgaaggataaccgggagttaattaggcagaggtcaagatgaggggcacagaggcatatacaaagcataggaaacagcatgtgcaaaggccctgaggaaggaaaaggaatagtcctttccaggaactggagaaagaagggccaatagggctgaagcaaaacaataaaaaacagcctgaagagtgatgtgagacaaaaccagaaatccagctgggcaaggtcataaaagatgttgtaggctacttttctattgtagactgcttttcaaatttacatcagcagatatgctgctaagattaacacattctatttttattgaacttttgcagttactgtaagtttaatataataagttcacaaatccatagacataccagtgaatagccttcataaaactatacatcttgtacttacactgtttcccaaattcatgtaaaacataatttaaatcatgtcactctactagtcatcatcctctagtggcattccatccactccaaatggaccctataatgacctacagaaatctgctcccactctatcctacctccaattattaactgtctgaccttatctgctatcactctctgctcctccttgctactgcccaaataagccagttattctcctgctttaaggcagaagataatcccacattcacatgattgtccacaaggataggagtctttgttttacttatacatctcaagcatcaaaaagtacctggagtacagcaggccaaaaccttaccaacactggaaagaaaggaagaaagaatgaaagaaaaacgaagaggtccacaaattggtaagaaaaggtctctgcacctttcatttataaacgataaattatagtgatgtcttctttgaaatgctactcccttaactaagagtttcgtgtttggagagattaatgggagaatcaggaaacttgtaatcctctctctgcaaaaagatccacaatattgatctgggcaatgatttcttggataagactgcaaaagcacaggcaaggaaagcaaaaatagccaaataggattgtgtcaaactaaaatgcttctgcacaacaaaggaaataattaacagtatagagtcaacccgaggattgggagaaaatatctgcaaaccatacctctgataaggccccaatattcaaaatatataaggtactcaaataactcaatagcaacaaaacaactcaatttttaaaatgggcaaagaatctgaagtcatttctcaaaaggaaagatacaaatggccaacagatgtatgaaaaaaaaaatgctcagcttctcaaatcataggggaaattcaaattaaaaccacaatgagatatcaatgtacacctgttagaatggctattatcaaaacagacaaatgataagtgttggagaggatgtggagaaaagggaactcttgcacactgttggtgggaacgtaaattcatacagtcattctagaaagccatgtaagtttcctcaaaaacactataaatagaactcgcaatcccacttcagagtatatatacaaaggaactgaaatcagtacatcagagatgtctgcactcccatgttcatttcagcattattcacaatagccaagatacggaagcaaccctaagtgtccataaagagattaataaggaaaatgtgctatacatacccaatggaatatgacacagccttaaaaaaagaaggaaattatgtcatttgagacactatgaatggaactgaaagatacaacactaagtgaaataagccaagcacaggaaggcaaatactgtatgatctcaattacatgtggaatctaagagtcattctcataaaaacagagaacagaaaggtagttaccagaggctcaggggagagatgggtaatggggagatgatccaaggatatcaagtttcagttgggcaggaggaataagttttaatgatctattgctccgcttggcgactacagttaataataatgtactgcgtatttcgaaattgctaaaagaatagatttttagcattctcaccacaaaaaatgctaagttggtgaaggaatagatacgttaatttgcttgattgactccttctacaatgtatacataaatcaaaacatcacattgtagcccattaatatctacaattattatttgtaagttaaaataaataatttttaaaaaatataaataaataaaatcatctccctgctgagtaaccttgagccaatctcttaatgttttagtgcttccatttttatgatattgggatatttactacgtatctaccatataagaatattataagaatgagattgatttcaaagtgttctaagaattcttttccaaatcttatataaatggcataactttgtcaataagtaattaggaacatgtatgtttatagtttaatctcagttcagtgcaaaaatagttaagaaatatgggtcagaaatatgttgtgggtcataaaaatgggttaattagatatgaaccccaaggcaatcctttcatttactttgaattacttttttaaaaagtatttatttctaaaaaacacaaagtaaggaatttcctcttcatatgtgcacatctttatatatgcgattatgttttacataaaacagaatcaatcatgcttggtaatagttttttttttaatcttaccatgaaaaagctaaacaatcttatttcacaaaaaaagaatttctaacaatcaaaaaattggagaaaaatactgtattcaggtttttcttaatacacattcatgtgcttttctatcagcatgccaaaaccctgcaccatcaacacatgttgtgtgcatcttgtaaaagaaaacattttaaaggcaaaacaaaattgctagcttttgcctttgcaaaaattctcagttgtgacagaatgaaatttactaaagaagcttgatcaatgaaaacatctgcatagtttttattatagaatgtataacctcaacattactgatcattattataaacccttttattgcatttcacaagtttcggatttgaaggttttaaatgtgttttaaataatttatttaataatcgattaagctattcatgctacacattttataactattttgttcgggcaaaattttcccttgtaaaaccatatgaggaaaaagaaaatttgaaaaaagtaaacctatgctatcttagcatctagtgcagagcaaactaaataatggaaatagaacttaaatgcaagtaacaattcagaactattctttgcaacataaaccaatcactcatgtgatcaaagtaactctcctaagaaagtaaggtaccaattagtaacccactagcatttccagtgagcagtgctctacaaaagctcactaaatacataaataggtactaccagagtgaatatttctgtccatagaaaaagtatacacttaaaaatctgaaaaacatagggtctgaaaatctcattaactaaaaccaaaatatgttgagttctcaccaatattttacccaaaactgcagtttatgctctcaattttaatgccattacctgtattttcacatgtaattttacatgtaagtaaaattatctacttgactatttcagcaaaactgaaattctaattctaatgatattcggtttaccttttcctaaaaaagtaatgtctaagcatgcttttcagctacaccaagtagctgaaaagtgtcaaaaagacaattcatcagcctgaaaagccaactgaatagtctgaattccattgttaaaatttaagaaaactttgtaaggaatgatgttcatgccacatgagtatcaaacttataagaaaacttaagaccaagaattaaaaaccatagtatacactgagggtagcacgatagacctttgcgctttacaaacagtggtcttcctggtggtctaggttccaaaattttgaataacctctttcctctgacaccttattgttaacacacgatgcttctttcttccattattaaatggttatttccctatttcttaggtcattcccacagaatctgtggctcaaagtgcttcatggtccacattatcacaatgtgcaggatccacagtcaggaaaagccaaatctttttttttttttttttaaacacatactataccaattaactgatgtcatgttgcaaccagttgtcaactactctagctttatatttctgtgattctaaatactaagaacatattagctaagtatccattagtaactcgctgactaaaaagaagtccagcattgactctgcattatgtttggagatgattactgttatagcacatgttaaaacatgtgcatattcaaatacagcaggcactgagtgtataaaatgcatggaaggacaaagtcacttcacacaaagcaagctgacctttattcttttctccctcatacaaaatttatcatgaaagaaatctagacagaggtgtattagaaattcatttacaactatgattaatctagaaacactgaaactctgaatttacattagaatttaaaccaagttaattagtcaataacagtaataacacaagctaacaattacatagcagctaccaagtgccaaacactgttctaggcatttacacatatgaattcacttagtctctgcaataatcctatgaggtgggtaacatcattatgcccatttacaaagaggaaactaaggcaaagagagattaaatgacttgctcagatcacagagccactaaatagcagtcaggatttgaacccaggcaacctggatccagggtctgtattttttacaatactgttgtctttagaaagcccttgaacactcaaatattttgcaaaaagtacttaaaagaatatcaaatgttaatacattaaaataagaatacactgtgtagctcctacaacaaaaagttatccctacaaaagaaagttatatcgattactgcctacttctattataactaaaatatgagtttcacagttttaaaattatacaaacaattgatacttgagggcaggcgtgatggcttacacctgtaatcccaacactttgggagaccaaggcaggaggattgcttgaggccaggaattcgagaccagcctgggcaacatagaaagattccatgtctataaaaaatttaaaaaattagctgactgtggtgatgaatgcctgtagtcccagctactctggaagctgattctgaggcaggaggatcacctgaccccaggagtttgaggctgcagtgagctacgacctaccactgcactccagactgggcaacaaaaagagacactgcctcaaaaaaaaaaaaaaaaaaaaaaaagaattgatacagttgatacagacccactatttcatcaaattactaagcctaagccttatatcacataagaagtataacggtcatgaaaagttaacttaaatgaatgctagtgtttaaattttgaatcaaaataataagattaaacatttaaagaatgccattatagattaaatttaaagaagaaaactgcatttccaggagtaattctgagaatagtttttgattacctacctctccatgactgaaaaagaagcacaacactgtaaccaggcctcctaatcggctgccactggaaaagaagaaaacataaataacaaaaatccaggtcaatcctaagaaaaatgttaaaatggcataacatcataacctctggtattataaaagattttagtcacactagaactctcctatgcttatttataaaatagtttatttcctccaaagtattagtcaaaataatcttttttcatttttaaaaaatcatttgctatcttcaatatgtatagactcagaaaagcacgcaaactgaaagggaataaaaaattcttactagtcacattgctgtacatcatgcaacctgatttttctttttattttctttataacctcatatttatttatgtccttcaacatttctcaaactgctttccttgggacagatgacatacattaggaaaaagggtgagaaagacgtgcaaggaaagggatccacggtcatgaggatggaaaaccccacactgcctacctgctcctagaaattcacaaggcacttccacacattaaagatttaatttcatatttcccaaatcccatccccaagctacttttctgcagaatacacttgagaaataccagtttatgaagttttatgtttcatttgttttcaaaaactggaatagaacacaaatatcaaagtatgacaatcaggcttataactctagataagaaattacaatggtgcaatctagtagttctaacaattaaccttcatttgctcaggtaagagtgaaatatgttccctactgtcccccaggtctgggtaggggacataaggctatctttaggtttatttcatcatgttctgcatctttactcttgaagtcttcttactcattttagctcatgctgctttcttattattctacccaaatatccttccttcttttcctctatctaccttccttctatttctctatctataagtataccacagagaggtcagagaggaaacaaagaaccagatggtataggcatcaaaggccttgtatttactcttgtgatgtatgaatgaggaaaagaggaagagatgcaatggccagcagggataatccacgtagggagtatccaggagacaggtagggctgggaccccagcacaggtggcctgtttgccttggcaaaagaggaggaagactgcatatttagtggcaagtactttgtggagtttccatgttccccacagagcagaagacacagccactcgctgctagagagaaacgatggcagcattaaacgtttgaggaaagacagaaatgtctgaaacaccactcacatttcaggagagtggtaactggggaaaacacagtgctgctgggatatcttaggggaacaactgaggctgcagaacacaaatctatagggtcactaatcataagattgtgtgatttttgcctaccaattatcagcctagaaagcacaaatgaaatataaaggggcaaagaaactgaggacattggccagaaagtgtctgaagtgatggatcactgaaatgagagcatcagatagaggagcttagaaagcagtacaggctaggaagtggacgccagggttctctcctgaaaggtgtaccacatcttcaaaagagaagcacacaggctaggcccaggcttcatcacaagtgattagacattagaaaggttaagacagagttaatggtttagaaaacaaataaatacactttagtgttttgaacttactctaacaagacaaaaaatatagtttatagggaaaaaaatgtgattttctcttgctaccctctcccaatcctattcacctaagaacattttagtatgtgtctattcttccaaatctctctctctaaccgcacaaacatatattttctgtgtgatcatattaacatctaaaatttgttccttttctaattattcagcataaagattattcctaatcaatatatgtaaagttaaagggattctttttatagatggcaaatactgtatagtacaaatatatttatttagcccattccatattactgggcatataaatatttttcaatttcttgctataataaaaaatggtgaaagtaaacatcctcgtacgtgtaaatgctggcgcatttgtttcaggagggatctaactgtgagacacatgagtcaaaggatgtgagctgtgcccggaagcactgcagcagtccacaccctcgtcacagagtatgcaggaggtcatttctccacccctcgtgcagcacctcatgtgtttttcaaaattttgtccttaggcaggtgaaaacccttttctcactgcctacttgtatgcagcatcattttagtgttttgttttgacaacatgtattttctcttccgtgaactgcttattcatattcttgtctatttttctattagactatttccctacttaaaaattaaggttatcaaacctttgactgtcaaatgtgaaaataacatttaaaagctgtccaaaaaaacaaccactttaagccttcagaaagatgtaactgtgatctgagtcacatatggttacaacttccattctcagattatagattaacttgctttcttatttttcttgttcagtacaatgactacagaattaaacactgtcaggcacaaaaacttcctgccttttttttttcccagagaccgggtctcactttgtcacccaagctagggtagagtggcacaatcatggctcactgcagcctcgaactcatgggattcagcaatcctcctgcctcagcctccagagtagctgaaactacaggtgtgagcctgcctttgtagttaataacccctgttaaagattaactttccctgtgttgttttactttgcttagatcagactatagaaaacctgtcattattataccctctgtttaaaaaaaaagttaaatgtacccttccccaaaagaaataccacctataaccaatcaaactgctgtgactatgtgccaatccgtatgaataatgttgtattcctgctaaaaatgtctctgtctctgcccatataaatgaaacctaaatttccctacttccaaaggctgacttcattcctttggagttggtgttcctgagtggtctaccctcacactttgtgcttgaataaacgctatttagattctgatccttttgattattttaagttaacacatatgtgtgacaaagtattttgatataatttgttgtgtattctgtcagaaagaatttttaaacttttatgtatttaaatatgttgatattttcctttatttcttctgcactttctgtcttgtctctgaaggtcttccacacctcaaaactatagtctcctaaaatttcttctaatattattaactgcattttccacttagctcttccaccctaattttgaactctttgaaatacccaattatattaaaatcatttatcacgtaaacatcccttttaccagtgaaatgaaattcagcctttgtcttatattaattccttacaatgatagactctgttctatttcattcaactgactgaattctttatttttttgtatcacactatttttattactgtagcattatggtaattttaacacatgattttaaaaagctccccacccccaactactcttatttttaagattttttaggtaattcctaccaacttattcttacatataacatctgaaccagtctcccaaccctgctccccaacccaagaaaaaattgtcaggcttctgatcagaatgacattaaatttatatataatttgggttgggaagggctgtcatttatatgatggtcattcagttgcacagtatatttctttccatttactcaattctaattgtattcctttaaataaaaatttttggggccagccacggtggctcatgcctgtactgtaatctcagcactttgggaggccaagtcgggtggatcacttgaggccaggagttcgagaccagcctgcccaacatgatgaaacactgtctctacaaaaaaaaaaaaaaattagccatgtggtggcgcatgactgtagtcctagctactcaggaggctgagagtcaagaatcgtttgaaccaggaaggcggaggctacaataagctgagattgcgccacggcactccagcccgggtgacagagtgaaactatctcaaaaaataataaatttttttttggacaaccaatgtaagagtcaagtaccaagttaaacttctagaaatacaaagagaacatgataaaatctgatcacagtggaaaattttaattctttcataatctgacaggtcaagtaagctaaaggaaacatattagggatctgaaggagataatcaacaagctcaatattgtgactatacagagattacacatcattttcttatgtcactgggacatctagttgcaaaggcacctcattctctgattagaagctaaaacaacctaaaacacaagaaagatgagttttttaaaaaatgacacggggaatttaatgtaaaatttccgtttaaaaattctctggaacgaggaataaaaatggaaatttaataactttaattttctaaatggcagagtaaaggtagagaaagaacaaaagactcacaaatccaattccctaaccaaatctcaggacgaggtttgcctaagaagtcgcacaccctcactcagctgccatacaacctgggaggctctgaggttggacaatttcctgagggcagagccactgtaactacattcctttttcaccaaattactaaaatacaggttatggtccaacatcttccatgaatatgggctcagctttgcttaactaacataagaggcagattttttctagtacacttttgagaactgcaaagctagaggaggagaataaaatttgtttatctacaaggaatgttctgagttagaatcactgtgaaatgatatgacttgaaacaaatctaaactagtgttctcgacgtccaccctctcaccccaatgcatacaggctactaagtaagtcctgttattttgctaaacagaaaagatgcagcaatcagaatacctaaaattttaaaaaaaatttttcccattatagttgatcagttgacatttcagcattccctagtggttaaaaaaaaaaaaagtctctcctgcaatattaccaccaactgtcagaaaatatgaaagctcctattgtgcaaattttaaaacattctaagcttgctaaacatttaccacatttactcatacatctcattcacctaaaccttgatttttcttagacataaaatgaggggataataaaaaataaagctaaaaaggacctaaaaatactttacagttctaaaatttaagaatgctataattctcttctttcctacctactatagttgtatagatttaaatcaattatcaagttttgataggtttcattaatcattgagatttttatctctatttacaaaaatgatgaaccatccaaagttaaacttttgaagagaaaaaagtaatcagagttcattcaaaactatattaaataactcttacgagttaagttttcttattgttgtataaatgcttaagaaagagaaaatggagaaaaatttggaaataaccaaattaagataatttccaatcttaagttggagattgaaggcttgagcatcttcctggcccaatgaagaaatgccaagcaggcctggttcagagctgagaaccttcccctatactcatggtggcagggggaggggggattcactggttactaaggaaagagataggaaagaaagatgaggaataaggataagaatcaggaagggtgagaaaagttctcagcttggtcgtttccagtctgtttcaagcaagtcattaacgcctttaatttaactctctatctgccagttctaacagaagttttcatttattagattgtgaactcctcaattcacccatggtgccaaggaccaaggcttgtccatgaaagagagtgaaagggtacctgaaaacagaactgttcaatcaaaagactgctggcattccttttttgaaagcttgtagccaaacacaccacacctcatgtcacaccaggcagggccatgtgttcaggtgagcctctgctctgacccaaccaccacacccctcaactcctatgcagacctctccactgtgtgctccaggcccttcattccatggtgaacaactacctatccaacacccgcagcctcttcccagatgcttcctccttctcctgcctggaaatatcactctcctctgaacaaatgcttcccctggagcctcccctacaattctgcctcctagtatcccagagtctgtccacttccctccatcccaccaccatcataccagctcaggctcccatcgtcttcccctgggctgctacagcctccgacaccccctacccaaagcctgctccctctacactgcagagtgtgttgtctttaacaatgaatggacccaatcccactccatgcacacagcccttcaatggcatccctgcccacaaggtcaaatccaaacaccaaaacatatccgaaatgcctcgcaggatctggcccctgcatacacctcaactcctttcactattcttcctcctacccacactctgctctccagctacacggtcctcatcacagttcctcaaatgataagaccacactgacaacagtgtgcagagcagcctgggagcaagactggtggggagcagagccacatgagctgatgcagagtcatcccagggggatgggctggcagagaagtggaaggacgccagagatactctgaagcaggacagtaataataggattttgtgactccttggattacagaggaaagaggaaagtcatggctatctcttagaggtcagactgggcattagagtagacagaagtgtcatttgctgagagagtgaaggcataaaaaggggaaggttttggagaaaagatgccaatactgccaaccaataactttcatcaatttatgcatattaaataaaaatacttatcttttaaatattcatatacaactgttagaccaaatggatttgattaaagatgtgttagcaggccaagttaatagtacattaaaaaaaaaatgtagctggaaaagtttgagatggtagaattcacagcctatttaagacgtgtttttagccaaaaatccaggctgtataagcagtaaatgcttgattttttgaaaataaataataagaaaatatcatgtaaaacaatggaagcaaaactggcataaaatttaagaaattcaacttttccttaaaacaggtggagggcagtggaagagtggaaaattaatacaaaacactattccattctgctacagagcctaagaatacctcataggcaacttggttggatcatgggaagagaaggtagaaagattaactgtgttaatgatgactattcactccagatgtaaagggggacatcaagcaaaattaaaaagggctttgacatacagactaatcatccaggccctcagggcttctggaacatatctagaaataaagcagcttaaaaaaaatctctcaggtatcaaagaaaccactctgaatctccaatgaccaaagaagataacagagaacagaaaattggaagatgaagtattgtcctctgactagccagttccttatgtggaagaaaagggattttctgctgactacttatgtctacaaaaggacatccaggcttttctcacaaaagctcagaaacaatggagaactgggtagagacaagggcaaatattcaaaagtgggggagaagatcaggaacagatcaacagaggggccacagggactctgggcagcccacattaaatgtagagaagttcatgaaaaagatcatttaaaagttctgttcaaaaagcgacctcatcgccagagaggggatgaagtaaggaaaagggaacactgaccctgcctcagaaagtgtgtgctcagccctcacgcataagtgtctgcatatgaccaggggtgagggggaggagtagtcaatggcactgggtgtcacttctgcactgacgtgaagaatcagatatgtctcccggactctggccacaggcagaagcagctgaggctggtaaactaaaaagcaacaacatgaaaggagcctgagtctccctaaacaaagcagtttacagtctcatcatgctgtaataaaagccactagtcagttaagacccatccactttgcaatcttccaaccagctcctcattcttagatacaaatgtcaagctaggaatcagcaggctgttggggatggaagcttccaatgtgaaaaatagaaactaatacaaattgaagggggacctagaggtaacaaagacaatgcaacaggcagagaaattttcaaactcaagattctttaggttggaaactaacagaaatgacaataaaatgtaaaaataaaataagggagaaaaaccctgagaaaattcgacttcaagaagtccaatatcaataactttcaagaaaacaggaaaaaaaaaatggagaagagaaagtcattagggaaataatactaaaaaaagttttcctccaaagtgaagtaagtgcccagatagagcacacaaagtatgcgatgagaaggatgaaatatctaccacatcatgaactttttggggactaaagagagaaagatgaacccaaaagctgccagaggaaaacaactaaccacacacaaaaggaactaatggtagaacagcaccagacttttgaaaagctacactccatcttagaatacagtcgaacaaagcctttaaaagtctgaggaaaaataaaaatcaacaaccaggcaaaccagtaatttagtacaaaaataaaaaaggaaatgttcaaacatgccagacaaatgtattttaaaactatctctgtgactctcttggaaattacctgaggatataatcctcgaaaggatgaaacagaccagaaagagaccaacctggggtccaaaacacaatgaatccaatgccagagaggaaaggggaattctcaggatggtggtaaacaaaactcccagggaatcgctatacggaagcccagggaaggacgggtctaggatggaaccagagacagaggctccaggagggaggccccaggggataggagtgggagaattgaaataatggattttatacatttgacaaagtataaaataagcgtttacagttcagttgtagatctggagagcaattaatcagcatacagaacaccaaggaaaacaaaatattagcaataattaactacaggaaaaattttaagttaccaaataaacaattatttatactacttaattcagcagtaagcaatatttttacagtcataataacgtaactgtggactattgttttacgtatcagaattgctgagatttcaaagatctgaaagtggctttccctagacaaagggatagatggggtggggaagacagatggggcaagggaccactgacgtacttgatgataaaaagttgaataatgccaaaagatatgcatgtatatataaagcagtgaaaattcagtttaaaaacatactaataagtaatatacccattgtagagcacattaatagaaagaaatttgttcaattacttatttggagacctcttgatatttgtcaaaaaatacttataaggaagaaatcataaaaatgttccagataacattaaaatagatgtttgtattcaccaccaaaagaaataatacagtatattttaaccttggcttgaaaacattaaagaagaaccttccaaaaaaaaagagaaattttccatactgaaattaccaactacaaactaccagaccatgcgaaggtatggagttacagtcatcttacctggagaatgaggagtcggggaaatgtgtaatcgcaaaagcagacatttaagaaaccgccacccaacacgctgtatgttacctttccctccaatgtgtcgttagttcaataaatgagtctaagtaaaattaactgaggaaactattagaataattataaaattacatgtatgacagctaaaaatggagcaaaataggatcctgaaaaatgacaatattagaaagagtaaacttccacctatcaaaccaaaacaatgcatacagaaatatcagctgaagaagagcaaaatcctgggacttcagaatccttcagaaatgaattattacagaacagtaatattctggaacatgagaacagaaaagagaacggaaagtctagatccttcttagtgtcgtgtatctttaaaacattttaacattttaagtaaaactttttatgaaatataaatactcactttggaaatggaataaacacttttttcttcattatgcaggatctttaaacaaaaattaactaaagctgcagacaatttaattgctgtggaaagaacactttaaatgtattctcaaagacagtaggccaggcgttgtggctcacgcctgtaatcccagcactctgggaggccaaggcaggtagatcacgaggtcaggagatcgagaccatcctggctaacatggtgaaaccccgcctctactaaaaatacaaaaaattagctgggattggtggcgggcacctgtagtcccagctactcgggaggctgaggcaggagaatagcataagtaaacccgggaggcggagcttgcagtgagcctagatcataccactgcagtccagcctgggcgacagagcaagactccatctcaaaaaaaaaaaaaaagacagtagagcacacactttggagccattgtcagtactcaaatccctactctgccaatgactagccctgtgaccttggcaagctatttaatatccttgtatctcagtttcctcatctataaagtggtttacctatctcatctggtaaccatatggattaaatgagtttctgattgtaaagagcttagactacagtctcacacataagcattttacacatactgaatttctccaatcaacaacagtcttcaagaaagattggaatctgcagagggaaagcttcagaatgagtccactggaaaaatacttcctaaattggtaaatgctagtaaagcttatgtgatagataatatatttttattgtgcctttcatatatggcaaccataagctaagtttttctttcaatattttattaattatgaatttattcaatcaaaaaatattttggaaggcaagcattcttctgggtcctttgcaaacactaccttattccattctcacatagaagacagagtctcttaaactcatttaggtgttctcccctctactcaatcacttctttaaaaattgtctataatcttccattttagttaacctaataaaacactgcacctcccttttacaaccctaaaagacctctgttactttatattttcttttacatctaaaggcaaaccaaagaactggcagtcactctaagttctgctcacatcatttattcaaattatataagaactcaaccttaatagattccacccacaatttagagcttctatacagcttttttcggtcttctagccttaatcatgacagcctaagtttgccagacatctaaggaaagcacctaacatggaaggtagagaccaaaagatgtttaaaaaaacaagctaggctgggcacggtggctcagacctgtaatcccagcactttgtgaggctgaggcgagtggatcaccaggtcaagagattgagacaatcctggccaacatggtgaaaccccatctcaactaaaaaatacaaaaattggctgggcgtggtggcgcgtgcctgtagtcccagctacttgggaggctgaggcaagagaaaattgcttgaacccagggggcgaaggttgcagtgagccgagatcatgcgattgcactccagcctggtaacagagtgagactccggctcaaaacaaacaaacaaacaaacaaaaaaacacaagctagaagatgccaagattattctgggagggtaaaaacatcattaatacccttagagagaaaatgtgttgaatccatgaaacaaaaataaaatactattttttagaaaggaatgtttatagaacaaacaaaactacttggaaattaaaagcatgacaatgaaaaataaaaactcattagaacagctggaaaaaataaggctgataaaatgttctagaatgtaaaacaaagccaaagagcttaaaaatggggggaaaaaaagaaaataaaataaaattagaggactgggaactatgaacatccaaacaataaaagttctgaatcagaaaacaaagggaatgaaataagtatagaaataattcaagaaaattcccagaaatcaaaggcatgagttacaagactgaaacaacccatcaagtgtctaagagaacacatgaaagcagatctacactgagatggtattgctctgaaatttcagaaccatagagacaaagaagatattctacaatcttccagagagaggaaggggaagcaaaggtcacatacaaaggtttagaaacccaaataacttcggaacatctgaatggcaccatctgaagcaaccgacaatgttttcaagtctagagttcaatacttggccaaacagtgaaccaaatacgaaagcaaataaagacattttcaaatatgcaaagtttcataaatgtttacctcccagctatctactctcaagacctacttactagaagatgaagtctaccaaagtgagaaaataaaccaagaaagaagaacaaacaggataagggcacaggagatccaacaggggagagcagtcaaggaaatcccaatgagatgccaagaggacagatgtacacaaaccatggaaggtagccagtccagaaccaagtacttactgactcatgcccaaaatctccacattttatttgtgtgagcctggatgagcctggaccagattcttgtctgtattttatcttggctccaaatgctttactgctggcatcagttaaagacacttatgtcactcacagaagttgttctgctttgatatgctccagagagccagggtaaacagtggtgaatttagaaagagggaacagctcttcccctcatgatatttctgctggatattcagtacctggctactacatttctgccagatgtccctaccaactgagtcccacatttatcccaggactagctcatgaccttgcctactgatgtctttaggaatcaggctcctggttgaaaatctatatgggatttctcaggcctggccatatgcaaggctttgcctggcaggcctcacagggaaaagaagaccttcacacaccaggcttggtgcagagccagcgtactgtagtctctcaggggagttgcagtcaatgactcagccatttctgggtgataaagctcttcttatatttgccttcctagcccaggcacctttatttcctggtcccattctctgctggcagagaggggctccttgaagaggttgctccccactctgactcagactctgcactctttggctcctggcccttctcctttgccccaccacctcaagaaccataaactgcaggagccttttgttcccttttgatgggggtgagacatcctgatcgtcacatctcacttataccattacagtaaatgattaaaggcttaattctcacttttgccttgtcgctttaaccagccactccaatacctggcagctcagctccctcccctagctcagctgtgctcctgacagcctcagaaagttccctcagggaacctaaagaccatgactcagaaattctcttcttctgggaactttcatctaacaagggcaatagtgtcctccccttaagcagctaggtttgtgcctgatactcagtttttcaaaactaaacacaccatatttaatatatacacatgagtggcataatcataaagaaaaacaaggaaaacattggtccaaaagttaggatgccatttcctctgagggttgagggaaggaaagagaatgcattaagaaggaattttaagggtatgaaagctctgataatttatttatttttttaatctgtgtcatgggtatgtaagtattcattttactaatctttaaaaatgtatataaagattttacacaattccatagtcgtaacattttacacataaaaaagtattttttttactagttatttatttactgggtcacagataatacactcatatgataacaatgcataaaataaagtaaggaatttcacacagctgtttctgacaagagcctcaacataaactgaagggataatttaaaagttccagtaaaagtattgcatgcggtacaataaaccaaagtccaagtaggcagcagtgactgggcagctatcagtcaataatgagacactccacaggggcattgttctgtctgccccaggatgactcatcagccacactcactgcccactgttttctccagaagacctcctctgacggcacttgatctagatggaatcaaaggctaaagagtctaaaaagctaatgaggtattttgggggcaacctcggataggatactgaatgggaaagaactcaaagattctaacataagatctaaaaatcaacttaagtacttttataattctaagacatttctcttaccttagggaaaggaatttttgtctatccttcagctccagttttaaggagagtagtaggaactctgaagacagaggcagcagtaatcaggggagaacgctacaaagaaaatgaagttcaaaaagacagcaccagagtcctctctggccagtcacagccctggtctgtgaaaaccctgggtggtttcatgcatcatttcaccatcctaagattcaaaacaaatcaagcaatcaaaggcagggctgctaagtaagcagctgcacaagcagagcagtgggagtggtgaatgggaccagggcctcgctgctggggagaggaggaaggggtgggagactagatgggaatagcaaagggacccaagggaagtccagttaaaaagttttgttggccgggcgcagtggctcacgcctgtaatcccaacattttgcgaggccgaggtgggtggatcacctaaggtcaagagtttgagaccagcctgaccaaaatggtaaaaccctgcctctactaaaaaaaaaaaaaaaaaaaaaaaaattagctgggtgtggtggtgcacgcctgtaatcccagatactcaggaggctgagacaagagaattgcttgaacccgggaagcggaaaatgcagtaagccatgatggcaccattgcactccagcctgggcaacagagcgagacttcgtatccaaaaaaaaaaaaaagttttgtcttaattttgtcatgtgagaggggaggtaagggatgaacacattctgaggcagatgggaaggaaccaggaaagcaagcctgaaggacagcgacgggcaaagaagaactggcagccagtagggataaatctaacacctacaaaggaatgagccttaaacaaaggcacttttttcgatgtttctctgatcccaccaggcctctgtatcccagtattgtactccctcttttatttcagctagtcagtatttttggcacccttttcaaaagagaaagaaaaaaactcctgctcagaaaccctgttattgtttgtactcatccttacatagcagtaaaatttataatacacaaatttataatatataaactttatatacatatgtatttttccagagaactgttaaacatatacattatttaacagcttaatacactatccaatctattcttcctcaacaatgcaccataacctagctaacctcgaattccaaaataatactaaaatcacactaaagtacaaagaaaagctttagaatcacctgcttggtatctgccttagagtccaacgccaaaagttttttatatttatcaataagggaaacttaagcatatatgaatttcctccagaagaaactatggggaaagttcgaactgcccaacaaccaatgctccttcttacttgcagaacagagatttctacacattgggtcttaagaaactggccttcagaaactgttagtctgtggctaagaaatatcagggtatcttatgaaataaataacggtaagtatatatcaatacagcttcaaaaaataattaacaatgagtatttttaaaaaaatactaaaatactgagaattccagaaaaagaattataccatgagtaggctgtgtttgcaaaacagatctcacttcatcttctcaagttagagcttggcagcctggctccattcatcatttggctgttttctattttcccttcttctatttctggtgaaatggactggcttacatggcttctaaaaacttacatgtatattatttcaaaacaaatatacttctgaatttaagatgtcacagtcaatctgcccgcaaatttctaatctgctagacaaatctcaacttttatttctcagtatataatacaatttattttttcaatcctaaaaacaactttagatatcctcctctttatttttaacccatattttaagaagtctgcagctttatccctctcataaaattacaagggtgactaaccatcaaggaagaaaatattaagaactaactagtaatttgaaacctctaaatgtacttcaggtcaaaaaacatacaaaaatgcaatgaaaaacactgatagaaaagaagtgataagagactctattcaaaataatatacatcaggatcaattgtgggaagaaccttcagtttaggatgcctttgaatagagctaaagagatggttccgggttaagaaaaagcccacaaacagcaaaaggaaagctggaaaaatgaaaacatgtgctgctagtgcagaccaccatggggtccaagagttgggtaacacagaaggggccagctaaagcacaaagcagtcaagtgggcagagtgaaacaagctatagccactgacactggaagaaccagagacagccatctggaaagacccaaatgctctaaggtaaaagctgccctcatgccaccttaagcagtagtctacagacttttttacaccaaaactacagtaagaagactttacacaactcagcacacatacatatgtgtgtgtgtgtgtgtgtgtgtgtatatacatacacacagcaaatggaagtttctctaagtagtatctatccttactagtctggtagatgatattatttactttgtagtattttttttctcatctaaaatgaaatgggctcaacccactgaatcaattttaaaactctcaaataagtgataacctgcaatttgacaaacactgtgctgaagtagtcactgcttgactttggggactggggaaagtcaagtgttccatgagatcatacttcagcttgaatcctgttcttatactggtcaatttttgtatttatttcacttgctttggaataggtttcaactcagtcagttaccaaggcctttcatcatccagcacaaccactgttccaatctgaatcccccacaacactccctgaagaacatgcttactgatctgcttactacctgctttccacatactagattttggcctttgcctctccctggtatgcttttatcctcatggtttatttccacctatccaaatacctctgattctacaaggtcacactaaagtagcccctccatgaagaacaaatttctcctgcctctggagttctaagcactttatttttccttcctttctatcttccattcacacacaccctgccgcactcccatgctctcagagcccaaacagtcttaagaaactacttggtatgaattgtttgtgttgactgaacaactgaatacaaaaaactgcctaccaggcaccacaggggttaaacactgagaaagatcaggtcagggccaaaaccaccaaaaacccctcaatcgaaaccagaaccttctattctcctcagtagatgttgtgccttctgcctttgaaaaaacagttacaacaagcattacaagaaaatatgaatgctttctttaacagatgtttacaaattcttctttcaattaaaaaagtagccaggcatggtggcacacacttgtagttccagctacttgggaggctgaggcaggaggactgcttgaagccagtggtttgaggctatagtgcactgtgaatagtcactggactccagtctgggcaacaatatagcaagaccccatattttttttaaaaaaggtagcataagtgcagattagcagcttagcaataatgccatgtttcatatttcaacttctcttatgtaaaatctaatctcccaaatgtaataaagctacccatagacagacgggcagtacttagcaaaatgaacagacaccaccaagtttctctccctctggctcattacgatgcaagcacacaggcccactttccctcaagtcagcctccttttctcattaccatattcttttggtttaacttatttccctgcatcttgtttcaaaaacaaaatctttcacatcatcttttaatcatgcatttttattttagtctccccaattaaacaaaagaattttcttagacctaagtcagaaacattaacttcaaagtgtcttaaatctatatacaaatatattttacatcaatcttctaacagcttcctcatttgataaatgcttatcaagtaactgctagatactcaaatggtgggctagaaactcaacacatctttgaggtactaaactgaaaataccacacttccaaaggaaaggagataatgggataatagcaaattcaaactcattatcccgaattgaaaatcatatacaattctcataattctgtactacaaagaatcaataagcagcaaggaagaaaattctaaagataatctcaaggcaaaatacttcaaacatacatacagtataataaattggcaaaacaaataagaaagaagaaaagtaaacataaaaagcctgaaaaaattagtcttttagttttaggaatgctgctcaactgtaaagtaaatcaggtcagatattaaatattgcagagaagacacttctaaatattgcatagaagatacttctattttaacattagtaaagagctattaatatcatttgataatgagtggtcttttcccttatattttatgtaaacaatatatactggatggagctgaaacaatctacagccattgacattggaagaagaaccacatctggaaagacccaaatgctctaaggtaaaagctgctccctcatgctaccttaagcagtagtctacggactttttttacaccaaaactacagtaagaagtaagacttcacacatctcagcacacacacatacacatgtacatacaacaaatggattatattgttccataacaatatattagatattccataacaatatatggaatatatattgcttatgttcaaatgcctatgaatatttaaaatttatgccaggcactgtggctcatgcctgtaatcccagcactttgggaggctgagatgggcagatcactcaagcccaggaaattgagactagtctgggcaacatagcaaaaccctgtctctacaaaaaatacaaaaaattagctgagtttggtggcatgcacctatggtcccagctactcaggaggctgaaatgggaggatcgcttgaacccaagaggtggaggttgcagtgagcagagatcacactactgcactccagcctgggtgacagagtgagaccctgtctcaaaaaaaatagtaattaaatttatcaagtattcccaattctatttacatctctaaaactatcttaagtgtgatgggccatggcagtggtgaaatcatgcaaataatgaatgattttatgataataagatattttaggatattttcataaaactgaactataaattaatcaatgattaactattaacttatcaactattttattttagtatatcttataaacacatactaaaatattcttaccttaaatatgtgccatatatgaagaataatgccatcattagtccatttaaaataaaaattacagcaacatagaagcaagcaagatctcccaatcctttaaaaataaacaaaacatatgttctaatcacattaacccaaattaccttatgtgtctagcaatttatattaaattgtgttcattttgaaaatggttgccagatacattaagtagttgccttggttcccacatgaaaacccaacactgctgcagaacacagatgagatcagggcaattagcaatgatggttttaaaacagggctgcaaattcacggatacgtctcctctggaggtatggggtctacagcccccatttttgagtttcagtgggcttgtgactcaacagagtacggcagaagcaacactagtgacttctgaggctaggtcataagaggtcacacagtgtccagcttggagccttcagctgccataggaaaagccttactactactctgaggtactttgctatcataaagcccaagtcacccagaaaggccacgtgtaggtgtcccagctgacagttccagttgagctcagcctcacagtcctccatgcccaggagccaaaatgtgagcaatgcagcctctcagttaactccagccttcccagacatttgagtcttagtagcagaggtccctgaaatcatggagataaaccagccccgctaaagcctgcccaaattctggacttgcagaatccatatgcataataaaatgggtgttgcttacaccactaagtttacagtgttaagtttattatgctggataagtttattacgttacaacagataactggacaatattacagaacgaaacttaccttcacagctttcagtaggactgagtccttctcctctggtaaccgtccgacatatcttggtttgaattgcaatgaagtccattattttggtataaatccagtaccagctggccaaaattacctatttttaaaaaatatagtggtatcttaagaaaatataccaaacaattttcattactagaatacttttgagatattgtgacaattgccatattttccctttctgtaccatccacttggctccctttaaatctagtaaaacgaggctcagaatctcctaggcagattcttcactggtcagttttcaattgttcatccatgggtaaggacaaaatatgggccaaaaaaaagtgctaagtttatgtttttcaaaaactatacaactctactaagagatacaaaagaggatttgctcaagtaaaagatactgggtctactggaatagaccaaattatttaagatttgaattctccctcaaattaattgataaacataaaataattctaatcaaaattccaagtgcctaaaatgtatctagaaaactaacaagaaaactaaagggaatgttttaacagatattaagtcttatcacctttaataattaaaatagtgtgatactggcacaagaatggctagacagatcaatgtagccatagtacaggtggtgataagccaccccagatgccctcttccaggctgaggcaatcattcctccagctagttggaagactggtgcctgagagctcgaagctgtgtccctccctgggaagaaattaaattcactcaaagtgacaccccctacccaagggcaatctgcatccaatgacggacaagtcaatagggaaagataccaggggcccttatgtcaaggtaggacaactctgcaaggccatcccagatccagagctgcccagggactggatgaggccttcacagtgactgcatcaaagctctcctcttcctcctgcctattctgcttcattcatccctcttcaagtgttgaccctaaggacactccctcaactacttcctgcatgcaaatctccatctcaaagtccacttcccatgacctcaacctaagaaatactgagcacaaaatccagaaacacatgaaagcacgtatgtataacaattttgcacataaagaagaaagcttacttcaaatcagtggagagaggatggacacctcatcagtgttaggttacacacaatactattttcaaagaaaaattcaaggttagattcctaccccacactatgcatcaaaaccaattccagataaattaaaaatgtaaatttaaaaaaagttataattataaaaatgaagttttttacatgtatgtataaaagacaaaaagattcatagatatatttctgtataaaaaaatacacagacatcatacacaaagctaaagggcaaacaactgggaaaaatgttttattatatagcattatattaatatccagtatataaaattttaatagaaatatagatgaaaagcatgaattggtaattaattttaaaagtaaaaatgcattatatgtatatgtatgtgtgttatacatacatatataaagaacactgaaatatatctataatcaatgaatgaaatacatcatgtgacttcaatttctttgtctatccaatcaacaaagatgcaggtaaataaatagtttcgaaaacactcctggtggatagttgaatatctatccggaaggtcttctgacaaaatcattaaagtatatattctactgaactagagttccacatcaacaaatttatagttttgcaaggaggataaaggaaaggccaaatgccatctccacttgctggatcgggctcaccttccctccactcccactcaagaaagtgcacttaattaaatgaggataaggaagaaaacatttaacaaatgacatataaaagtaacagagctcccttagtataatccttgtaagcacaccaaatctagtttttgtattttttaaacaatgcagtcacaacaacagttccccacagaattaaagccccctcctcaaaatcagtaatgatgttttttacatattcctccccaagatacatattttcttttaaaaaattaaatacaatttaatatattgaattataccttagagttagaatcagcatttaattcaaaaaagttttacaaaagtgaaaaatcacaattggaaaaagtaccttacctcagggtaaagattgaatctttttaatgtattaataacaagggggtattcagtcagtttatcattcataatcatccatactccattcaaaaatgagggtgtttccacaatagtcttgaaataggaataatacagtccctgaaataaggatatgctcagttaaaataacaaaaggtacataattatgatgcctcttcgaagtaaatatactgtttttgaaaaacaaagcaattaagcaactaatagctattaagacaatgaatttcacaggtttctgaccattgataaatcctaaagttgcgaaaaaactacgtattttcacataaacttgtcttaattgaaataactgaatgcaaaatagcttcaacaatagtttcagcatttaaaaaataatatgactcagcatacttcaacttagaaaatcctattacccacactaatataactgttagaaaatgctatcttatgaatagagtgagtggtttcttacggaactaaaatttatcattaaccaagaaatcttaagccaaaaatgctcctctaactgcttatgttaatccccaaaatgacactatcaatcatttttcctccggatttacatggaaaaatgcaaatgtgttgagaaggctactcactgatgtattattacatatgaatttcactcgggtgccacctaattttgcagattattttccctcctatcaagtcagcataaggtaagaaccctgcgtgactggggatgagggtggggagtggtcctattttgaagaaaagagttttttagcttggcacactgctttggaaagatagcaagggtggaaaattacgtgagacaaaacaagaaaacactagaagcctaacggagagtctaagcggcagtatgagggaagacagagaaacacaagataaatctacgtcttgtatttgcatcttcagttttgtctggagctgccctggtagccagtaccagtagctgccaaagtttaaaccgggtttaagactcacaaatacaaaagtgagatgcctacccagaaatttactgaaaaagaaaaaaatggtcttgatactctgatgtattagctctgatatcactatttttaaaattatgtttccttgtgaactgatttggatactgtcccctaaaatttcatgtccaccagaccctgtggattgatcttatttggaaataggattcttgcagacgtgatcaagatgaggtcatattggattaaggtggactctaaacccaacacaactggtaaatctaaataaagaggaatatttggcctcaaagctacaggcacacaggggaaaaggctgtgtgaagatggatcagagactgcggtgaggcatcagcatgccaaggaattccaaggatggccagcagccatcagaggctgagaggaggcaaggaaggactctcccctccagccttcagagacaagatgcccatcaacaccttaacgtcccactgcaagtctctgcaactgtgagagaatacatttctgctgttttaagccacctagcttgttgtacttctttatgacagccctaggacactataccttccttcttttgtaggtttgcttttggaaacatatcaaaaatttaaaaatccctaaatatcaaaataaaaatgaaagaaaggaatgaactatttatcaacttgggagaagatttcaaataacattaagatactgtaattttactgtatatccctagtggactatatcctaaggttaaaatggagcccaggaatctggcacgactggtttcacaagttacaggtcacaaagaccctgctgataatacaggatgtggtaaagaagccggccaaaacccgccaaaaccaagatgacaactaaagtgacctctggtcatccttattgctcattataatatattagcatactaaaggaaactcccaccagcagcatgacagtttacaaatgccatagcaacctctggaagttaccctatatggtttgaaagcgggagacaccctcagttccaggaattcccctccctgttcccagaaaactcatgaataatccacctcttgtttagcatatgatgaagaaataaccttaaaaacaatcaaccagcagccctcacagctgctctgcctgtggagtagccaccctttcatccctttactttcttaaggtaaacttcttttcacttcactctgttggagcattcttgaattccttcctgcccaaagccaagaacccacatggcctcctgggctcaaccccaattctgggggttgccctgtgaagaaccaaactgcacgaaaatcttaaactcttttcagtaatcacataaatgatggctattattattatttttagtagtatttgactatccatttattccatgaccattgcccgggtttccaatgctcttcagacttatttttctttgatcacacgtcagtgagtccatggccaaaatgagtctatctttggccctactctcacattcagatatattctacactttcacctgaacttgggatactccatggattgctggtcctacctcaattatttttcctgcttgttctctgccttatttgtccttctacttcctgagcccctaatttattcatgtgaaaaagcaaaattgcacaatgtaaattctgtgagaacagcttcactctaaggtaaattataatgtcttgtattattcaggaaatgactggatgttgatgttcatatatatcatctactaaaatgatagaatgaatgctttagacactctagaaatagattgttctatttttctctacttgactgatgatttcttgggatcagaacagatattcacaatattaaaaccacagtaaatggttttgtggttgaaaccaatgacaaataattttttgtctttgaatctgatgtcctccacatgtactctctgggatggaaatttctttagtggtactgtcaaaagaagcatcagagagacattagacagagatgacctttccatgaattttaagaggaagactctgatatggtttggctttgtgtccccactgaaatctcatcttgaattgtaatcctcaggtgtcaagggaagaacctggtgggaggtgattggatcatgggggcggtttcccccatgctattctcatgatagtgagtgagttctcacgagagctgatggttttaaagtgttgtactttctggtgctctctctctctctctctctctcttgcctgccccatgtaagaagtgccttgcttccccttcaccttccaccatgattgtaagtttcctgaggcctccccagccatgcagaactatgagtcaattaaacctcctttctttataaatactcagtctctggtggtattcttcatagcagtgtgaaaacagactaatacagagaattggtaccgaggtagtggggcactgctataagaatgtggaagcaactttggaaatgggtaacaggcagagggtggaacagtttggaaggctcacacgaatacaagaggatgaatgaaagtttggaacttcctagagacttgttgaatggtttcgaccaaaatgctgatagtgatataaataatgaagtccaggctgagatggtctcagatggagatgagtaacctattgggaactggagtaaaggtcactcttactatgctttagcaaagagactggcagcatttttttcttttttttatatactttcagttttagggtacatgtgcaaattgtgcaggttagttacataagtatacatctgccatgctggtgtgctgcacccactaactcgtcatctagcattaggtatatctcccgatgctatccctcccccctccccccaccccacaacagtccccagagtgtgatattcccctacctgtgtccatgtgatctcattgttcagttcccacctatgagtgagaatatgcggtgtttggttttttgttcttgcgatagtttactgagaaggatgatttccaatttcatccatgtccctacaaaggacacgaactcatcattttttatggctgcatagtattccatggtgtatatgtgccacattttcttaatccagtctatcattgttggacatttgggttggttccaagtcttcgctattgtgaatagtaccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatggtatctcattgtggttttgatttgcatttgtctgatggccagtgatgatgagcattttttcatgtgtcttttggctgcataaatgtcttcttttgagaagtgtctgttaatatcctttgcccactttttgatggggttgtttgtttttttcttgtaaatttgtttgagttcattgtaggttctggatattagccctttgtcagatgagtaggttgcgaaaattttctcccattttgtaggttgcctgttcattctgatggtagtttcttttgctgtgcagaagctctttagtttaattagatcccatttgtcacttttggcttttgttgccattgcttttggtgttttagacctgaagtccttgcccatgcctatgtcctgaatggtaatgcctaggttttcttctagggtttttatggttttgggtctaacgtttaagtctttaatccatcttgaattaatttttgtgtaaggtgtaaggaagggattcagtttcagctttctacataaggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtatccttatagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcactgaatctataaattaccttgggcagtatggccattttcacgatatagattctttctacccatgagcatggaatgttcttccatttgtttgtatcctcttttatttccttgagccgtggtttgtagttctgcttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggaggttttgggctgagacaatggggttttctagatatacaatcatgtcatctgcaaacagggacaatttgatttcctcttttcctaattgaataccctttatttccttctcctgcctaattgccctggccagaacttccaacactatgttgaataggagtggtgatagaggtttcaaagttttcctttgaaaactgtcttgtgccagtttttcaaagggaatgcttccagtttttgcccattcagtatgatattggctgtgggtttgtcatagatagctcttattaatttgagatacgtcccatcaatacctaatttattgagagtttttagtatgaagcgttgttgaattttgtcaaaggccttttctgcatctattgagataatcgtgtggtttttgtctttgattctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctttttggttgtgtctctgcctggcttttatatcagcatgatgctggcctcagaaaatgagttagggaggattccctctttttctattgcttggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcaaggaatttatccatttcttctagattttctaggttatttgtgtagatgtttgtagtattctctgatggtagtttgtatttccatgggatcggtggtgatatcccctttatcattttttgttgcgtctatttgattcttctctcttttcttactagtcttgctagcggtgtatcaattttgttgatcctttcaaaaaaccagctcctggattcattgattttttgaagggttttttgtgtctctatttccttcagttctgctctaattttagttatttcttgcctcctgctagcttttgaatgtgtttgctcttgcttttctagttcttttaattgtgatgttagggtgtcaattttggatctttcctgctttctcttgtgggcatttagtgctataagtttccctctacacactgctttgaatgcgtcccagagattctggtatgttgtgtctttgttctcgttggtttcaaagaacatctttatttctgccttcatttcgttatgtacccagtagtcattcaggagcaggttgttcagtttctatgtagttgagcggttttgagtgagattcttaatgctgagttctagtttgattgcactgtggtctgagagatagtttgttataatttctattattttacatttgctgaggagagctttacttccaactatgtggtcaattttggaataggtgtggtgtggtgccgaaaaaaaatgtatattctgttgatttggggtggagagttctgtagatgtctattaggtccgcttggtgcagagctgagttcaattcctgggtatccttgttaactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagcacttcgtgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctctttagttgatgcaatttcttcctagccttgatggtctttagaatttggcatgattttgcagcagctggtaccggttgttcctttccatgtttagtgcttccttcaggagctcttttagggcaggcctggtggtgacaaaatctctcagcatttgcttgtctgtaaggtattttatttcttcttcacttatgaagcttagtttggctggatatgaaattctgggttgaaaattattttctttaagaatgttgaatattggcccccactctcttctggcttgtagggtttctgccgagagatccgctgttagtctgatgggcttccctttgagggtaacccaacctttctctctggctgcccttaacattttttccttcatttcaactttggtgaatctgacaattatgtgtcttggaattgctattctcgaggagtatctttgtggcgttctctgaatttcctgaatctgaacgttggcctgccttgctagattggggaagttctcctggataatatgctgcagagtgttttccaacttggttccattctccccatcactttcaggtacaccaatcagacgtagatttggtcttttcacatagtcccatatttcttggaggctttgctcatttctttttattcttttttctctagacttcccttctcgcttcatttcattcatttcatcttccatcactgatatcctttcttccagttgatcacatcggctcctgaggcttctgcattcttcacgtagatctcgagccttggttttcagctccatcagctcctttaagcacttctctgtattggttattctagttatacattcttctaaattttgttcaaagttttcaacttctttgcctttggtttgaatgtcctcccgtagctcagagtaatttgatcgtctgaagccttcttctctcagctcctcaaagtcattctccatccagctttgttccattgctggtgaggaactgcgttcctttggaggaggagaggcgctctactttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccatgtgaggtgtcagtgtgcctctgctggggggtgcctcccagttaggctgctcgggggtcaggggtcagggacccacttgaggaggcagtctgcccgttctcagatctccagctgtgtgctgggagaaccactgctctcttcaaagctgtcagacagggacatttaactctgcagaggttactgctgtctttttgtttgtctgtgccctgcccccagaggtggagcctatagaggcaggcaggcctccttgagctgtggtgggctccacccagttggagcttcctggctgctttgtttacctaagcaagcctgggcaatggcgggcgcccctcccccagcctcgctgctgcctggcagtttgatctcagactgctgtgctagcaatcagtgagactccgtggggtaaggaccctccgagccaggtgggggatataatctcgtggtgggccgttttttaagcccgtcggaaaagcgcagtattagggtggcagtgactcgattttccaggtgccgtccgtcacccctttctttgactcagaaagggaaccccctgaccccttgcgcttcccaagtgaggcaatgcctcgccctgcttcggctcgcgcatggtgcacgcacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctccgactggcagcattttgcacctggtctagagacctgtggaactttgaaataatatggtttgtctctgtgtccccaccaaaatctcctctcgaattgtaatcctcaggtgtcaagggaggaacctggtgggaattgagtgcatcatggaggtggtttcccccatgcggttctcatgatagtgagtgagttctcatgagagctgatggttttaaagtgtggcacttcctggttcgttctctctctctctctctctctctgtctcacctgctgctatataagatgtgccttgcttcccctttgtcttccacaatgattgtgaatttcctgaggccttcccagccatgcagaactgtgagtcaattaaatctcctttctttataaattacccagtctctggtggtatttttttttttgaggtaagactctcactctgttgcccaggctggagtgcagtggcgcaatctcagttcactgcaagccccgcctcctggattcacgccgttctcctgcctcagcctcccgagtagctgggactacaggcacccgccaccatgcctggctaatttttttgtatttttagtagagacgggatttcacttgtgttagccaggatggtctcgatctcctgacctcgtgatccgcccgcctcggcctcccaaagtgctgggattacaggcgtgagccactgcgcctggcctaatggtattctttatagcagtgtgaaaacggacaaatacagactccttccctagacacgagaaccatgatggcattagggatggagttattaatgcataatagcagaaagctctttacctcaacattataaagataataaaggtatagttaacaatgattggacacacactgtagaaaaagaaatgtgtgaattccattagagtattaaattgagcaatagtgtttgcagcaaactatgagcattattctttaatttccactcccattaaaggagagggtggtctcttttcaggtaaagattgttcatctctttcttctgcatgccccatgcagttgtaagctagatggcattctgtatgtcaggaccatttttcattactgcaaaatagtcaaactaagttttaaagaaaagaatttctatcactatgcattgctataaggctttttattccaacatatggtattaaataggagttttgtgctcaattgtgaatttatatgaaaaggagattaggacacaacaggcacagaggaaagatcatgtgaagacacagggagaaaacactcatctgcagatcaagaagaaagatcccagaagaaactaacagaggcccaagagtggcctttgtgtttcacttcagtgctctatgttctggccaattgtctgtcatcttcctttctgtgtgaatgagtcccctgtgggcaaaagcagagaccaccctttggggcatacctagatgggtggcaggcagacagccactatctgtcatctacccaacccccacttacgtccttttccctccacatccctcatctttcaccatccctcccctcctactcaccttcttcaggtagcaggagtgggaggtaggaaaaagcaataaacttattaatattaaagatccaagccacaaacctttgcctctgtttagctttttggtttcagactctttttcaaggcaaaattttctcaaaattatctgctataaaaacaggaattcagagaaacatttacaaactctaaaagtagacagataccaccaccttccccatcctccacccaaccaggctgtgacagtaggtaaaatctgtacaccaaacaccaattcccttgatggtatttggatccatttccaattgagaagcagtcatctatcctttttcattagcttcgccttcactggtgagaagttagtgggaagtaaagactctggaggcctggagttgttgggttttaaaattttatgcctggagggtaagtccactgtagtaaatgcaaagttatttttaaacttaaagccatggaataccactacattatagtaaccagctattttgttaacctacattcattcatgtattgtttgtatgaatgttctgtttccagcataatggcttttaaaaattaaagatataaattagctattattagagaaacagcatgatagtaaaactcccctaaattggcataacaaaatattactaatagactctagaggggacggacagtctctaaagaataaacaaaccattgagtagagaacagaaatcccacccaaccagtaagtgctctatgctgatcttcaaacaatgagttcctgggtcttagcaataaccacaaaaacaactcaccactaaccgagtgcttactgaatctcatatgctttacatgtattactttatttttttcttccaaatgtcacttttgaagaagatacctttaatatttccactttacagatgatgaaattttaaaatgttaaataaattgcccagctagtaaatggtagagcagggattcaaacccactcttaatatatatactattattttgatccccagagcactcaatatagtgttgggtactttaaaaagaattaataaaatgttgagccatatgggggatgattcagccatattgtagggacagaaagcagtaaaagtgacccaaataccctatctttaaaatgtttgtatattttaaccatttattttccaccttattctttggtgcaatgtttgctgagcatctgctatgttccaggtactgtgtcgggtggaaaacaggaataaataatatacaaacccttttattaagtaattcagagttcaataaaagacttcaaaggaaaacagatcatttttaaatgatcaaactgtgtgacaggtggagtggcattagcagatcacagaggggatgttcgggactggctgctggcaggaggggacatctgagcaggtgagaggcagaggtgtgggaggaagacaggttaagaccttaacagacaagggtacagtgggagcactggcaggaaaaagagttgctggaaatttccagcaatttattgttgctgaagcaaaaggtgtgatgtcaggtgggtccctgatcctggagcggaggtgggatgcaaagcatggagacccttttaaggcaccagaggagggagagagattgaacaaacaggagaggtgggtgggtgagggagagaagagccactgagatcatcacaactcaaacaaaactaaaacaagtgtaatacatgtcccttgagttctcttgctttctcccattttctattaaaacatgtgcaaactagcaccttaacactttttgtaatttcatgacaaatgctatcatatttcatagccagcagatggcactaagtatacataaaatgaacattttgcacactgtcactttttttttttttctcttgagacagtctcactctgttgcccacgctgcagtgcagtggcgcaatcgtgtctctctgcatcatgggctccagcgatcctcctgcctcagcttcccgagtagctgggaccacaagcgcctacctcctacttattttaaaagagttcaatccaggctctactgttctcaagggacttttctccatactaggaactctaaaatctgacaatggtctggatctctgagataggcaaggcatcttgtaggtacagggtcctctcttctgccaggggctactgtgctgtagtctcagagggatttcatcaggggatcccagtaaggttgtaaaatgaataatgatcttggtggcaccacaccatctctgtgtagtgaggaaaacttatgtaaaactggaacgggtgaaggggtgaaactaggaaggtttcatagctgttagaagagggggaacaggattgggtgggtaaagccttcagctgtgaggcctgttgacatctatgaaagaggaagaaagcaggagagcctccagctgcaaaggacagctgaccagggcttggcttgctcagtgagcagcttcagagcaaagattgcctgatgaagcagttcagcattgggctgaaacagccaggccctacagtacccttctaatctggtttggctctgtccccacccaaaatctcatcttcaattgtaatccccataatccccacaagtcaagggagagaccaggtggatataattgaatcatgggggtgttttctcccatgctgttctcctgatagtgagttctcacgagagctgatgattttgtaagtgtttggtagtttctcctgcgttcatttctccttcctgccaccttgtgaagaaggtggcttgcttccccttaaccttttgccatgattgtaagtttcctgaggcctccccagtcatgctgaactgtgagtcaattaagcctctttcctttataaattacccagtcttgggtatttccttagagcaatgtgagaacagactagtatatcttccttgctcagtcattggctgggggttgcctaggaagaagaatgtggtccagcgtgaatgccatgcagatgctgatggctctacagttgaaggctgtcagttaactctgttccctgcagctgggcagcaggttctcagaggaataccctagaggttgtgtacttttgtggctgccacaccatccttattaaagaaataactctcatatgtatgatccccattgtatttcttaggtctgtgtgaagctgtgtaaacaggcttgctcttttcaatagctgaggtgctttttaaataaaattcatacgttcttggatatgattcaatccagtatattccatgaactggctttgcagcttcatctgaataatctcgatatttatatatgagttatatgtatctcttggatgaaaattttaaaagtaaaggccattatctatatgtgctcaaaggatataaaagaattttaatctcagaaaagcataataaggaagtcagtatatattttaatctcaggcaagcatactaaggaagtcagtagctgcaaaagctcctcaaaaaattattcgaagtcaaatataaataatcctattgctcttctggattacgaatacatcatagcttttttattaacatccaattcaaagttggtctattgtctggtggtattaaaatggatcacatgtgtagcccttaataatgcacattgacttggaacaccttgcttgatcctcataattctatgaggtagttattatcacctatgtacagatgaagaaacacatcctgagatatgtcaattttaatgcaatttctatgaatgacatctttttttcaaaaccctatgaaacacaatccagtaatttttaagaagctataccactccttccttacacaatatacaaaaatcaactcaagatggatgaaagacttgaaaactataaaaaacctagaagaaaataggaaaggccatggacataggccttggcaaagacttcatgatgaaaatgccaaaagcaattgcagcaaaaacaaaaattgacaaatgggatctaacaaaactaagaggttctgcacagtaaaagaaactaacaacagagtaaacacacagcctacagaatgggggaaaacacctgcaaactacacatctgacaaaggtctaatatccagtacctaaaaggaacttaaaccaacaagcaaaaacaaacggcctcattaaaaatgggcaaaaaatgtgaacagacacttatcaaaaggagacatgcatgtaggcaacaagcatatgaaaaaatgttcaccatcactaatcattagagaaatgcaaatcaaaaccacagtaagatgccatctcacaccagtcagaatggctatgatgaaaaagtttaaaaaaaaaaagatgctggtgaagttttggagaaaagagaacacttatacactgctggtagaaatgtaaaccagtttggccaccgtggaaagcagtttggagatttttcaaagaatttaaaatggagctatcattcaacccagcaatcccattactggatatatacccaaaggaatataaattgttctaccataaaaacacatatacacgtatgttcattgcagcattattcacaatagcaaagacatggaatcaacctaaatgcccatcaacggcggaatggataaagaaaatatggtacatatataccatggaatactatacagccatataaaaagaatgagatcatgtcctctgtagcaacacagatggagctggaggccagtttcctaagtgaactaacacagaacagaaaaccaaatactgtatgtgctccttataagtacgagctaaacattgagcacacatggacaaaaagaagggaataacaggcaccagggcctacttgagggtggagggtgggaggagagtgaggactgagaaaatacctatcaggtactatgcttattacctgggtgacaaaataatctgtacaccaaaccccatgacatgtgatttacctatataacaaacctgcaaatgtacccctgaacctaaaatagaagttggaaggaaaaaaattcattgcacaaatggaaacaataaaatctacaatttgaacatgtatttgaatagctagacgtgtcatcagaacaattcttggtgcttatttaagcacccagagctacctaaagagaacatgaggtttaagaaccactgatgaggaatcaaagccctactttgaagagtataaatatataagcattatatacatatatacacacatattttaaagaattataaaatgaacacttgtatacttaacaccaagaaattgaatattaacattgaagcacccagggcttctcctgtattgcattctttcctagaagtgatcaccagcctgttttgaattaactatgcctatgctttcgctgttttgccacactatatcttctataatattgttgtcttgtttgtttttagggcatatgtaaatggcatatatattgacatgcacactcatcccctttgatgacttagttttttatctttaacagtctatttgacattggttcccgctgacacttttgactgtagatcacattcactcatttacaatattactttgtatggaaatattcattttatccattctgttggtgggcctttgagttgttttcagcttttttttctcaggtacaaataatgcttccatgaagattcatgtaattggtttccttggtatatttgtaccaatatttctttagggtgaaactataaattgcagacactatataccttaaaacttattaggtaataacgacttattttctttttattattattatactttaagttttagggtacatgtgcacaacgtgcaggtctgttacatatgtatacatgtgccatgttggcatgctgcacccattaactcgtcatttagcattaggtgtatctcctaatgctatccctcccccctcccctcactccacaacagtccccggtgtgtgatgttccccttcccacgtccatgtgttctcattgttcaattcccacctatgagtgagaacatgccgtgtttggtttttggtctttgtgatagtttgctgagaatgatggtttccagtttcatccatgtccctacaaaggacatgaactcatcattttttatggctgcagtgagccaagatcgtgccactgaactccagcctgggcgacagagcaagactccatctcaaaaaaaaaagggagaaccaaggattttatatctagccaatctgtcattcaagtatagatgttataaaaaaagtttcaaatatgcaataattgaggaaataatagtaaccttctcaaatacaaaaagtttaaaagagaatcatatacagaaacaaagcaaatatagtcaaatacacataaaacttacaacaaaggttctcacattatctcacaaagcaaagacagactcaacttatgctacacagggaagacaaatacaaacagattcagaaaggtgaaaaatagaatgatggcatcagcatggcaggcaataccatttccatatgcaaactaaggaagacatttaaagcaaggataagaagcaaattcatggcctcaaaagctttatcaataaaaatgaaagagtgaaaataaatgaattaaattcttgacttaaaaatctaaataaataacaaaataaagcaaaaaaagtatactaaaggaaatactcatgagaagaatagtctattatatctacccctctgtgtatctattttgcgttttatatttcttctctatattctaggattccttctttcatttcctttttgttttcagaatttttaaattttaagttcagggatacatgtgcaggatgtgcatgtttgttacataggtaaacgcgtaccatggtggtttgctgcacctaacaacttattacctaggtattaagcccagcatacattagctatttttcctgatgctctccctccccataccctcccctgacaagccccagtgtgttttgttcccctcccagtgtccgtgtgttctcactgttcagctcccacttgtaagtgagaacatgcagtgtttggttttctgttcctgcattagtttactgaggataatggcttccagctccatccacgtccctgccaaggacatgatctcatttctttttatgactgcaaaatattccatggtatatatgtaccatattttctttatccagtctatcactcatgggcatttgggttgcttccacgctatcaaaaaagagctcatacagccaagacaatcctaagcaaaaagaacaaagctagaggcctcagcctacctgacttcaaactatattacaaggctacaataacaaaaacagcatggtcatggtaaaaaacaggcatattgaccaatggaacagaatagagaactcagaaataaaaccacatatctacgaccatctggtcttcaagaaacctgacaaaagaacttcaattaaccattcttttttttgtttgcttgtttgttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattattcaattcccacctatgagtgagaatatgcagtgtttggttttttgttcttgcgatagtttactgagaatgatgatttccaatttcatccatgtccctacaaaggacatgaattcatcattttttatggctgcatagtattccatggtgtatatgtgccacattttcttaatccagtctatcattgttggacatttgggttggttccaagtctttgctattgtgaataatgcggcaataaacatacgtgtgcatgtgtctttagagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtattcctatttctccacatcctctccagcacctgttgtttcctgactttttaatgattgccattctaactggtgtgagatggtatctcacagtggttttgatttgcatttctctgatggccagtgatgatgagcattttttcatgtgttttttggctgcataaatgtcttcttttgagaagtgtctgttcatgtcctttgctcactttttgatggggttgtttgtttttttcttgtaaatttgtttgagttcattgtagattctggatattagccctttgtcagatgagtagcttgtgaaaattttctcccattttgtaggttgcctgttcattctgatggtagtttcttttgctgtgcagaagctctttagtttaattagatcccatttgtcaattgtgtcttttgttgccattgcttttggtgttttggacatgaagtccttgcccatgcctaggtcctgaatggtgatgcctaggttttcttctagggtttttatggttttaggtctaacgtttaagtctttaatccatcttgaattgatttttgtataaggtgtaaggaagggatccagtttcagctttctacataaggctagccagttttcccagcaccatttattaaatagggaatcctttccccattgcttgtttttctcaggtttgtcaaagatcagatagctgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatattcttccatttgtttgtatcctcttttatttccttgagcagtggtttgtagttctgcttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcattttgtctgcaaacagggacaatttcgcttcctcttttcctaattgaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggttggtcatagatagctcttattattttgaaatacgtcccatcaatacctaatttattgagagtttttagcatgaagggttgttgaattttgtcaaaggctttttctgcatctattgagataatcatgtggtttttgtctttggctcccagtattttattgaggatttttgcatcaatgttcatcaaggatattggtctaaaattctcttttttggttgtgactcagcccggctttggtatcagaatgatgctggcctcagaaaatgagttagggaggattccctctttttctattgattggaatagtttcagaaggaatggtaccagttcctccttgtacctgtggtaggattcggctgtgaatccacctggtcctggactctttttggttggtaaactattgattattgccacaacttcagctcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttatcgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgcctcctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggggcaggttgttcagtttccatgtagttgagcggctttgagtgggattcttaatcctgagttctagtttgattgcactgtggtctgagagatagtttgttataatttctgttattttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatggatcttgactctttatccaatttgccagtctgtgtcttttaattggagaatttagtccatttatatttagttaatattgttatgtgtgaatttgatcctctcattatgatgatagctggggattttgctcgttagttgatgcagtttcttcctagtctcgatggtctttaaattttggcatgattttgcagctgctggtaccggttgttcctttccatgtttagcgcttccttcaggagctcttttagggcaggcctggtggtgacaaaatcggtcagcatttgcttgtctgtaaagtattttatttctccttcacttatgaagcttagtttcactggatatgaaattctgggttgaaaattcttttctttaagaatgttgaatattggcccccactctcttctggcttgtagggtttctgccgagagatccactgttagtctgatgggcttccctttgagggtaaccggacctttctctctggctgcccttaacattttttccttcatttcaactttggtgaatctgacaattatgtgtcttggagttgctcttcttgaggagtatctttgtggcattctctgtctttcctgaatctgaacgttggcctgccttgctagattggggaagttctcctggataatatcctgcagagtgttttccaacttggttccattctcctcatcactttcaggtacaccaatcagacgtagatttggtcttttcacatagtcccatatttcttggaggttttgctcatttctttttattcttttttctctaaacttcccttctcgtttcatttcattcatttcatcttccattgcttatatcctttcttccagttgatcacatcagctcctgaggcttctgcattcttcacgtagttctcgagccttggttttcagctccatcagctcctttaagcacttctctgtattggttattctagttatacattcttctaaattttgttcaaagttttcaacttctttgcctttggtttgaatgtcctcccgtagctcagagtaatttgatcgtctgaagccttcttctctcagctcgtcaaagtcattctccatccagctttgttctgttgctggtgaggaactgcgttcctttggaggaggagagacgctctgcgttttagagtttccagtttttctgttctgttttttccccatctttgtggttttatctacttttggtctttgatgatggtgatgtacagatgggttttcagtgtggatgtcctttctctttgttagttttccttctaacagacaggaccctcagctgcaggtctgttggaataacctgctgtgtgaggtgtcagtgtgcccctgctgggggtgcctcccagttaggttgctgggtggtcagggacccacttgaggaggcagtctgcctcttctcagatctccagctgcgtgctgggagaaccactgctctcttcaaagctgtcagacagggatatttaagtctgcagaggttactgctgtctttttgtttgtctgtgccctgcccccagaggtggagcctatagaggcaggcaggcctccttgagctgtggtgggctccacccagttcgagcttcccggctgctttgtttacctaagcaagcctgggcaatggcgggcgcccctcccccagcctcgctgctgccttgcagtttgatctcagactgctgtgctagcaatcagcgagactccgtgggcgtaggaccctccgagccaggtgcgggatgtaatctcgtggtgcaccgtttttttagcccgtcggcaaagcgcagtattagggtgggagtgacctgattttccaggtgccatctgtcacccctttctttgactaggaaagggaactctctgaccccttgcgcttcccgagtgaggcaaggcctcgccctgcttcggctcgcgcacggtatgctgcacccactgtcctgcgcccactgtctggcactccctagtgagatgcactcggtacctcagatggaaatgcagaaatcacccgtcttctgcgtcgctcacgctgggagctgtagactggagctgttcctattcggccatcttggctcctcccccttaaccattctttaaggttctctgctagccacaaattattttaattttccttgattggagaatgtctatttccccttcattcctaagggaaacatccactggatatgtaattcatcttgacaatgttctgccacaaccttctggcctccttaatttcacatgagaagtctgctacaattcaagtcagttttgcctgtaggtgatgtgtcatttctccgtacctgctttcaagattttttcttttcgttttaaaagttaacttataatgtatcttggcatggatttctctgggtttgtcttacttgggaatggctcagtgtcttcactctgcaggtgtgtctttcaccaaatttggggagtttttagcaattacttcttaaaatactattcagccccactctctttttccattccttctgaaattttgatgatacaaatattaaatcttttgttactacaccataggtcccggaggctctgtcctttttcctgtgattttctctcaatttacattgggagatttctattgttctatctgcaagagcagtgactgcttcctcagtaatattcactccgctaccaagtccatttactgaattttaattttagttattgtatttttcagttctataatcaccaagttgttctttaaaaaaaaaaaaaattctgtggtgagattttatagccttttcatttgcttccagagtatttaaaactgctcattgaagtgtttttatgatgactgctttaaaacccttgtcgaataatccccacatcctattcatctcagtgttgacatttgttgtcttttctcattcaagttgttttctccattcttgctatgatgagtggtttttctattgtgtccagtacattttttatattatgttagagactgtggatcctatcttaaatttctatttcagcagacagtcattttgtttttaggtttatcacgcaagtcctggcctacttctgtgtgctatagttacaatgacagtttagttttcagagtctttgcaatgctagtgctattgtggtcagcttgattcatctggtgccctggtgctccgtctccaccccaaatcatgctgccgatgcaggaagaatgtatttcccatgtcctgttgccatgggatagagggtgagagacaccagactgtggggtagggggttggcagagggcagagggctctttcctagggtgcctagtcctagcagggcacctgttagatctccgctgctgctacctgcatgggcagcctccctggagggaatagtagataccagacccacaggatggagagcatttccctggaccctctttctgattgtcttctgccactggatggagtttcaggaggtggcagcctgtggtgtttttctgtgagttctgaggtacctaactagtctgcctttctatatagcattgggctgggattggagctacagttatgaaatcatgatttcatacacacacacacgtgtgcacatacgtgcagtgaaagggcctagaaacaaggacacactggtagtaataagtgcacataccactcaggtcttggtttccaaataccattctcctctaaaaggaaccagggctccttggaaaaaatggctgattccaaggctagcacaaggaaaatcaagaaaagcctggagcattataaatttataaagacatgtcaaagagacatccagcttaggaacattcaaaacggctaggcccagaactgatatttgtgtataacatatggtttttctcatatagatagactattccagcatcatttagtgaaaagtgacctgcaagacaatcttgctgaaattgctttgaatctgaacatcagctggggagaactgcattacatgaaacttcatacacataaatgtgttttatttttctatttatgtcttagaattattaaaataaattttcatacaaatactatatgtattttgttagattcattcagatcctatgcatttttcttcctaatacataaggcatatttttaaaaaatatgttttctgtttgttgccaaagaataaaaatgcaattgatttttgaatattaaacatatctagccatggtattgaattcttctaattcctaataagttgtcaattattttattctttctaggtaaatattgatactataataaattttccttctttctgtttctttccttttcctattatttacttttcttgcattactaggctagtttggactttatttttttttattttttatttttttcttttgagacggagtctcgctctgtcgcccaggccggactgcggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggcctggactttaataaaatgtgaaaaagcacatttatctttatcttgattttaaacagaacactctaaatactttattatcagtaagactaatgactgctgaagaattttactgggttgagaaaactgttatttctattgtgttacatgttttcattataaatggatgttcaattttatcaattttattttctgcatctaatgggatgatcataagattttttctcttttaatctgttagtgtgataacttacatttttggattttccagaaatgtctttggattcctagaataagccagatttatcacaagtggattatctttatcatatatatggctgttcttgagttactaatcttttatacttttgtgtgtaaggaatgcttttaatctaggtgaaattttgaatctatgctcacaaataagaatatcctttctcaaactatcctcatctggccttagtactgagctttagattatcttggaggttccatttcccttcttgtaatgattcttatgcctcatggcacacacaaagttcccctttgtaaatttcatatgagctcaattcaataattaccttgccaccaaaaactggagtctcccattaaacagtgaatttgcttctattgatgttaaactctaaactgaatcacttagatctaaaaataccttgtgcaggttgtgtgtaataaatacttacctttgccaaagacatacagagctagaaacagaaaataatacctaggaaggcttaaaaaacatgtaagctgaacatttggttaaatctcaacttttctctccttagattttttgtttctttgatattcttgaatttaaaacttagtcaattcatgttctttccagtctactactgaaaatattcttgaaaatgaagacagtaaattttcctttgagtgcagccttggcagaatttttttgatgtttatggacactcttctacttactgtcatttttcaatagtttgcaactgaaattctgaccttcttttgagttgtattaaattgctcaatttttctgaagtgaaagaattatatattacaagtgtaatgtcgatatgtgaatttctacaaagcctgcatgcctaacaacaggtggcctgggtaaagagtcaaattggtagaaccaataaagaataataaaaagacaaaaaaagcatcatgtcattcattcaacaacttactggacaaatctttctatattttcaccataaaggatgggagaatgcctccaacaagaagaaaatagcaactccttacattttgttctcttgtattgtgggtaggaacctacctcctcaacttgtaacatttccagacttatcctctcaatatataacatgaaaacatacagttcatttcttccgtcacccagggtggagtgcagtggggtgatcatggctcactgtaaccttcccgggctcaagcaatcctcccatctcagcctcctgagtagttgggatcacaggctcatgccaccatgcccaactagtttttctattttttgtagagacggggttttgccatgttgcccaggctggtctcaaactcctgggctgaagctctctgttcgtgttggcctcccaaagtgcagtgattacaggcgtgaaccactgtgtgtggcccagggtttattttttaatagaagtacatcacagaccagagaaaaagaatatcaactgtctcatattaagataatttaagagttgcactacctgcctaataacttattttactaggaaaccatggaggtaatatgggccatccatctgcatattagggaagaagccaaacaaagattaggttgtggctgagttcaaattagaaggggctgggagactgtaaggaaaatgttaaaaggacaaaagtaatagactctaaagttggaagatggccgaataggaacagctccggtctacagctcccagcgtgagcgacgcagaagacgggtgagttctgcatttccatctgaggtactgggttcatctcactagggagtgccagacagtgggcgcaggacagtgggtgcagcataccgtgcgcgagccgaagcagggcgaggccttgcctcactcgggaagcgcaaggggtcagagagttccctttcctagtcaaagaaaggggtgacagatggcacctggaaaatcaggtcactcccaccctaatactgcgctttgccgacgggcttaaaaaacggtgcaccacgagattacatcccgcacctggctcggagggtcctacgcccacggagtctcgctgattgctagcacagcagtctgagatcaaactgcaaggcagcagcaaggctgggggaggggcgcccgccattgcccaggcttgcttaggtaaacaaagcagccgggaagctcgaactgggtggagcccaccacagctcaaggaggcctgcctgcctctataggctccacctctgggggcagggcacagacaaacaaaaagacagcagtaacctctgcagacttaaatatccctgtctgacagctttgaagagagcagtggttctcccagcacacagctggagatctgagaacgggcagactgcctcctcaagtgggtccctgacccctgacccgagcagcctaactgggaggcaccccccaagagggacagactgacacctcacacggccaggtactcctctgagacaaaaattccagaggaacgatcagacagcagcattcgcggttcatgaaaatccactgttctgcagccactgctgctgctatccaggcaaacagagtctggagtggacctctagcaaactccaacagacaagcagctgcgggtcctgtctgttaggaggaaaactaacaaacagcaaggacatccacaccaaaaacccatctgtacatcactcatcatcaaagaccaaaagtagataaaaccacaaagatggggaaaaaacagagcagaaaaactagaaactctaaaaagcagagcgcctctcctcctccaaaggaacgcagttcctcaccagcaatggaacaaagctggacggagaatgactttgacgagttgagagaagaaggcttcagacgatcaaactactccgagctacaggaggaaattcaaaccaaaggcaaagaagttaaaaactttgcaaaaaatttagacgaatgtgtaactagaataaccaatacagagaagtgcttaaaggagctgatggagctgaaagccaaggctcaagaactacgtgaagaatgcagaagcctcaggagccaatgcgatcaactggaagaaagggtatcagtgatggaagatgaaatgaatgaaatgaagcgagaagggaagtttagagaaaaaagaataaaaagaaaagaacaaagtctccaagaaatatgggaccatgtgaaaagaccaaatctacatctgattggtgtacctgaaagtgatggggagaatggaaccaagttggaaaacactctgcaggatattatccaggagaacttccccaatctagcaaggctggccaacattcagattcaggcaatacagagaatgccacaaagatactcctcgagaagagcaactccaagatacctaattgtcagattcaccaaagttgaaatgaaggaaaaaatgttaagggcagccagagagaaaggtcgggttaccctcaaagggaagcccatcagactaacagcagatctctcggcagaaactctaaaagccagaagagagtgggggccaatattcaacattcttaaagaaaataattttcaacccagaatttcatatccagccaaactaagcttcataagtgaagaagaaataaaaaactttacagacaagcaaatgctgagagattttgtcaccaccaggcctgccctaaaagagctcctgaaggaagcactaaacatggaaaggaacaaccggtactagctgctgcaaaatcatgccaaattctaaagaccatcaaggctaggaagaaattgcctcaactaaagagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagatacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacacgaagagctaactctcctaaatatatatgcacccaatacaggagcacccagattcataaagcaagtcctgagtgacctacaaagagacttagactcccacacaataataatgggagactttaacgccccactgtcaacattagacagatcaacgagacagaaagtcaacaaggatacccaggaattgaactcagctctgcaccaagcggacctaatagatatctacagaactctccaccccaaatcaacagaatatacatttttttccagcaccacaccacacctattccaaaattgaccacatagttgcaagtaaagctctcctcaaaaaatgtaaaataacagaaattataacaaactgtctctcagaccacagtgcaatcaaactagaactcaggattaagaaactcactcaaaaccacccaactacatggaaactgaacaatctgctcctgaatgactactgggtacataacgaaatgaaggcagaaataaagatgttctttgaaaccaacgagaacaaagacacaacataccagaatctctgggacacattcaaggcagtgtgtagagggaaatttatagcactaaatgcccacaagagaaagcaggaaagatccaaaattgacaccctagcatcacaattaaaagaactagaaaagcaagagcaaacacattcaaaagctagcaggaggcaagaaataactaaaatcagagcagaaatgaaggaaatagagacataacaagcccttcaaaaaattaatgaatccaggagctggttttttgaaaggatcaacaaaattgatacaccgctagcaagactaataagaaaagagagaagaatcaaatagacgcaacaaaaaatgataaaggggatatcaccaccgatcccatggaaatacaaactaccatcagagaatactacaaacatctacacaaataacctagaaaatctagaagaaatggataaattcctggacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaagcaatagaaaaagagggaatcctccctaactcattttctgaggccagcatcatgctgatataaaagccaggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacacgattatctcaatagatgcagaaaaggcctttgacaaaattcaacaacgcttcatactaaaaactctcaataaattaggtattgatgggacgtatctcaaattaataagagctatctatgacaaacccacagccaatatcatactgaatgggcaaaaactggaagcattccctttgaaaaactggcacaagacagttttcaaaggaaaactttgaaacctctatcaccactcctattcaacatagtgttggaagttctggccagggcaattaggcaggagaaggaaataaagggtattcaattaggaaaagaggaaatcaaattgtccctgtttgcagatgacatgattgtatatctagaaaaccccattgtctcagcccaaaacctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaagcagaactacaaaccacggctcaaggaaataaaagaggatacaaacaaatggaagaacattccatgctcatgggtagaaagaatctatatcgtgaaaatggccatactgcccaaggtaatttatagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactataaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccttatgtagaaagctgaaactgaatcccttccttacaccttacacaaaaattaattcaagatggattaaagacttaaacgttagacccaaaaccataaaaaccctagaagaaaacctaggcattaccattcaggacataggcatgggcaaggacttcaggtctaaaacaccaaaagcaatggcaacaaaagccaaaagtgacaaatgggatctaattaaactaaagagcttctgcacagcaaaagaaactaccatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatattaacagacacttctcaaaagaagacatttatgcagccaaaagacacatgaaaaaatgctcatcatcactggccatcagacaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggtactattcacaatagcgaagacttggaaccaacccaaaagtccaacaatgatagactggattaagaaaatgtggcacatatacaccatggaatactatgcagccataaaaaatgatgagttcatgtcctttgtagggacacggatgaaaatggaaatcatcctcctcaataaactatcgaaacgacaaaaaaaccaaacaccgcatgttcacactcatagataggaattgaacaatgagaacacatggacacaggaaggggaacatcacactctggggactgttgtggggttgggggagtggggagggatagcattaggagatatacctaatgctgcatgacaagttaatgggtgcagcacaccagcatggcacatgtatacatatgtaactaacctgcacattgtgcacatgtaccctaaaacttaaaagtataataataatttaaaaaaatagaaaataaaaatgctactgttacgtgaaaaaaaaaaaagattgtaatttaccattaaatattctaaatacaaaagctcgttttcctctacatctgcatgacattagaaatttaatactccagcaaggaggtcagaaaataggacagggcgctgcccctgcacacctcaatatgcttctcctgtatgtgtagcaacaacttttatataccaccacttttctgtttcaaaaaacattgaagagaaatgtaagtgctgccaaagtaataagttaacaactatgggaaaaatttaagggaaaagaatcttaaaaaattaaaaaatcattctagaattcagctgaagcatgtggaagtttaaattgtccattctgcattactgagatgtattgggaaccaataccttttaccacagagaattatagtaacttttagataagaaaaaagaaacacaaacattttacctgaataataaaactgtaactgctccttttataaatgctatattggattttgatgaatctttgtataatcgtatataaattttcaagaacaaaattctaaatgttcatattgtttattaatgttatcataaaatactcattatgtactttgtaatcttacatttttcaaacaaaaattagttctgactaagatacagagtatagcacatgcactcaatgatacaaccctaaatgtgctcattaagacattttattccatgaaagccgtgactgaccagactgatatcacctcaaaaaaataaaaataacccaccttcctaggaattaaactgggaatgaatagcaaggggtgatgaagaatggtcagcttccatcacctaatctttgagagaaggcaaagtgtagagcaaagatacagaaatctgaatgaggaggaggttcctaaatccaaattcaaccccagaatatacttgtcaggttggtaagaaatcagaagttagcctgctccattctcaaggtttgtgccactccagtacactactatttaccactcttcaattagctttatctgagtgccacaaatatttgcatggacatgtgcagtgttctgtggttaaagagataaatatggcatggtccctgtttccagtggtacttttaaatacatataattggctgggcacagtggctcacgcctgtaatcccagcactttgggaggccgaagcgggcggatcacttgaggtcaggagttcaagaccagcctggacaacatggcaaaaccctgcctctaccaaaaatacaaaaactagctgggggtggtggtgtgcacctgtaatcccagctacttgggaggctgaggcaggagaatcacttgaacccgggaagcagaggttgcagtgagccgatcatgccactgcactccagcctgggtgacagagcaagacttcatccctaaagaaataaacaaataaaaatttgtgtatgtgtggatgattcataaatttactgtttcaaaaaacaaggaagaaaaacaaatgatttttatataaggcagaatctgccagggactagtaggtgaagaatggggtcctctgggagtttggaggagatagtgatcattatttcattcagtgagagttctcattagtattctatcaaatttatttctctgataaggctatttatactattctaccacataaggttttttttgttcatttctcagaccttttatatatctaaaatgcttataaatgtaatccctacaaaaaaagtgtatccaaaaaaaaagtttgaaatgaaactggttgtcctgttagaaacattagttgttcagaaatgcttcataaatatgtgaatatatgtactctttatccatctaactctgcatttcccaaattcgtttccacacagaacacttttttcatggcacattcatcaaaaccacaggttagaaaagaatgtcagagtacctaaactttgaagagaaaatgtaattgtttctcaaaaacttctgaatcttggcaaactatatacaaacacataccttttggtttattaaaatataatgtagttatctaaaacctgtagcctacactcttaaatggagagcaatttttacgtagcaattttgaattattttcttaactctatactcaatttacttttaaaataactaaaaaatggtcaatttggtaattacaacttcataggttgaagtatatatatataatatatatatttacatattttttttttagagggagtctcgctctgttgcccacgctggagtgtagtggcacaatcttggctcactgcaacctctgcctcccgggttcaagcaattctcctgcctcagcctcccaagtagctgggattacagatgcacaccaccatgcctggctaacttttgtattttagaagagacaaggtttcaccatgttggccaggctggtctcaaactcctgacctcaagtgatccgcccacctcagcctcccaaagtgctgaactgaagcatattttaagacacttaaattataatttatttgcctttgttttataaatcgaagttacctgagaatcaaagttaaaatatacatctgaagtacaaggaatggataggaaaaactttcacggagaggttgtgtccacatcacacgggtgacctgaaatcaacaaaatgcccactttacatcatgtttactacaacaaacatttaaaaaccaggggtgaggtttttttagtaatttcaataccaggctcactagatcccatttctgagtgtctggcatagcttctcagtttttgaagctctcttaacgcatgaggccattaagtagagagcaattaactaccatgtccagaaaccagcaacagatgtatcagaccgagcaaaatgaaacccaacggacaaacaagattgtacgtataagagttgtgagaattctgggactgaccaactagatccataggccagccctgcagtatgatcctggcacatgatcctggcatccgaggctttgggatatatgcatgccgagacaaacacctaaacaaatgtcacctaggtcattcgcaagcaccatgagagtttctatgtaacaagtatgaacgaatataaatacacactttgaatagctaagattgcctcagattttgtaaaatgtaccttaaaaaagttaagtatatattttaaaaacaactagaagtatttgggaactacaaatgtgatgcatgtaacgaaaagtattaaattttcacgcaaactttaaaattatttctaagacgtatgggtcagagtattagaaaaattttccatcaaaaattctgaaattctagaaagaatgtgaactcttattactttgcaagagtcttagaagttattgctcctcttccaagataccaaaattgtaaatgttggaagaggaattatgatacataaaagtcaacttataccaacagttgtctggcacactcaaagaaaaagctttgtctttaaatcagcacattgttgaatgtcaatgcatttgtttgctttaaaataatatatatggcttttatgtataatttttatgattcctttatctaactgatttttaaaaattaacccaacagcaatggataaaagtacctctaccccggccgggcatggtggctcacacctgtaatccccagtactttgggaggccaaggcgggtggatcacgaggtcaggagttcgagaccagcctggccaacatggtaaaaccccatctccactaaaaatacaaaaatttagctgagcatggtggcacatgcctgtaatcccagctactcaggaggctgaggcaggagaactgcttgaacccacgaggcagaggttgcagtgagccaagatcatgccacggcactccagcctgggcggcagagcaagactccatcttgaaaaaaaaatacttctaccctatgaaacctgtgtcataacttattaaatattttgctcccaagagctaggagtcagaatctctctctttttcattgccatatcctcagcatctaacagagtatggacatggtatataccaatattttgttgaatgtatccatcgtatttgaaataagcttctatgagctcttttttaggtggactatgtttcattgggctgaattagtaagttaatgtctattttgaattcagcattttgcattactgaacagacagcatgacgtaacacaaagaagtgagggagcaggtggcagtgtcttaaccgtgtccctgctgtcaggcctgaggcctctttcattgttgttaaggggagtgcaatgcatacaaagtttcagttaggcaagataaataagttctagagatctgctatacaacattctgttaacactgtattgtacacttacaaatctgttaagagggcagatctcatgttacttattcttaccacaataaaaaagttgaatatatatgttatacatataaaatatataaaagtttttataaaatataactataattttataattaataaaatataaattaatatatatgtgaggttttaaatggcagaccagacatagaatgggaaatccagcttcatcatgtagtaaatgtggaatgtggataagtaacttaattttctctaaatttaaatttcataacttgtatggtgaggctaccaccacccacaaaaaaagtttagtgggaataaatcagataatgtgcatgacgtgattcaactcaacaagtacagtatttccttttctctacagaatatatgtatatgtatatatttactaaaaataaggcaagagatttcatgtttgaaattctagctatttaaacattttgatcagcatgattaaaatatcaacttataacacaagggtctttaaaatattgtgaagtcataagtagtatacaattatatattgtttcgatgagtatatttctttgttcctctataaccccttctatttcttaaaaattgctttctagaaaacaaacctctccatggttgaaaaagcagcacagtactgtaataagacctcctagttgagtcccactgtaaaaaataataataataacagagtatacaatcaaaattcatgtaaaatacagtgagtttttcacaaaattacctcagaattttaaaccatagtttaaatcatatttaaaacataatagtactaaaccatacccatgtggttgatgcttaaatcctgaatgtacaatcgtaaaaagtgtacatataaattaatctcaattttataatttatcatagctaaaatactttctaaataaaatacataaggtgtgaacataaattttttttgagatggggtcttgctctgtcgcacaggctggagtgcagtggcgaaatctcgactcactgcaacctccacctcctgggttccaaatattctcctgcctcaggttcccaaggagctgggattacaagcgtgtgccactatgcccggctaatttttttacttttagtagagatggggattcaccatgttggccaagctggtctcaaactcctgacctcgtgatccactcgcctcggcctcccaaagtgctgggattacaggcatgagccaccgcgccccaccgcataaagtaatttttaagaaacaggctagcactttagagtctagatcacatcctttgaataacctgaataaaggcaaattcttatttttgaaattggctttaagggattgagaaatgaagacaagattcaaacagtttcatgtagcattaacttagaactgtctaaactactgcaaatattctttacttgagtcccagacaagcaataatgccgaatacaaaaatcagatgaaagataaaaaccatttcttttgttgttgtctttttgtttttttgtttgtttgagaaggagtctcgctctgtcacgcaggctggagtgcagtggagcgatctcagctaactgcaacctctgcctccccagttcaagccgactcttctgcctcagcctcccgagtagctgggattacaggcgcctgccaccatgcccggctaatttttttttttttttgtatttttagtagagacggggtttcaccatgttagccaggatggtctcgatctcctgacctcatgatccgcccgcctcggcctcccaaagtgctgggattacaggcgtgagccactgcgcctggcccaaaaacagaactttttttaaaaaaatagaatatttttaaacctgcccaaacaatctcaaagcaatccttttccctcaaagtactttaatgagcttatatttttctacacggcatatagaaaagtgcataaaatttctagattatagaactgtaaagggaacgtccatgtagtcaccatataattaattgaaatagagaaatgattatactgtcttcacttgccagcctccaagataagaatcagctactgacctgatttttgagattatcaacataactctttctatacacatatcaaactatgatttactttaatctgtttttaaacaacatacaaatggaagaatgcagcatttttttaaattttgtacctggattcactcattcaaaattatatttgtaagattcaaccatgttgtgtgtagctgcatagttcattcattctcattattgtatactgttccaccatgttaataaaccaaaatgtattcatttctctgttaatggatatttgggttctttccagtttgaagctattgcaaataatgctaccatattattgtatgtacttcctagtacacatgtgcaatacttttttgggaatatgtatgttaaattacaattgctgagttataaggtatccataccttcaactttaccagataatatacactgtttaccaaaatagttgtaccaatttatatgtccacctgtggtggacgaaagctcctttatcaatctattagatgtgagttggtatttcactatggtttgaatttatattttctttataacaaatgatggtggtcaactttacatatgtttattgaccatgtggtgttcttctgggaaatatcagttcataaacattttgtccatttttctatcaagttgtctttcttctttgtctttatcttcccactctaatataaacttcacaaggacagagatttctcttctgtattccaagcacctagaacagtgctcctggtcacaacaggctttcaataaatatttatcaaattaatgaatggaatttctggatagtaggtggggcataaactttgtaaatatcttcactcactttcaggtttttttaatcctacagttcttttgaggtaaaattgataaactcatcaaatttatcagtttctcttcatggctggatttttgtatcttgtttatcatttcttattccaagtgactttttctatattatatgctgaacacttttataaacctgtctttcatatttgagtgattaatccagcttggagtattatttatatagttccaagttctctttgttccatatgatctcccaagtattccagcactattttttaaaatgcctgtccttacccaccaatctgcaatacctgctcttccatatatcaaatgcctttaaatgtacatttctgcttctgggctgtactctatttcggttatctatttgtctattcctgtgccaatatcacagcatctttttacattagctttataatatagcaacagttgatagtgcaaatcctcctttttcaagaataccttgactgtatttggcgctttgcatttctgagtaacttttaaatcagctcatcaaagtcaacaaaaaatatgttggaattttgactggtagagcattgaatctataaagctttttaatatcaagtcttcaatcaatcaatgtggaatagctctccacttagattttcctagacatatctcaggaatgttttaatcattttcccatagctgtcatatatattttttgttggatttattctgaggaacgtcatgcttttaatgctattctaaacagcatcctttcaaaatttcattttctatttgatcctaaagtataaaatttataattttgaattttaatattaatgtttacatctagtaacactgtatattttcttattgcaaatactgtatccataagcttgtaaaatttttctagatatacgatgttatctacttttaagaacacatttcttttttttcaagttttccaatccttatacttattactaattttctttttacgtaccatgctggatagtatccctggtacaacactatgtcactagttttcattgattctatgctagtcttttttatgctgaaaacttcctaaaacaaagagtgtgtatatttactaatctctatattgacataagccctatgaaaactcaacaaatatttgttgaaagagtaaagctattaattaattttaattttaaatgttttacacgacaagaataacattgtaaagaaatctgatgattcagctaggaatatgttccactgaaagaaacagaaaacctaacaaaagtagcttacacaatatggatgttgtttaatatatcattcaacaagaaaatgaaagataagtacctgttggcattggttcagcagcagaaggatggtaggccagatatatctgctatttttatggcctttcccttatggtcacaagatgaccgctacagctctgggcatgacatcctagtgtagtaaaagcaggaagaaacagagaaggggcagctaagtctgtccttttgtgagaaaggcagatactttcctagatgtaaccaaaactgacttcaccttagttttcattgacaaaaactcgctgatttggctatctcagggagcaattaagtgtgggagcaaaacacatgaccgctgaaattaatttcaacttatcacctgagaccggtctcactgcttcttcatcgtggtactcttatcaagataggcaggctagtagatgtaagtgcctgccacatgtgatacagtttttcctactgctttcttaatttcatccttagagaatacaattagaaataagctgctattactgctaaccaaagatctcctccaatgttttcttaattttacacatgaactaggagatattccattaaagcctttgttaggaaatcttaattagtcaaaaaaaaatccttaagggataaaagggatgcctttgggatagaattttagtgacatctccagtttctggttacatgatattggttaagcttctgaaaaaatcaaataaatccacaaactttcctgatatgaatctaatctcgttaattttccttttcattcaatcaaaaaatatcagccagtctgtataagcccactgaaaggtctcttaattcagtagtagtcttacctcaggttatgctccatacacgaagaacaatctcatcattagtccattcaaaataaagactacaccaacataaaagcaagcaggatctcccaatcctttgaaaagatacagataagcagtgtttaatgaatatatgactcgaaagcaattgggcataattatctcagtgctttgcaatcaagagcttatgaatttgctgaaagcatttgctttccagattgccgctgtgtttaattctttacccttataagagtttgtgtgtgtgtgtgtgtgtatgcaaacacatatatgtatgtgtgtatatatgtgtgtatatatacacatacacatatgtaagctcacccttaatgaggtattatatagttacactttatactttttataattgcatttgtactttcctctaatgaattactattatactgtaatgatttgttggggattcacatttatttaggtgatgctgctagtgttcagtgtctggaactgtctgtagaaccacttaatgaatacaaaagaaaatccattgcattatttttatcttttgctaggctctaggaagagttaagatatgattttgacttcagggtacagctttagtctatatgaaatgatccagtcatttgatccattattatgtatagctagaatcttagtatattccatatagaagatcgtgcgtgtgtgtggcaatatgtactttacaatcatcccacatttttctcagaacaagtttatggtattagctgatataaaaatacttttcttatgattaagaaaacagaacatagaatattcaacttgtcaaaggttatttcactttaactggctggagccaaagtctgaaggctggccttctgattccccctgcctctctggtcactcctttcaatcagttccagtaatttctcttgttttatgtaccactctttaatactggaccaccttaggctctgtcatatgcccccttcatttctctatctgcgcattctccataaagaaattcttccacatccatggctccaatgatctatatacagatgactccaactctacatttaatccagaactttctccttattcttatacccagatagccacttgatgtccccactctgaggtctctcaagtacctcaaattcatgcatacacaatgaaacataacaatacaaacctgctactgttcaaatgtttcctaccattcaaagctcagttacttaagctagaaaccaaactgtttcacatgattcttcactcaccttcccctctcttaccaaacaattaccaagacagggtcttgtccattctacttccaaaatctctctcaaacccacattatccacattatctttcctgcatatccacattatctttcctgcaatcacttgctgagaatataatagtcttctacctggcctccctgaacctacttttgtccctttactaatattctttccataccattgattaaataatgttttaaaatgaaactctgttaaaattcttcaatggataaagtataaaatccttcaccagtgcacgcctttcatgatctgatcctcgcttatattcccagcaccatttcacatcatttttcttctccatcatttccaggaattctagccttctttcagttccctcttgcttcaggatatttgaatatgttattccctattcttaaaatacttatcctcttactcctcatgttggtaatcttattttcttatttgtagtatccctcacagttgtaactgctaacagaccccttacagcataaactctatgagggtaaggccccatgtctagctggttcatctctgtgtcccaagtgccaaacagtaacttatcacttattgggaaggtaattaataccatatttaggtgatcattttcaccactcagacagggtcacaccttctagctgattgaatcattgcaaagtatctcattttatgaggcattttctccaatcctttacattgtacacaaaaaaatataattgcccctcaaacatcctcatcaattctatttttactgaggcaatcagtaaaaaatgtaaggaaaatagatttagtttatattccaagagttgaatgttgttacaaacaagtctaaaaatttattcataaaatataataagtcatgttgttaagaatttgaagaaatgcagaaaaaacaacagtgttagtgttataaaaagagatacatgtggctctcaacaagtctcaagggacagcaccatatttgaattataaaagtgctgaaatgcaaacatcttaaatggaagtgaccactatgtatcctggaaagctgttggatgactccaaaagtggttctttgacaaagaaaccaatgtggaagataaataggaagagttttattaatactatgagcatatataaaaaagtaatgtttctaaatcaatctattattgcatatccgatttttaaatatgtatgcataattaaatttatacattagctattacaaatagatatttgactgtttaatctatcctcaaaatttatatattgaagctaccccaaaaaacatctttctgtatcttcgcattctgaaacagaagactaacttatagtcaagattgccttacaatgggatatgttaatactcaaattccaaaatttatactcaaatttgtaagtacacagccttctcagaaaactactttaaaacgtaaaatactcattgaggtgagccagttctaatttttttttaaatcaacaacagtattttacaataattcttaaaagtgaatcataatattattaaatgtttatgaatgtttacaaatgacagcatttttggaagaaacatgccttcacagctttgaacttcattaagaggttctattctggtgacattccagcaggtcttagtttctagtccaaataaattcattattcccatggatgtgcgacaccaggaggctatgattacctttaaaaagataaaaacaaagagataatggaggaaaatatattctcttcataataataatctttccaaaataccattttgtgatggttgccttagacattataaattctgacaaatttatttagatcatttcacttaggaatcagtcacttcaaaattacacattatgcctctatatagaaaaatattatatatgtgatagccaattctgtaatataaataatagtaagtcaatataaaagtatataattaaaatacggtgattaatagaaaaatacaaagatttatagaaacatttcataattcacttcatttagatccttgaatttattccttcataaaatatataaaatatattataaaaactggaacagaatggaataatagcacctgtacccattacaattttaatcaagcagaagatttaattgaccaattgtttccaaactgcaagctatttttaaaagttcaaagacaaagaaaaaataacagaaaaaaatttccaacagaatgttcatgtctcagaggttttttaaaaataacactatacattctgggaaactaatgtgaaatcactggggggagaatgtcaaaaaataaagagttgaaaagagaaagtaagcacctcttagagctaaccatttttaatattttggtgattggtgcggtggctcacgcctgtaatcccagcactttgggaggccaaggcgggcgggtcatgacgtcaggagttcgagaccagcctggccaacacagtgaaaccccatctctactaaaaatacaaaaattagctgggcgtggtggcaggcgcctgtgatgccagctactcagaaggttgaggcaggagaatcacctgaaatcggaaggcagaggctggaaatcggaaggcagaggctgcagtgagccaagatcacaggactgcactctggcctgggccacaagagcgaaactccaactcaaaaaaaaaaaaaaagttggtgattatctttccagtcctccccctaggcatttaaaacatgaaattagagttattcaatactacctaatgagatcatattatcaacgttaatgtaatatacatcactaaacatcagaaacatctttcctcgtctcagaagcgtagttttattaggcaggttaacatagtaggaaaagcatagctttgatatcagaattgaactcaaattctgactctgcaagttatagtttccatggtctcaagtaatccttcaacggctgtcaatcacttcacctctcaaataagtttaataataaccattctacaagagaagtgagataagcgctcacatatacagtcgtatatgtcctgtatgtcctaagtatagtgctggcatatagtatgcagtgaatgcttttacctttttaaaacattctgttctaaacttacatttttatttgtaaatgagaaattaatcccctgtgaaattaatctcgcagggggagcgaagccacggttgcgggggagcgaagccacggttgccgggaagcgcgggccacccctccctccctctcattcttcgtcctcccctcgcgcgccacccgtttttcctctttctccgttaataacggctgggtggctgggggaggagggaaggtggctccggcggagtctgggcgggcgcctcccactcagccgccagtcgccgtgggagccggaggatggcggcggtaacagcggccgccggagaggaggcggtggggaggcccggggcgccaagcgcgacggcagaaagcggcagcggcccgtcatggcgcaccgaaaccagcggcagtcgcacggccacctgagtcgccccttcctgctggagccagcgaggggtgcctgcagccgggacaccttcctctccgcgtctcctcgtctcccgcgcccgcgtcaggccgccagccttgcccaccgccccgagaagagcgcgccgggcgccgactgcccctcggggcgccgagcggcggccctggacgtgcgggggcctctctgggccggccgcggcgcctcggccctgccctctagctcccgcgttcgctcctaccctcttggctctcggggcacagcgcgcggcccggtccggagcagggcggacaggagcgccaggcagagcggcctggccgccgctaacggcgcacgcgcgcgtactcggctcggatctaccttccagtagcagcggagtggccaatgggaccgggaccagggctgggggccggggggccgccgccgcggggaggttcccggctcaggtgcccagcgctcaccagcccagcgcctcgggcggcgccgcggtggccccggcagccccgcgcagctgtttcctggggggcgtggcgtcgggggcccgcgcggcgcagtcctccttcagcatcccgaacagcagcagcggtccgcaggactcgcaggactcggtgcacagcagccctgaggatggcggcggcggcggccagcaccggccggtgggcgggagccccggcgggccgcgcctggtgatcggctccttaccagctcacctctcaccgcgcatgtttggaggtacggacccctctccacgcgcccgcgctcggttctcccgcggctgcacgtgggccgtggccgccggctatttttaccgttctccttttctccttccgccggggcgccgggggctgcttcccggcccagcccgccaggggctgcttcccggcccagcccgcgccggtctccatcctgggaagaaacccggcacgtaacacctgcggtgtcgctgccgcgtagacacgtggttttgtttttaaacatcgtgagcacccacacctcagcgggtactcagtagagatagtctattttccagtgagttgactggagcaaatgttgttttacagcaaacccacgaaatagcccttgtggttgtggcttttagtaccaggaagtcaggaggagacggttgctaaatgtagttctatctggggactcgagtggggcacaatttttaaaagccaaaagtcagagggtctcaaatgaactctgagttaccatctttggaccgacttttaatataaagctgtaatccttaaatctgtgtcagtagtcccacttactatgtcactttaattggatgaatgcgttaatgaaaagtttgttttcaaacctcactaaactgctacttaagatcacagttaatgtgagtcctgcttaatttggaaagcatttaaaaaatggaaaagtttcttagggaagtaaaaattttgcaactctgcctacaaggtacagtaattggctaggttcttttgaagagcagtgttgactagagttaaggaaaagtcagttgtgaaaaatggacatttttaatagcaaaatgatgtgctttactgtagaaacaggaggaagggtgcattatcctggggaaaatgaattcttcagttatgttttatgctgctctactttattgcaaaacgctaatattaaatgaatcaagaccacctccccttcccgctttatgaaaataaatagaagtatagaagataagcattcccatttcatcgcattatgtatctgatattagaagaattcgcaactgagcacagatgagcaacgaaaacaccatcccctacatttttgtgcctcttttacttacatatttgtaaacgtaggaactgtgagtggagacttagtaaagtggaatacgtagtaatttatctgttgtgatgttctgtgctatcagcacacacgccagcataaattaaaaataggaatgtcatgtttagtttttcccatctttttagtaacgctttgtacattcaatatggaacgacgcttgacttttaattagctaccttgttttaaagtaatttttgcttcttaaaaatattcatccctcttaaaattgggccatttttaaaagtcattagcttttgagtaaaagaactccactggtgtctttaaagtgatttgatcacaactaacacagcagttgaagttgctgtagtccgcactgaagaatataaaaggcagtttctgagaattggtgattactgcgaaaatgaagagcaaactggtttttaatatttatctttttaaagtgaaaatttgcatttagcagttatcaaaagatgaatatttgtttgctaaagaagggtcaataggaaaagccttgtcaagttaatatttaatatgctgatttttaaaaattcactttctaagagctgatcattccctttgagaaacattatagttctatgggtttattttgttaagtaaatgcattctattcagagcaagagacagttgagccccatgctattcctagtaagtaaaaatacctagttgcttaaagttggagataaagcatttatcttttttcttatctaagttctagatttgtgcactcattatagttcttttagtgctgttggggttgggtgactggggcctagtagtacagtgacactttctgaggaacttatagcagcctttctcacccggctttctggagacaattgtgccgtagtgtgcaatgaattttaactttcagcaccagtgcatttaggacggttttagttatgtatcattcttggaacaattgagaaaagtcactgaaataatttcctatgtttggtgattcagatgaggaacctcagttgagaattgctggaaagggatcagagaaattacctgttcttattatatgacaggatcggatgaaagtgccacatcctgaaatctctgttgaggcagggagatggaatacacttatgtaaaaacccatcttagtggcattgccttactgagatttttacctatattttagtggatgggttattaggaaaacaatagaagcatgtttctcatcatcttgagatttagggagctagatgaagaatcttataattaaaaaagttagacttgactgtacttcacatttacttaattttttagtatctattatagcattattgtgtttattcagttacaaattgtataaatggttatatacaaataactccatctgaaaattgataaaaggattatttcagaattaatggaaagttcatattgatttttgtaaaactgttgttttaattgttgtttatattattaacgtctcctaataagaaaatgtggtactaataagattcaaaattattctcttgtgaggtctcatgtaatttatagaaaatgaaaaacagtcccccccccttttatttttaacacttaagagtctagcaagtggaattgttagtagttccctcataatgaattgccacattgaacgaggaagttttctgtgttggttttatgttttgctgtcttttggacatctattttcgctatatacactcttattctctctagagaactggaagaaaaatgcctaatccagatatttcagtgtgtagaaatttcctagaattgagttgccggacatcagaatgtgattatatttaggagttcttaggtgaagtaaatcttgtccttattattcttttcagactgaggagtgttaaagtgaacagacgctttcttgactactgctagtgtcgtccatcacctttgttttaaaaaaggtcttaagggtatttcctaatatttaaaaatcttgacggtattttagggtttgtttggctttaatttacgtctacgtttttttttccactgtcaagtagctattgttcataagagcataacatgagtggtcaaatagcctttaatgatgcagcaaggatggggtagatgaattgggctatagaaatataccaatacatggagattatttccagagacatcgtgtggacttctataatgtatctttgagtccggaagtgaaaatgtaaaatgacttaatctaagacaactagtggtgctgggttgcttttggcctcctgattttcttgagcttttttgggtgtggcttgctcatgagtatttcagtagtctgattgtaactcaggtgccttgttacttgtgcaacatgttttcttatattgaaggagtgtgggttatctcttaaaactgaatatgttgaataagacctgtatttctaggacgatttctcttaatttttaagcagatgtgaagttttatgctgttaggttgtcttcatcaattaaccattatggaattggtctcagttatctcttcttaccaatatcaagtgccaaaatgtttgaatttgggatactctaattaatctacttcctattcctgaatgttattttgtgccattgaaggcttttatggggagtggccaaagaggaatgtttgcctctttctaagaaaaatgagccttctaaccacaacccctgccactcctgaagtaataagaattttggtggttattgtttctcacttgtaatttcataccttcgtgttatatgttttgctgtgtgtaagtgtggcctgtgtcatggacgtttctgctttggggattttttggaactattcttgactgcaaggtggggaggattggtgagttgcacagggcatcacctgatctgagagcagcgtgacctaagaacctggtattttgatgctttgctggctggtgcagtgcctgagggagtaagagccctgttgttgtcagatagtgtcttactccctcaggcacatctccagcgagtctcttgctctcctccaatttgattgctttgcctggtgaccagtaagtaagttcttttgattaccaaatatcattaattagatatcaacttttaaactatttattattatttgggtttgtaaggagaattgccctaatattaaacttattacatgtactaagtattatgtacaattgggtatactggcaaatgtgttaaaagagagtgtaggaactgctttatgtagcagattacttcctaagttttaccttatgtgaatattcttaagaactattgtttatttgaaatgttagtctgtgttttaattttgcatatacatgacatttatttgtttagaaattggacaaaacataggcctttttgtgaacaaagagttcagaaataccttaggttctgattttattcattttctttttttttttattttattcatgttctaagctgcttgttcacaaataactacaaatttagctgttctaagcaacacatttattacctcgcaatttctatgggtcaagaggctgggcacaacttagctgtgtcctctgtaagactgcagtcaaagtgttggccagggctgggttgttatgtagagactcaactggggaaaggtctgcccccagacttccttgggttattggctgaatttatttccttgtgtctgtttggttcagagcagcttgcttcttcaaagtcagcaaaggaagagagtctatcaaaggtgaactggtgctatgttcttacataatcgtgtacatgtaatcacatacaacccattgcctttgctgtatttcattgattagaagcaagtcataggtccagttcacgtgcaaggggagggaattatacaaaggtttaaacaccaggaagtgtaggaatcaagaatagtcacatcaattctgtctgccacatggattatagacttagattgacagctgaacatgcaacttttttttaaaactcagtttttatttacttttaaaaagttgtactaatgcatatggtaagtatagtattaataaacatgaattgagccccttttaggggctgggcattgtagatattcagggtttaaatgtggggcttctttatgcactgctcaactctccattgaatttgagagatggatatgtgtgatcattatacagtgcaacaaattcagtaatagaactgttaacaaaatgcttcgtgaagtatctttgtctaggctagtcaaaaaatgcttcacagaggagggtacatttgaactgtagtttgaaggatttagaagttttatggagagagggcactgtagactaaagaaaaatccacaaaagcttgggttttgatagggcatactgaaaagttaaatatgtctggactgtagggtgcatagaggaatgatgagcacctgaagctagaaaaatagaaagtggagccagttgaaggattttatagtgctgtaggtttgttttatctaatgaagtttgaaagcagggggagtatcatgattaggccattgggcacaattaacattcgtagtttacatggatggcaaccttctctagtggtgcagacttcaggctgtatgcagcaaccctgatcaggattcagttcttaaggaggagagtgtgatagcaggaggataagttaggattcttttagaatataactgatagaagatgcctacgttgaaaagatggcattggtgagggagaagaaaagttagatttgattgagatttctaaggtagaactgatagaattgagaacctgggtacacagtgatgtctttaaccagtattaaagatgaaaataacaagttttaggaaatgataatgagttccttttaggcctgttaaatttgagtggctataggatttccatctggatagaagtatcctttaagtggctggaaacatgagtctctaattcaggatattacaaaaaactgagaaatcaaattgcaggatataaatgattccagaaagtggataagattactaagggatgaatatagattgacgaaggacaaggatggaatccagaggagcaagtattttaagagacaggcagaggaagaggccagcagttagaattcaaccagagggaaaggaagttttttaaaaccttttttttttaattataaaaataatacctgttcactagagaaaaactgacatacagaaaagcagtggctcacgcctgtaatcccagcactttgggaggccgaggcgggtggatcatgaggtcaggagatctagaccatcctggctaacacggtgaaaccccatctctactaaaaatacaaaaaagtagccaggcgtggtgatgggcgcctgtagtcccagctactccggaggctgaggcaggagaatggcatgaacctgggaggtggagcttgcagtaagctgagatcgcgccactgcactccagcctgacccacagagtgagactccgtctcaaaaaaaaaaaaatcgcaaattgcttgtaatcttaccactagaaataaccagaaaaaagtgttaatgtcttttatatatgtatttgttttagacacaaaatttggaacattcatttttatattgttttgattttaacctttctgatgttctaatacgaagttttaaagctacacattttcctccaagaattgctttacctgaatcccactgattttgaagagttcttgttaacattcagtgaaaaatgtattttaatttcccatatgatttcttcttgatccatgggttacatattctttgataacgtgctctttccatttccaccagtttctaacatcacattaaaattttttataacataatttttaattattacccagtattccaaaaatcactcaaatgtttaatgaggacccgctcttccaaacactattctgggaatacagcagtgaagaaataagataaaaatccctgcttttaggggccttattattctatttgggagagatagtaaacaaacaagtaaaatacatagtgtgttagggcattgagtgtaatggaaaaaaatggagtgcaaaggctgatagagattatggggtggaggcctatctatagttgctattttaaatcgggttttaaggatgacctcactgacaaggtgacaattcaagcagaaagtgaaggagcaagccatgaggatctctgggggaaaaacatattcaggcacagggagcagtaactgtaaaagccctgaggcatgagtgtacctgatatgtaggtttactacagctggagtgcagaggggtatacaagatgagagcatagtggggtggcatgaggttgggacagaatcataaactgcctcataaccactgacctgtggtttgcggcttttgttttaaagagggatggggagacactggagtattttcgtgcagaggatagacataatctgacttgggttttaaaggatcactctggctattgtgtgaggtgtcaagagtcagcaaggaggcaaaaatccagatgaaagataacagtggtttggactgggtggcagtgctggaggtgctaagcagtggccagattctggatatcccgtgttttgaagatagagccacctggattagatgtggaggtatgagagaaaatgaagagtctaggatttacctggttgttccttatagctgagcatttagtttgtttggtacagttataataaaatactgttgccatgaacaccttggtaagcaaatttttacagttttttttttttttttttggatggagtctcgctctgtcgcccaggctagagtgcagtagtgcgatcttgactcactgaaacctctgcctcccaggttcaagtgattcttgtgcctcagcctcccaagtagctgtgattacaggtgtgcaccaccatgcctggctaatttttgtatttttaatagagactgggtttcgccatgttggccaggctactctcaaactcttggcctcaagtgattcgcccacctcagcctcccaaagtgctgggattacaggcctgagtgcccggccagtttttagaaatttatcagcgacatgggattgccagaaacaaagatatgcttttgttcaaggcatttgatctttattgccaaattgctcattagaaatggaaacagcttctagcaaggtatactctttaggactatgaaaaattttttaaccaataaaagcttgtgaggtttttgatatttataagtgcagattggtagatatatttcgagtaatatcacctgtcagagtcattatttcattcagggctctttttttttagcaacgaaaagatttagtgtgtcagaaaattataggtatattcagtcatttgaatttcataagttctgaccatgtggaatatcctaatttttgcttgaattgtgattagtgtgtaatagttctttaatttacctatttacatatgagctgaggaaaaaaaagaacaaagaagccatatatacataatgggttatttattatgtgtaatatgtttcagagagccagtgctcagttgaacaataaatttttctatttttgttggtttttaatttttttctactgttacctctgttgtgttctgtctcattttgtaaagttaattttgttctttctcctagcttcttagttcttttattttttatttatcattttttaatgataaaagcgtttaaggctgtttacttctcgttaacatgtagtcacttcccatagctttggatacttaccgttttcattgtcattgagtacacattttttatcttttaaaagtcagttctatcgaggaataatcatgttaactgcattttgatattttcttttacttgaaagttattttaaagtgtggctttattgtggttatccttactactaccctatcgttacttctagtgttaatttagaaatattgcaccgtggctcggcactgtggctcacgcccgtaatcccagcactttgcgaggccgaggtgggtggatcatctgaggtcaggagttcgaggccagcctggccaacatggtgaaaccccatctctactaaaaatacaaaaatcagccaggcatggtggcaggtgcctgtaatcccagcttattaggggggtactgagacgggagaattgcttgaacccgggaggcggaggttgcagtgagccgagatcgcaccactgtactccagcctgggtgacagagcaagaccccgtctcaaaaaatataaaagtattgcaccatggtcagagaatcttaagtctttcagttgtaaaggatagaagcataactcaaaatagcattaggtggaaacactatatattgtttcaaattattgaaaaggatcctagggtaacttagagaattgaaggaacaaatgcaggaaccaaggcccctggagctgaaatttggacagggagagagggagggagggagagagagcgagagagagagagagagagagagtgtgtgtgtgtgtgtgtctttgtgtctgtgtgtgtctgggattacagctgtcagctactgcccccaggccccagtatgggccttctttaagctggggccttgagactctctgtacttccaactacatgcagtcttacaggcctgaaaggagtacctttctctacctccagcagaaaggactcagattagctcagtttgagttctgcgtctgtccataaattaacgaaagcagaaatgggatgcactttatgtccaggctgtattctgttattgtggggaagagtttaagtcttcaagtcatgtttcttgggctgaccttaagcaagtttcttagttcctctgtacccccattttctcatctctagaatcaggccaggtgcattggcttgcacctgtaaccccagcactctaggaggcccaaggggggcgattgcttgagctcaggaatttgaggtcagcctgggcaacatggtgaaacccaggttctagcaaaaatatgaaaattagccaggtgtggtggtgcatgcctgtagtcccagctactccagaggctgaagcaggaggatcacttgaacctaggaggctgaggttgcggttagccaggattgcaccactgcactccagcctgggcgacggaatgagactctgtctcaaaacaaaacaaaaacctgcttttgtagtattatgagggttaaagtagtccacatacttcatacctttatgcttttaactattgaaggaacctcttcaatgaatgaaaaaattaaaacatccaagatttatgccgcatttccagtctcaccctcctcagaatgaccatgtgctttactctgataccgtattcctttctcttcccaactgatcagactttgcaaaaacaatccagttttcattatttttagaatgtatctttcttatatttacaaaattctcccctgaacatttgaattgagtttttcagcacatttactatgccaaacacatggtaaaaactttgtaaatattgaatgtttcccaaaatgtatttgataactacactattatgttgtaagatgattattatcagaattattgctgtgtttaaattatgtataaaaatgtattgctctagaaggaagtggtaggctatgtttttatttgtataatgtaaatataggtaaattaatttttgaaccaaataggtataatgtagattatacaaatggagacagttataaaattgccttagaagtaaaattatactgtgcttatagctcttttataaccatttgaatgtgttacaaagtgttatcaatgtgagtgtgttttgtgggcggttggagatggttggaaggatggttgataaggtaggtcagtgttttcattaagtgtgtgctgctgcttcagggcagaggctgaaaaacttagattttttttagttacatgatttactacatctcaggcaacctggatgacttggcatttactaaagcaattcactgctttgctggtgcttcagcacccttcagtctgacagccctgaagtcttgatttgtaattctccatatttcctatcatagcacttcttcaaaaacagcatatctggtcaccttgaaatgtcagttccttaataactccttttgtccactcttcctccaccttaccatacacagagttctttggaggattgccattagtttctttaaaacagaataactaaaattaagaatatttaatattattggccactttaagtgtctttataaatattgaactaatacagttactttcatatagtaatttatgtgttaggaaagttacttcataagcactatctcttttgagtctatgtcataagaagtcggtggtagagtagataatttttttagctattatctggagatgagactcagaagttagatcaaccacttgtagtattttaagtgtgagttattctgtattttagttgtgaagtgtacagaatctaattagcttttaataattcagagtccttttcacacttggctgcttttcttttcctgtacaattttgtgttttctcttttgtcttttaaaaatttgttagttaaaaaaaactgtttagttttacaaccctccctcatttgtataaatctcctctcagattattcatataatgagtattgcctgaatttcattttcttgttaaagtctcttttgagaccctctgacctaccctgttctgaaatgattatcctatgagatccctctttgttcatcatcatcttggaaattgtatttgcctgcttctctcttatgttcagtttcctggttccttgaatttatgtgtcttctttcttgatgttctccattgtttttagttgatataatctcatagttcctactgagaaagaatatgtgtaaggtaaaatttttttgaggcttccattcctgaaaatattttatttctgccctcatttttgattagtactttgacttgatatagaattctaggttgaagttattttccctgagaatttaaaatgtgttgccttgttgccttctggcttctagtgttgctgttgagcacatagatgtcattatggtttttgatcctttgtatgaaaatttcattattacatgccatgggagggaactcttttcattcattgtgcaacatatttggtaggctctttgagtcagctgctttctgtgattttttttttttttgccatttttttctttgatgatttagatgttgtacacctagagtaatcctttgctttttcttttttctcttcaatttttttatgtctttggtttttgttctttttttcttttgagggatttatttatttaattaaagacaaggtcttgaggctctgtcacctaggttggagtatagtcatgtgatcctagctcactgcagccttaaactcctgggctcaagtgatcctcctgcctcagcctcttgagtagttgggattacaggtgcatgccaccatgcccagatagggacttttaaaaatgtgatcttataactcttttgtcagtttttatttgtttctgtaattttaatttttaacttaatttttaatgttttttaaaatttctgaggtctttaaaaaaataatgtttttttcatatattccatttttgttttgtgggtacaatatctttttctaagaatattactgatgcgtatttacatgtgcatctgtttgtgtataagtctatatatgtatgtgtatgtatatatatgtatgtgtatgctttgttccctttcctgatgactcagtttcttcccacttgctttttctgtttgtttggcttcattcttttgttagatattttctttaaatgtttggtgatctttggcctactcctgatacttttaaagtggggggcactaaaaagcaaattggaagctctctgtgcatgtaatgtcctctgtctgggccattttcttaggaatattactgtcttttctcttgggctggtcatattttccagaaatggcttttcttgcctggaagacacaatcgtttctgctagtggtctaggagcagagtaagaataagattgagagtcttaatactcaaagtgatactttcatttaatctccatatttagtatcaatacaggacctctgccttcagctattcctgttgtctgcaagtctagaaacttttccctctcctaataacaaatttgtagtagagtgccagggttggggttgcttagctgctgcaagtcagggaggacaactgggagatctcacggcttccacacagactggcgatgaatctttctcttttaggcctgccttcacccctgcttccagagatatcttgtgcttgccaattcttgtgcctgctgtaaagcagtttgcttctctgctttcctagttctgcagtgaaaattattactcattaattttctttccagagtctaaaggtactgctttttatttcatcttcttgaattttttataggcgtattccctttaaaaattacatttttatcattttagtaggatgtttggactgagcggaagctaatgaatgtgtacaactaattatctttacttagaagttttctttttttaattgcagaagaaataagaattcgctcctataaaaatttagatgatgcagctgggcgtggtggctcacgcctgtaatcccagcactttgggaggccgaggcgggtggatcacctcagctcgggagtttgagaccagccggactaacatggtgaaaccctgtctctacaaaaattagccgggcatagtgatgcatgcctgtaatttccagcgactcgggaggctgaggcaggagaattgcttgaacccaggaggcgtaggttgcagtgagctgaaatcgcaccatggcactccagcctgggcaacaagagcgaaactatgtctcaaaaaaaaaaaaaaaattcagatcattcaaaaaaagtgaaagtcactttcagtcctctggtatgaacatgttcaactagtcctctaaggaatctaatggttttcaagctttttttttcttttttttgagacagagtctcactctgttgcccaggctagagtgcagtggcaccatctcggtttactgcaacctgtctcctgggttcaagcaattctcctgtctcagccccccaagtggctgagattacaggtgtgtaccaccatgcttggctaatttttgtatttttagtagagacagggttttaccatgttggccaggctggtctcgaactcctgacctcaggtgatctgcctgcctcggcctcccaaagtgctggaataaaggaactgtgtattaacatgttaacaattcataactgcacttcttatgacattttgaaaatctatgtatagttacagaacaatgggttttgttaaactatcacatttatacttgcagaaattatttcatcattattagtaggaattttattggttcaataaaattggcaaaactgaaaaaaaatagaaatttatatcttacaattctggagtctaagaattctggagtccaagaaagtccaagatcaaggcgctagcagatttagtgtctggtgaagactgctctccacttccaagacggtgccttgatgttgcatcttctgaaggagaggaacaccgtgtcctcacatggcagatagtaggagagtaagagagctttagtcacactcatgaggggggagtcctcatggcctactcacctcttgcaggtcccatctcttaatactatcacattggccattaagtttcaacacctgaattttggaggggacacattcaaaccatagcagtgcccactggcatttctggattgccagcctctttaactccaaatctgagaaaatgaggcacaaagagagcccatggaactcataaccatgttattctttgggtctcaagtctgtcttctctctacttttcagtcttcttatgtttgatttgtatataactcaaagggttttcagttgtacttcaagggagtaatcaggaaaagtacatccactccgtcttcccaatagcaaacatttgtattacttaaatatttatatatcgtataggcaagagagaaggcaatgctgtgagggaaatgtatggcactaaaatgaatatgttagaaaagaggaaaaaaatcaataatctaagcgtccagttaggaacctaggaaaaaaagagcaaaataaactgaaagccagtagaatcaaggaaataataaagagtagaaatcaatgaaattgaaaatagaaaaataatagagaaagctgtattagtcttttttacattgctataaagaaatacccgaggactgggtagtttagaaagaaaagaggtttatttttgctcatggttctgcagaccgtacaagaagcatgcatggtaccagcatctgcttctggtgaagaccttaggaagcttataatcatggtggaaggcgaagggggagcaaacaagagagagaaagtttccagtggggagggggcaggtcaagacagagggagcaagagagagacgagtgaggtcccagattctcttaacaatcagatctcacataaacttacagagggagaactcccttattactgtggggtgggaaccacgtcattcatgaggattccacccccatgacccaaacacctcccactagatcccagctgcaacactagagatcacttttcaacatgagatttggagggaacaaatatctaactatatgaaaagccaagggaaaaaaggagctggttcttcaaaaaggtcaataaagttgacaaacctctagcaagactgacaaaaaaagagaagacacgaattatccatatccatgtcaatgaaacaggggctatcactgcagactctgcatacatcaaaaagataataagggaatactgtaaacaactctacacacttaaatttatcaatttagatggaatataccaattccttgaaaaactcaaactattgccataaataaaatcaatataaaatagatcatttaaatatttctataactattaagaacttgaattcaaatgtagaaattcttcaaaaagaaatctctagacccaggtattttcactagagacttctgctagaggtttaagcaatcattaacatcaattctatacaatctcttctggaaaagagaagaggaaacacttcccaattctttacctcaaactattattaccttgatactaaaaccaacaaagtaccaacagtatcaaaacaaagtaaacttcagactaatatcccttgcgaatataaacacaaaattcctaaacaaaattgcaaaaatagatttcaataatatattaattatataccatgaccaaatgaggttttcttccagggatgcaaggctgtttcaatattcaaatacatcatattacatgttaacaggcaaaataagaaaaatcacataatcatataaattggtacagaaaaaaaatttgaaagaattcaatacccattcatggtaagaactctcaggaaaaaaaagaaataaaagggagattttctcaactgtgtaaaaatcacgtgcaaagaacttgtggctaacattgtgcttaatgattaaatactgatgctttctcctaaggctgacaacaaggcatgtatgttcacattcaccacttattaaacacagtgctaaaagttttagtgcaaaaggcaaataatggaaataaaaagcatacagattaaaaagtaagaaataaaactgtccctatttgcccatgccagaactatgtaaaaaatcccaacaaatctaaaacaacaacaaaaagataaccacaacaaaattcgtagaacaagtgagttcagcaaagttgcgtgataaaagataaacataaaaaatgtattttatgtgctaatgatggacaccaaaattaaaactataattctatgacatgaaaaacttaaatgtatatctagcaaaatacatataagacttagatgatcaaaactatacaatgctgatgaaaggaatcaaaggtgatctaaataaatgaagagatataccatgttcataaactggaagattcagtaaagatgtcagttcttccaaaattgatttacaaatttaatgcgattcttatcaaagtcccaacaagatttttgtagatatagcatgttgtaaaatatatatgaaaaggcaaaaaagaacctagccaaaccaattttggaaaagaataaagtaggaggaatcaggctacttgcttctaagacttactgcatagatgcgttaattaagactactggccagacacagtggctcacacctgtaatcccagcactttgggaggctgatgtgggcggatcacttgagggcaggtgttcaagaccacattggccaacatggtgaaacccaatttctactaaaaataaaaaagtagctgggcgtggtggcatgtgcctgtaatcccagctactcaggtggctgaggcaagagaattgtttgaacccaggagacagaggctgcagtgtgctgcgatcatgccactgcactccaacctgggcaacagagtgagactcagtctaaaaaacaacaacaacaacaaaaacctatatggtattggcagaggggtagatgcataaatcagtggaagagaacagagaacccagaaatagacccatacaaaatatgtccaattgacatatttggcagaggcacaaaagcaattcagtgaaggaaagaaaggaaagatccactttcaacaaatggtgctggagtaatgaacatccatatgcaaacaaacaaacaaacaaacagaatcttgacctaaatttcattcaaaatggatcagttagatataaaatgcaaaactcttaacctttacaaaaaatacaggagaaaatctttatctctagggctaggcaaagaatccttagacttgacaccaaaagcacaatcaataggagaaaaatggacatactggacttcataaaaaatttaaaatttttctatgcaaaagaccctgtttaagagaatgaaaaggcaagctacagactgggaaaattttttgcaagccatatatatgaaaagtaattagcatttataatatataaagaacaccctaagatccaaaattcataaaacaaacaattcaaatagaaatggagcaaaatacataaagacacgtttcacatatggacggcaaataagcacaaaaagatgtacatcatcattagccaatagggaaatgtaaattaaaaccataatgatatatcactacatatgtgtaagaatgagtaacataaaaaatagtgacaataccaaatgcaggtgagaatacagataaacctaattttggttgtgcttaggttgtatccattgactactgagtatgtagcagaaggaaatttgcatagtttcattcattcaacaaatatgatattgaatcaactccatattccaggaagtaggcacctgggatacagataggaaatacataatgggcatgggaaaacagtagaaaacaaggtcattcgctgagcatgaaagggggagaggaggtttgcgataactggagagagaagatataaaacaggcgtcaaggggttagcaaaagtaaggctcaagaactaaatcaggatctgtggcctatttttgtaccagtaatgtgaaaaggacagtgttttcccccagctttcccgcagcagtttaagctaagagagtttaagacttacaggggagataaggaagaggggggtgggtgggtttcatgcctttctctaagtggctgctgttctcccaggctttaccatggaggatgctttctgagcactcttgctaatcttttgtcagcaccttatgagctctgtgtaaaaatgtctgtaagcaattgcagattcccttgctaacccatactaggcatttaccgactgactggtgaacaatttgagctgagttctttaccattgtgtctagtggcatgacccgtataattaaatgcttgtttctgttcttgcacatggtttttctttttaatttattttgggttatttgattgtcctgtgacctcagctccctgactgcttcaggaaaagttgtcaatttgaagactgtctggcttttgttgttgttgctgctgacattgctggaaggccatgagcaatgttctttttggctttctacatccaagggaaagctgacccaacatgattaaatccaactctccattttctccgtgtttatacttgggaatctgattatagctggagaaacacaattctgttggctggttttgttctcagttcaagaccatcaacctcaaatgaagcccttggtgctgcccaagaaactcacattatatccctagtctattcattctgttagaaaagagatcagcaagcttttcctataaagagccagacgataagtattttaggctttgtgagatagtctctgtctcatactctttaatgtgtttacatttacccccaggtttgtatatgcatgtttggtttgtttatctattcattcatgcatttgtttgatatttatcctttttgatgttctctgagtttcttggatctgtggtttggtatctgtcactaattttggaaaattctcagtcatttatttttcaaatgtttattcttcctcatcctttcctctcccactgggattctaattacgcatgtattagaatatttgatatggtgtcacagctcttagatgctcttattgtttccttcctccacttatttttctctttgcattcctattgacctatcttcatactcactgattatttcttctgctgtgctgtgtctgctgatgagcccatctaaggcattttttacttcttgtttttatttccagcatttccctttgattcttatagtgtccaactctctgctaaaattatctatctgatcttgcgtatcatctgtcttttccatttgggtgtttaaaatattaatcatagttacttaaatctcctgtccagttgttccagtatctgtatcttcttggggtctggatgatgactgctctgtctcttcggactgtgctttttcttacctttaggtatgcctcataatttttgctgaaagttagacatgttgtataagacagtagacatagaggtcagtatttttatgcttgaaaataagaacatctttcttactgttaggtctttattgtaggtatttgtgttaatctagttagggtgggcgggatttgaagtttgtaattgctgtagttaccaaagctggagtttgttgctgctatggatactagcgatttcaaattcctctagtggtaccctgttttgaacttggttttgggctgtcctttgtgctgctccctagaaagaaaatgccttgcaaaactcactcagtcacattccactgtgatttttaccaaaggcttgttaatgtaatgggcgaagagtggcaggttttctgatgttccagttaagcctcaatcttagacaggtactgtgaatttgggacttgggggctgtacccttcataagtgttcccttctcaaggaatatgattgttttttaacatttaggttttttttttttcttttttcctgcctgttctctttcaccagcttcactggatacccaccagtgtcctcagacaatgggtttgataccgttctccctgcagatcatggctttcttttccttaggagagatttcacaacttgggtgtgagcagagtctgagcaatgattgcttttcctgtcccctagccagcaccatagggaaagctttctctaaatgcttccccaatcttccctgacagagcctgctcgccttcacatttcatgccagctcacactaagcctgtagcagttcattaaaaatttctggtttaatctttgtaccagcttatatggcattcaaaagcatctatctcagtcaagccgttcctattccagaatgctcagttcctgttgctttctgcaggcacctgtccttgaaattttgcgttggttgtcctctgacctcagttttctgaagggttcaagaaaaggtgttatcttgcagtttgttcagctattttccttgtaggaatgacagtgtcatcattccagctctcttcatcatcaaactgacacctgaagcctccagaagctaaatatataaagaattaagagttctttatatattaggtgtattagccctttatctgtgaggtatattacaaatgttttctcctggccgggcatggtggctcacgcctataatcccagcactttgggaggcggaggcagggggatcactggaggccaggagtttgagaccagcctggctaacatggtgaaaccccgtttctactaaaaataaaaaaattagccaggcgtggtacgcatctgtaatcccagctatttggaggctgaggctggagaatcgcttgaacctgggaggcggaggctacagggagctgagatcacttcagcctgggcaatgacgtgagactctgtctcaaaacaaacaaacaaaaagaaaccaaacaaatatcttctcccagtttatcaactgtctttcgattttgtttattttcttttttaaactctgcccagttttgcctttcccatagaaaccccaataaaagtgagggcctaggctttaccctcagtcctgcttccgcctgtccaaactgtatctctcctgtagctctgtgtgatgtgacttgtcctcttctccaaggaagtattagtcataaattcttctttcagcggcactgatctatctgtgtcatcactcagtcaaccgcataaattaagacctaggcacagaacaactctgtttctatttctataaaattctagaaaatgcaaactaaaccaggccgggcgcggtggctcacgcctgtaatcccaacactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcagaagaatggcgtgaacccgggaagcggagcttgcagtgagccgagattgcgccactgcagtccgcagtccagcctgggcgatagagcgagactccgtctcaaaaaaaaaaaaaaaaaaagaaaatgcaaactaaaccataatgacaaaaagaatattagtggtttcctagggatgggatgtgggcaaagagagacaaaggaaggagggattaccaaggagcacagggaaacttcgggatgagggatatgctcattatcttgactggtgatggttttgcaggtgggccaaaactaatcaaactttacacttcatctatatgaccagctatcatatgtcaattatccctcaataaagctgttttaaaaacatttagggtatatctactggaaagtaaaactgcttttaattacagactatatcatcatgtacatagaaaaatccaaaggattctgcaaaaaagctactagaaccactgacttcatcaagatgcaggtacaaagttaatattcaaaatcaactatatttctatacgagagcaacaaaaaatggaaaaatgaaaaatttttaaataataccatttataatagactactggggcagactgtacattaaaaaaatacaaaacattgctgagactaattaaaaataatcaacaaaatggagatctataccatgatcgtggattagaaaattcaatattattaagatgtcaattcttcccaaatacatgtacaaatccaacataatcccaaccaaaatcccaggatttttttgagaaattaataagctgaccctaacatttagatagaaatgcaattttaaaaaggaaaaacaaagttggagaactacctactttcaagatttattgtaaagttacagtaatcaagacagtgtggtattgacataattatagatcaagagaataatagagtccagaaacagattcatatttaatgtgatcaatcaattttcagtgaatgtacggagacaattaattcaatgggggaaaagacagttaccacaatggagcatttctgaaaatgttttgtaactcaattgtggtgatggatatatagcttcatatatttgtcaaaactcagagaatggtacactcaaaattggcacattttattacatgtaagtcatacctcaaaaaagctgatttggtgacaaagatttatatatgttgttgatagaagaaaaaatccaaatacttattaaacgtggaaatatatttatccccataaataataagggaagtacaaattaaaacaaaaaagcatatcacagccatcataagagtaaaaatcacagggtctgacaattcaaaatctaataaggatatgagaaaattctagacagcagtgtgaactgccacatttgcttcagacagcaatttagcagtatctggtaaagctgaaaaatcacacactctataacagcaattccacttctaggtatatatcctagacaaaatattgcacatacacagaagaaaaccatacaaaagtgtacattttagattacattgcttgtaatcaaaaaattggaaataatatattaagatggggaaatacataaactttagaattcataaaatggttaaaattaaagaaatatatatatacagaaagttcaaaaatacaattttgaagaaaaaatcctacagtgacacattcagtatgagatcatttatgtggacttaaagcacataataaaacaatctctaaaaacagagattggatggatacacacaccaaattttaataaaggtataagttggactagaagcagaacaaaggtgattttaactgtatttataatattttaattattttaaaatagctgatgcaaaaatgacaaagattagcgtttattttagatggttgatcacacatatttgaatattattttctaagtctctgtagttttaagcatttcaaaatctaaagaataataatttttaaaagctataaaaatatgaataaaggactagaaagcagtaacttttcattaatatgctggattctgagacaactttaaactcaacagtagtatttaccatggtgtcaaatttagcatttatcttgagttcacaaactgagttcactaattttgtctccgtttttcaaatttctagcatttatagactactataacaaccatactctccctctcccctctcccctctccacggtctccctctccctctctctctccacagtctccctctgatgccgagcggaggctggactgtacagccaccatctcggctcactgcaacatccctgcctgattctcctgcctcagcctgccgagtgcctgggattgcaggctcgcgccgccacgcctgactggtttttgtattttttggtggagaaggggtttcgccatgttggctgggctggtctccagctcctgaccgcaagtgatctgcccgcctcggcctcccgaggtgccaggattgcagacggagtctcgctcactcagtgctcaatgttgcccaggctggagtgcagtggcgtgatctcagctcgctacaacctccacctcccagccgcctgccttggcctcccaaagtgctgagattgcagcctctgcccggccgccaccccgtctgggaagtgaggagcgtctctgcctggccgcccatcgtctgggatgtgaggagcccctctgcccggccgcccagtctgagatgtgaagagcgcctctgcccggccgcgaccccgtctgggaactgaggagtgtctctgcctggccacccatcgtctgggatgtgaggagcccctctgcccggccgcccagtctgggaaatgaggagcgcctcttcctggccaccatcccgtctgggaagtgaggagcgtctctgcccggccgcccatcgtctgagatgtggggagcgcctctgcccggccgcaaccccgtctgggaactgaggagtgtctctgcccgaccgccaccccgtctgggaggtgaggaacgtttctgcccagccgcccgtctgagaagtgaggagcccctccgcctggcagccgccccatctgggaagtgaggagcccctccgcccggcagccgccccgtccgggaggtggggggcagcccccacccggccagccaccccgcacgggagggaggtggggccagcccctgcctggccagccgccccattcgggaggtggggggcagcccctgcccggcagccatcccgtccgggaggtggggggcgcctctgcccggctgccccatctgggaagtgaggagcccctctgcccggcagccaccccgtctgggaggtgtgcccaacagctcattgagaacgggccatgatgacgatggcggttttgtcgaatagaaaggggggaaatgtggggaaaagaaagagaaatcagattgttgcggcgtctgtgtagaaagaagtagatataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacccttgttcacatgtttatctgctgaccttccctccactattgtcctatgaccctgccaaatccccctctccaaaaaacacccaagaatgatcaataaatactaaaaaaaaaaaaaaaaaaaaacaaccatagtcttttaggctaagtgttggaagatagtaatagatttccggctgtgtgactaaataaatcttactttactaacgtaagtccaagataactattcaagctcatcactctcactgtcccttcacgtggtcatcgtgcccacctacgaggtatccaaagccaaaagcccatccccatttagaacctttttggctcccatgactctcttttccatttggcttgtctattaccctggctattatttacacactaaagttcattctttgagttcatgagagaacagtttctggggtctttaaattttaagagaggaacttatgatattctgctcaactataaggatacacacaactaataaacgtgaaaggtcccctccctttcttaaaaagattgtgcttactatttttatctgataaagaggatcactctataaatatattatttgtctcaaattatgactcacctctggataaagatggaagcattttactgcattaattccaagaggatttcagtaagcctgtcattcattatcgtccccagtccttccaaaaatgaaggtgcttcaatattggtctcgaagtaggaataaaagtccctttaaaaaaaaaaaaaaaaaaagaaggcacatgttgtcaatgtaattaaaactttaaaatatttatttttatcacttctttagaacatttttttctgaaaaaaaaggtcaataataagacttcctaattacgcctcgctattttgcattcttggactttaaaaagcacgtattttcaggtgatcactgtactattctttcaagttttctataggctttcaaactaaagagttggagggatggtcgaatgatttaaagagtttctctaataatgtcttaaaatgtgtagacagtatatgttcaattttcccaaatctggttttatcccccacatttgagatgcttgaaggttgacatctgattaattctgtcataaacagggatgccttcatgcctctgtacaactttgcatatagaaaattacttctttttttcccatgctcttaggaaataaaatataatgaccataagcatcatgagcaaggaatccagtgcttctagcttaattcatagctccatctaatcctctgtgctaagtgaaagctcaatgttgattgactattgttgctcacaaatactatgtactaaaaagcagattattttagtgtcttacacttcagcatataaaataaaggcttcattaggatagtaaaagtgctgttgagttaaaattcatggattaacaatagcatgttatgtcttatttccccatcaatttcttgctttcgctcctaaaatctaaaagcaaaaaagggccacattgtttaaaatgcattctccctaaaaaatgctatatgctataatcatatctgcctcatccaacacgagtaactactaaattaaacgtctgttttagctgatgtctgaaaggccattacctcatagttgattggcaaaatatgagttcataaagaattttcctttctgcttaggaggataaagcaatacaataattaaaggatatctaatatgcaaaagtctatatttagggaaatattaaatattctctttaaaatgttcaaatgtcatacatatgttaatgtatccaatgctttgaaactttataggggcaatatagggatgaaaattaaaaagcagtgacggaggggcctggcataggcaaaatcatagagatagaaaatagagctgagtgtgattagtgtttagtgggtggagtttctgtttgggatagcaaaaagttctggatgtggacagtggtaatagttgcaagacaacacgaatgtacttaatgtcactgaattgtacgcttaaatgataaccattgacatttttctattacaaacttaaatctaaatttcaccataatttaaacaaaaagcaatggctagagtgaggagagtcagcttcaatgcttcagtaggcccccgaccagctgggagcagatctggaagatggacggttgtggtgtcttctaaatgtaaaattgcacaattttggtattcgctatcccatttactcctcacaataattatgtgagatgtgtatggcagaaaactccattttaaagattaagtatcgaaaaacagaaaaatatttaaaaattatatcaaaagtcatctcttaaaagagattatcttgaaatcaaaagagaaccaaataataatcatcatcagtaaaagacccagtaaaacatgggacctcccaactgtagccaaagaaaaagcaatttctgataacatctcatttcattcccctttatcacttcttcagtgctttctttgtcctccttcctcagctactataattcatcttcattatcttaaaaagaagtctgcattaggaaagggtgagagataatgaagtaacagaaaaataatctcaaacactttactatttaaataataaacctgggttatagcttatgaaacagtgcaatgaagtatcatattacaataagaacaagtttcaaaaccaacattaaaataagcgataagtaagaaagccataaaaaaggaaacaataaattgttataatattgtttttataatttgcttactaactcgtatgtttttaggcatttataatgcagtatggcacacacctgaaattccttaactcagtggtttttaaacttaattgttgccgggtgcgttggctcatgcctgtaatcccagcactttgggagcccgaggcgggcagatcacttgaggtcaggagtttgagaccagcctggccaacatggtgaaaccctgtctctactaaaaatacaaaaattagccagccatggtagtgcatgtctgtaatcctggctgctagggaggctgaggcagaagaattgcttgaacccagcaggcggaggttgcagtgagcagagatcatgccactgcactccagcctgggcgacagagtaagactctgtctcaaaaaaaaaaaaccaacttaattgtatatctaaaattcttgtggcttgtttcacccttccttccatcccaggcctctaaatcagaacagaggcaggttagtgtttgttttttaagtttcaagtgattctaatgtaccagccttgggaaatacctccgtaactgttgaaaagggttcagaatataattttaaataaaattactttagatcaaaacagacttacaataagtataatatcacataaaggatcaactttcaagcgccaaagaatacaggtgtgtacttgaagaccttttagtagtgaaactcagcagctgtaggcagtgaagaaaggagcatatgtgataaacaaaattagctgtggtcaacaattatgctatagctaacttatgtagtcagtactttccagtgaagttgaaaataaagcaaagttccatgtattaaccctgttttccactaacccttctttacatgtaggacatatgccagggtaccaaaaactgcaggaatattccctagcattgcagcctcagttctaataccaaaatctccctgcagactaaatgtctagagcagcactgtatcaatagaacataggggcagatctcataccttccaagggtagaaatcgctgagcacaggtaaaaataaaatattccagagggaaatattattttacaaatttttataaacacttttgtaaaataatgtacacagccttgcacactgaaagagtcaaagccatttaactctgtataaccactgcagaatctttatcttcttttttacctgacttccaattggcgggtgttactaaaactttatcaccaaagttatttcactagctgagcgtggtggctcatgcctgtaatcccaacactttgggaggccaaggcaggtggatcatttgaggccaggagtttgacaccaacctggccaacacggtgaaacctcatctccactaaaaatacaacaaattggctgggtgtggtggcgcatacctgtaatcccagctactcagaaggctgaggcacgagaatcacttgagcctgggaggcataggttgcaatgagtcaagatcgcgccactgcactccagcctgggagacagagcaagactgtctcaaaaaaaaaaaaaaaagttatttcactagcaacatataattaccataaaacaaaggagggttttaaatgaactacacatgcaaaatacactagaaaagctagatatttttaaaaacgtggtgaattatttggtaaagccaaaatattttaattcataagttactattcccccaatgcatctattttgtaaatgctgtttcacatatgaggtttgtaaaaaagcaaaatatatgtataaaatggcgtacataaagatgttctacaaatatagccagaagttattgttttactgtatgcaaagagtgatggcaatttttaattcaaatgtttttaaatatttcgaactgaaactaaatcttaccaatgtaaaattgccacaaagacggctggaaaagagaaaagttattaaaagctgctttattataaaataccattaaaacaagtatttcaaatgtattattttacatgtctagaaaagatagcacagaaagcaagatggccagctaatcctgtctctatgagcataggaaaaaatccaggacacaaagtaaattctgaacagagcttacctctctgcagcagggcttgacaagcaaagggagagacttgagagggtttttttacttcagttaattggtaggagtgatggaattatggaatattgtgaccttttttgtttttttttctttttagtattctattcctttatatgaaattttttaaagaagtaaatatatacagtatgcttcagctcgttctaaccaagaggtgccactctagatcagtttctctagcattcatcagaagacgattaaatgcaggcaatcacttcctcagcagcacatctaaaagccccattgtgcaactcaacccttgatgaattgcaagctctttgcaagcgcccagacttaggaactactagatggcctaggagacttatctggaggcacctgtgccagcaccccatgtatacgtaagacttcaccagggagctgggagacactgctctgggtatggagcttttaccagagctgcaaacgcagcctgtgcccctgtttcgttggggaattgcttgttttcaagggtaccatggagctggagagagaaaagtggggaatagaacaagttaaaacaccacagactttgctgttcttatagaggttcagcagcttttcttgaattaatgccctttagattgttgtaaacctttggttaacttccaaagttttgaagaaaatgattttgataattttccaagtattttcattgtcatcatggaggagtgcatttccttggctattccagaagtcctacctcccttctgagattttataatggtatttcttatggttatcccaaatatacttggcaagtcgtcttataaaccaccaataatagcctcttaaaaattcaaaaattactcctcttggctaacaaaataaatgcaaattaatttaataattgttgaagaaattaaattttttaaaattaaaaaattgcaatgttgaaattctcaaccatgcttatccagaccttttcctatactactaactgccctgggcttatcttaaatacttctcagaagatttacttgttttacaccaggataggcaaagtatggcccacagtgtatttttggactgtctgcaagcacagttgctataatttttaaaaggctgaaaactttaaatttttgtaaatatgctcattaactgtttattaggcttcattaattttaaaatatacagagactatcctattcaactatatttgtatcctatttctaattctcctaacaattatatacactggcaaaaactcttcagatgatatataaggaaaaggtcaaatatactaccgaattcatccagctttccaaagatgctcaaaatctttctgtgtctctcactccctcccttaacccacataccacatctgaaaaaaaatgatatggtgtaacgatgccagtattctaaatgcttgaagggcttatcacatgccctttccaagctgtgacagaagcatgtcccttggaccccggcatcctgtcaatctcacctctgaaggtgacccagtctcatacttcactgaaacaaagaccattagacgccagcactcccgacttcttttatctccactttaacatttctccatatagtaatcctcacttttctactccctgtcatctcagaaaaggaattctctctcctcttttccacagttagcttctcaaatttgtgcctttaattctacccctcccaaatattccaagacttgctccactaattatttcctctcttggaatcttaatctcatcctcttcccttgatccctcccctcagcctttaaaactcctagaccttaaaacactctctgtgatctgacagcccttcaaaccaatatactccccatctctctcccctggttcaatggcaagatctttggccaactgctttctactcggaccttgctattatttgctactaggcacccacaaaccgttgcttgttaaactgatctccttcaagacttaagaaaagcgccatgcggctccctcccagggctctcctgccctctcctcaccgatgccaagagtggtcctgctggagaactgccgcgcctgcagttcgtgcaccttttcccgaagctgcgccaggaaattatggacgaactggaaggggccgagaagaagggtcttggcccccaactgtagctccaagcctttttgtgctttcagatttcggatcctccgcgtggagcaccttggggcgccccttggcaggttcccgccgcatagggccgacttttccacctctggctccagggcgggaagattgtagcggctttgagcttactacttgttttcttataatccctggcggagctgggtcaatttcaggcacagcccagctcagtcaggcgaggtccagaaaggcctgacttgcctggcagcctcaacggacttgtccccgcagcccttgcggacctcctggtcgtcatggcgactgtgaaatgtggggtggggagcatgcgttcgaagccatttgcgcgggcagtccctgcgtgtccccccacgtgctccccagcactcgcaggacccccgcctccgagcttccctgagcgtgcagcttccagtgagggcagccccacgcacagccccccacaccctccccaacgccttcagcccccggtgcgcgtagtccccaagcccacacgtgcactctccaccttgcggcagctgcacgtacagccccccacacgctcccagccccactggcgcagaacccatcaccgctcgcccttcacgcgcttcactgggagtgcagcccccaccccgagcgcgcagctccacgcagcctctccacactctccccagcgcctgcagcacccccagtgcgcacagctctgccagtcgcttccccgcgtgccgcccctgcaccacttcgggccataaccttgctggcgactaagtctgaagaacttcccgtgatttaattcttttcttcgagtttagtcttagctttgacattttaaccaaaaggttacacgttaatttatggtatgaggtcaccacttctcctattgtccttctcagtttctccccaacctctcctattccctattttataagacaggagaaaagggagaaagcaaaaagttagaaagaaacagaagtaagataaatagctggaggaccttggcaccaccacctggccctggtggctaaaataataataatattattaacccctgaccaaaactattggtgttatgtgtaaattccagacactgtatgagaaagtactgtaaaactttttgttctgttagctgatgtatgtagcccccagtcacgtttttcacgcttacttgatctattatgactttttcacgtagaccccttagagttgtaagcccttaaaaggcctaggaatttctttttcggggagctccgctcttaagacacgagtctgccgacgctcccggccgaataaaaaacctcttccttctttaatctggtgtctgaggagttttgtctgcgactcgtcctgccacaaattaacgaagtattaaaggggaagatctcagctgaaagaaatgactgtaggaagtgtgtcaggaaagccaacggacccgcaggcccgcccgtggtgcccgcggcattaggaacgtctctgctctcctacgatcgctggggtatcggacagtcagtgcccgctgtcaatgcggagggaacgggccgagactgcgggcaacacgtggcagagccggcctgagtccggtgggtctgatcccagagcctcaggttgacgccaattccttggcatgggacagcgtttactgaatcttaaagcaaaatgcttttaaaataaggttcctcagaagtcgtcagccctaggagcggtgtgctcaagcgctttcagcaccagccaggaccaactaagaggggagcccttagctcccagtcaccgcgcagccctacaggaggccaaagcggctggcacagatgcactggggccactgacattttccatgtcctcttgtcacgggccatatgctggatggagcccacaccgcttcacttcccatctgtctgatgatggatcaaattgaactcccatatcctaactgaccagtctaaatcatggctcattgtggccaggttaatttttcctgatgcaacacagcacaaaaatgttcatggctccccatagcccacaaatcaagtcctaggcttgctcaccaatgccttcaataattgcccaatataccttttcaactttaatttcccacttcctcaggcacaaatcttccatcccagtcatttcaggtgaggtccacagcctgagacaccataactgctgaattcctttactcatatggaaaagccaccccttggcttttacatccttttctccctgcccatctgaatgctatcaccttccaagccccagcccatttctccagtccatattaattatgctttttctgaaggtctagagcacttaactgacagtactatttatcttgtcattcatttaaattcagtaagtgctattactgttcatttcttgttttgggagatttttttttaaggagcatttctacattcctggcattgtgtttggtgctcaaaatgttttcttacttaattcatgcaataactatatgcaaattttaaaatcaagcatcaggatgtagttatttgcccaagttttaacagctaataaattctatctgtccaatactgcatttaaaatacaaagtatttatggtggttgttaagaatatattcttgaatggctaggcaaactcaaaataaaggaccttattttaaagtatgactttttaatttttttgcaacaataagtgaagtggagtgattgtttttctttttagtcagtttgtttcttctggagtttccaactgccttttgcatcacttggtgtcctggtgggataaaatatgctcttacccatgatctagtccttgaaagtgcaaatctggtcattttatcatttaaaaaattaatctttttataagaatgttcattgtgctattatttatatcgttgaaaaaatagaaatggcctcaatgccaaacactaagttatgaaacattcatataatgaagcattacagccactaaagtcattttgcatggatatttaataatatgggaaaatagtcatgatatagtgttaaaggaaaaatgaagcaggatatattttatgattcatatgtttagtaacacataaaattaactgtgtgccatgtgctgctctaaatcttttacacaggggactcatataggaagattaccaatgtatgaccttgagctagtaatttagccactctaggattaatttcctcatctgaaaaatgaagacagttatatttgtcttactgatgatgtgatcgaatgaattaatgcttgtaaagcatcaaaaacaaagcacgtgcttaaacaaatgttcctttattatgttctagactggccatcctatagtgcagtagtgaggatttttaggttggtgcaaaagttattgctatttttgccaacacttccaattaatattttgctcacttggtttgtttgtcatcaagtgatatgttagtaattattgaacagtagtacatgttttaggttcattagttaacagagatagttgcctaaatcattatgtatctactcctactaaggagaggagtagatttgtgtataagagggaaatcatgacacttagttttatgtgcggttaaatagaatcatggatgttttcatgtttttacagcctctctaacagaggtcacttattttgacctcgttattttcaatggttattttagtcgcattttagctgcatactaactaatgacaataacttaaagcagttagcctgataatttaatctatgatgaattgtcaattaaaatagcacattataattaggtatgatgcaatatattcttgcattatcttatctttgaaacagacatgcctcatgatttagctttttttgttgctgttctcaagatagggtctcactgtgtcacacaggctaaagtgtgatggtgttcactgcaaccttgaactcctgggctcaagcgatcctcctgcctcagcctcctgagtagcttggactacaggtgcaggccaccacacacagctaatttgtttatttttgtagagacagggtatcactatgttgcccaggctggtctaaaactcctagcctcaaacactcctgccgcctctgcctcccaaggtattgggattacaggcatgagccactgcacctggctgcaaattatttgtcttacatagagatctctaatccggttatggatatctaaaacttgcctcagtttttcctttgtcttttagtaaagcaactgggaaaaaaatgccattaaactatttaaccagcagatggcaataatgatctgtaaatcaaaatttcaaaacgcagttacttattaaattcgttctttaaaaaaaatcactgttcttataataaatccatttactaaatatgaaatgtaggaaaattccaaatgtaaccccacataaaaattacattgcatatttcatatatcaaaataatcaagatattcatcatggccaagatttagttttccaaataataatgactttgttttaactgattcagataatttattagatttaaagttttaactttcacaaatacatacatataaatttaagtggatagttaagttccatctctagcctccaggctagatagaggtagttcagtgaagaccattttgaaaatattacaaacttttccacttataatttggtaatttaaaatatgaatttcactttaattgaaactttctgcataaaagattggtctttatttgtgctgtctcataatttcttatgcattaagatacttttccccctttgtacagtgcaaggagttggaattggcaccaaagtattagtctctagtttatcagctttagttattcccaaagatggtggcaaaattattgggatctcatagttattttatttagtaattttatttattttcattatcccgctctaagacttctacaaattccaacatgaaatacatcctttgtttaattttgtagctccatttttgtcttcaaaaaatagcatggccataggtatgttcttcttggagcttacttattttctaggcaatttcaaattggtctgtttataaatgttaaaagatcctttcaaattcttcttcagcaagttgcctccactaaaaaaagtgtctttggacatgtgtattttataaaacaactgcttcaatctaaaaccttccttagatttacatatcttggattgactcatttttaaatagcatatttgctgctgttgaattactttacagagcctctttaaattcatattggatgcaggtgcttcatcaaggagaaagtggaaagacaccaacttgccatgtcaatcagaaaaggccacaagcctgagtctgagagaaaaaaggaaaacaaaaatatctttagcaggaaataaagtgattctgctcttctagaattatcttaggtgagctacaaacctgctgctaactccaattttttcaacatcatttgaatatacctcatcttatatgcagattgactagtgttccctgaagctttccaattgcattcaattgaagggagagggccataactgtttaggtgccaatctctgtgtttttggaaacatgaaaaacccatgcctcatttctctgcaattgcattttaagaatacattatctgcaacagggctggtccagttaacattttcaaagtgcaattccaggcttacagaatgttaaagtggatggagtcttatatcttctggtctcatggttttcagattgctgagagactccaaagctgttccaaggaggtgactcaatattaatatttttacatggctgggcatggtggctcacgcctgtaatcccagcactttgggaggccgaggagggtggatcacctgaagtcaggagttcgagaccagcctggccaacatggtgaaaccccgtctctcctaaaaatacaaaaattagctgggtatggtggggggccgcctgtaatttcagctacttgggaggctgaggcaggagaatcacttaaacccaggaggaggaggttgcagtgagccaagattgcaccattgcactccagcctgggcaacaagagggaaactccgcctgaaaaaaaaaaaaaattcttacacacaacaatagcatagaaatcaagaggcgattaaatgtagttaaatagtttcaagttccttgaattatcttgcatgcaaaatgtggattaagattagtcattgatacaccaagaatgaatgttacaatttcagagtcatcactgaaataatagaaatgcaaaaatacatatctttcagactaaaagagaaggaaagctgagtgacaagtcactcaaacaatttgaaagaaagcaagaaaagagagaaacagggacataaaacagctaggataaacagaaaacacataggaagatggtggtttttttatccaaacttattagtaattataagtgcaaagagattaaatgccccagttaataatcaaagactatcagactgatatacaccataatagatatgaaaaaatattcttaatagcactaattataagagcctcaaattggaggcaaaacaaatgcccattagcagtagaatagataaataaactatggtatatttcatacaatggaatactttacagcaacaaaaaaaaatgaagaaactgcatatgcttgcagcaacataaaaaaacttctaaaaacataatataaaggtcaaagacagagacattaaagatatcatatgatctcatttatatgaaattcaaaactagccaaaattaaattatcatatttggcaatgcacacataggtaattgtattagtccatttttcacactgctgataaagacatacccaagactgggcaatttacaaaagaaagaggtttattggacttacagttccacatggctggggaggcttcacaatcatggcagaaggcaaggaggagcaagtcacatcttacatggatggcagcagtcaaagagcaaccttgtgcagagaaactcccatttttaaaaccatcagatcttgtgagacccattcactatcacaagaacagtacaggaaagacccatccccatgattcagtcatctcccactgggtcccttccacaacacgtgggaattatgggagctacaagatgagatttgggtggggacacagagccaaaccatatcagtgataaaactctaaagcaaagcaggaaatcactttttgtaagagtccagattgaaatatctttgtggggagagggaggagatgtacagagaggggctggcagagtctcttttttgctctagctggcaggttcaagggtgttcaggttattttggaagcagtgcagagaagggagccagactagaaacagggaggtgatcaactgggtctcggttacatacagaaaacagcagagacagctgaaagatccttctctgtgttcacagccatcatctatgactagcatccagtgatagcaggaacactgatgccaacatttttcaaagtttgcagaaacgacttggctcctccacagagcattgtgagtcagttcagaagaaatcaatatccatcttctgttctcttcttgcctgccaaggggacctggaatccttaagcttttgctcctggtttcccacttcaatattcatccaaagagtctcctcctgcttgttttcattctttctgcccttccttgtcccccagggtggagatctcaagtgcataataccccactatgcggtgatgttagccccagagcacagctgaacacagcattcctcaggagaagattcatcctctatatagggaacactggagatattgctgctctaaccccaaagaactcatcaccaaagcttgggactttgggcccatggtaggcaactggaagagctatttgtggcaaacagtgtaactcaaacatcatcataactatctgacagactttaaggaggccaatccaatgttctcaagcctggctgcatcatgaatcactcaaggaatttattttttatccagatttctgaacccccaacctcgattctgacttactgggttctgagtagaacatggaaatctgtatttacagcaactcacccaggtgatttatccaggtggctctggtgcaactcttcaatgggatggtaattaggagcatcccagggggtcagagctcacgtacctcatggccaggaactgtgtaggcctcctttgcttacatctaaatgttttcccctggtccaactggaatacgaatgttacctcctaagagtccaactttatcacttcttctaaccatctagatatctgctggtaaactcaagacatctctaattcttcctctttccactagagattaaatgcatttttttcacataaagatagactttaatctaatgtggttatgtatgcatataaatgtccaaatgagagccaagttgggaaatatggccatgtgttgatgtgatgtcttggaacaaggaaggacacctctgcagaggtgttttgagggctataccaacatgctgatgtgatcccttatcaaagcactctagagcagccattcttaaatattttggcctcaaaaagaccaaacaagtcctttatgattgcttaagtgtattgtatgcattgatatttacatggatatttataatccattcatgttaaaactttaaaatgaaaaaatatttgtttataaatcatttacaaataacaataataaactcactatattaacagaaatatcttttatatgaaaataactattttcaacaaaaatttagtgagaaaagtgacattgttttaactttatgcaaatctctttaagtttgacttaatagaagacagattttcatatcttctgcattcaatctgttgcaatatgctgttttgatggaaatatataaggaaaatcagtcctcacaaatatgtagttagcaaaaaaaagagtattttaatctccctctgcacttaatctgttgcattataacatgccatgtaacctctggaaaattccactgtacacatgacagaacaaaaatgaaaaaggcaagtaacatcttaatactgttagaaaaatagttttgacttcacagacccccaggattttcagacttggcccccacttccccactctccccacccccatcctagttctggaccatgctttggagactgaagactgcatcttcaaagaaaagcaacgtgctcctttctttgccaatagacagccattgctgtaacactgtcctcttggacacaaagctgaggcagctgaggcggctgaggcaggcaagctaagggaccattcgcatccatttgcagagctggtaaaagtgctaactatagccaatgccgattgaggcttcgttccaggcaacaaacacctcagcaggttcacctggtgattaaacccacctatgctgggggcaagaacctgatgccctacttacactggggacaggtgattgcttgaattgaggaagagaatagtcaagattcacctcaaagtcgatggcatttgccagggttctgagtttcagcaacaaacagcactcatgtttgtcagaatgagcctctgagccacctccccatgaacttgagcagttccccctctgagaatatgtttctcccagatatgtgcttgtccaacatccttgctttcctcagatctttgcccacatggtactttctaagagaggcccatccagactacatcatttaatactgcagctgccagcccagtaatccggatgcctgactatccggcatttttcttttgcagtagtatgtattgctttctaacatactgtacaatgtgcttactggctatgtttattgtttattgttgatatttctcatgagacaaagatctttgtttgattcaatgttgtattcccaaggacagaaccacacccaaaattgagtagacaccaataaatattagcttaatgaatgcacaggtaatatttacacatggaggggcaaaggagaacatcagcttcctataagcagcctactcccaagagaaggggaaggcagagctgagcatgcttggtttattctctgcaaattcatgatgcatggttcagccattccttttcatcagagtgactgaagggcaaataggaattgggaatgtgacatctccacaaagaaagaagacatcaggaatggaaaagaagaacccaccccagtatccccaactgtttgttattaactcatttgcattcaactcctaagcccatgctcagtttaagcctgtggtgatcctcagcgatcagaagttccagcaagagcattctgctccctcttcaacaggcactcccccagtgccaaccattgcacctgtgccctttatttccctattgtttctcagctccaaagccacccttctattcccttctcttgatggtggggtgagtactttgcaaaccaaatttctcagactacctcagtcattgacttcctgtctgccaaaaggagataggcaggagactggaagcaagcaagaacataattgtgggggggggaggtcaggggtggcagggggcagttcttcctccaagccccagccttgccatctcctcagttaccagcagcatccaggcactgtttgtcctgagttgcgtggagctcacccccagagtcccagcatcagccctggggccttctctgaaccctcaggatagttctaccctttacttttcgttcctctcgtcttaggaatattagcagctttctgcagttagactttctatgttactcctccttcctgctctttcagtcctccaatagccatgggatcagttccttgcattgagtctctctatctgaaatacctagtgtggtttctctttctttgcctggatggaccctaactcatacagcttctctgtagatacttttcggaacatcagtgaacaaattaaaattcatccccagggagctctgatgtgggtcagaaaatttgctaattaaatttctacaagactgcaaatccattccttattgcatttctcttcccgaagtatgctcttcctcattgcccaatataattggggtgaccatacataccaatgcacccaagacagtccaggtttttgcctgttatcccagcaaaattattaatatagcctcctttctctctcgaaactatgtagtttgagtgataaattatatggtcactctaaatataggccatcatatgttctacagtgaaattcaatgacaatattaagatactccagcaaggaggcatcatgctacctgacttcaagctatactacaaggctacagtaaccaaaacagcatggtactgtgtaccaaaacagatatatagacctatggaacagaacagagccttcagaaataatgctacacatctacaaccacctgacctttgacaaacctgagaaaaacaaccaatgggaaaaggatttcctatttaatgtattgtgttggggaaacaggctagccatatgcagaaaactgaaagtggacccattccttacaccttatacaaaaattaactcaagatggattaaagacttcaatataagacctaaaaccataaaaaccctagaagaaaacctaggcaataccattaggacataggcatgggcaaagacttcatgactaaaataccaaaagcaattgcaacagaagcaaaaattgacaaatgggatctaattaaactaaagagcttctgcacagcaaaagaaactaacatcagagtgagcaggcaacctacagaatgggagaaaatttttgcaatctatccatctgacaaagggctaatatcaagaatctacaaacaaatttacaagaataaaacaaacaaacccatcaaaaagtgggtgaaggatatgaacagacacttctcaaaagaagacatttatgcagacaacaaacgtatgaaaaaaggtcatcatcaatggtcgttagagaaaggcaaatcaaaaccacaatgaggtaccatctcatgccagttagaatggcaatcattaaaaagccaggaaacaacagatgctggagaggatgcagagaaatcagaacgcttttacactttggtgggagtgtaaattagttcaaccattgtggaaggcagtgtggcaatttctcaaggatctagaaccagtaataccatttgacccagcaatcccattactgggtatatacccaaaggattataaatcattctactataaagtcacatgcacacatttgtttattgcagcactgttcacagtagcaaagacttggaaccaacccaaatgcccatcaatgatagactggataaagaaaatgtggcacatatggaaatgtgcacaccatggaacactatgcaaccacaaaaaaaggatgagttcatgtcctttgcagagacatgcatgaagttggaaaacatcattctcagtaaactaacacaggaacagaaaaccaaacactgcatgtcctcactcataagtgtcagttgaacaatgagaacacatggacacagggaagggaacatcacacactggggtctgtcagtgggtagagggctaggggagggatagcattaggagaaatacctaatgtagatgacgggttgatgggtgcagcaaaccaccatggcacgtgtatacctatataacaaacctgcacgttctgcacatgtatcccagaacttaaagtataataagaaaaaaagagacaaaaacagatattccagcaataaaataccaattacaagatattccaaatttgaatatgaactccttctcatcatgaattttctgaaattaaaattaaaagattaagttcaatgattaatgtacaaagatattaaaccccaaaggagttaaagtccaaaatcatattctcttcaccttgtaattaaaagtttaaagaaaattaatgcccaaaatatatcccaatttcttattcaacctctttgttatatttctcaatgttcctaggctatgcgcaaaatgttggagttgagatgtccaaatataacttcttttttcctcatgagcatcttgaacaaattataaaattaaacaaagagaacagagaagagactaaaacaacacccttattactaacaaatgtggcttgtgcctacaggcaagaaagcctgctaacaatgaactctagaactggtcttccccactgtggcataaacagctactgttcacccatgtgtgtgtttggcccctcttccgggcacaactacactatatctttctcagcctcccttctggttaactctgttcatgtgattgaattttggccaatggaatgtggaaaaaattctgtgcaccctcctaacatggtcaataagaatttcccaaatgtgtttcatgctttcacaccctcccctcatttgcaagctgaataaagaggactctcagggcttaaaagagggcaaagccaccagatggaagaacactaggtctcagcatttgtgcatggaatagagcctgtttctttaccatcaatcctcattgaacactgacataagtgagaaacaaacatttatttttgttacgctacggaatgtttggaagttgtttgtttcactggctagcctatcctgcctgaaacaccccgaaaatccctggaagccctgatgcaggacaggttttcctgtggcaggaagtgaactgctcaggtgatccagagatgcagaagaaacttctgaccctatggacagctccccccatgaaaaagagagtaaggctgagctaagcatgctcagtagaatctttccacattcaatccaagcagcttaagcccctctttcttccctggtaggagtgagggagcttctttccagaggctaaaataatcacaccgccacatggaaggaaacagctccccatcgaaatgtgttttctttttgtgcagctctttcttgatgtctagaaatctttccctttgttccccatccagattctatatactgtttctcaagacacaccccctcttagcatccttagcaggtatgagacagaggggcactacatttctgtcttctgactagcccatgaatgccagtcatacggtcccctttgggcctttgggcaagcttcggtgagagttaaggagaaacagcccttcctgacctctctccccacctgctccagattccagagtccatgaagggtcattctcagcagacataataaggatcctggatgcattcttctttttaacaatgaggtcatttcctcacaaatcaccaggctcttcctaagggaagtttgcacccacagcaatgcccagagtcctcctgccttacagacccaccttccttctctgcctttatttgaaaaggagagagaaaagctccaatcttcatcataacaaaactaatgctgggatgaatccacttcaatgtgcttgccatgctcgtagtccctactgagggacaataccctgcatagtcctggatacttgggccaacgtttggtcccacatggcctccagctcccaaccaaaacagatgaggcagaggtggaagcccatggattggtcagcacactatggctgagagataagccagttaacgggaattgaaacccaaagttcatgatgtagaattcaaatgagataagtcacaatgaaccatctcaaaaccatgaaacagcaggacccgtgagtaaacagaggaagtcagctcatggagaaaggacaagggcacagttgtagacagacatgcaaatgatgagaggatagcggagggacagaaggcagagcgcacagcctggaggaaactattcacagagatatctcggaacctgtccgttgttcagtgctttctttccatgtctatgtttataataagcccctttttccttgacctgacttgggtggtcaaggtcactgtgccttgcctgattgaaacaactcatttccacaattgcattaaactgtgataagtgatccagaaaaccatgatcatatcggcttctcctcttcctacctaaaatagcagatgccttgggctacaaactttgggaaaagggtatgaataagcactagatagttttgcaagatttgcactttagggagaaaggagagtaagctaggtgaattattgggatattctttaggttactatgaggtttggaggttacagttaggaaaaaaaagtttcctgcagcaaaacccatgccaaattgaaaaattctttagaccacataggaggtcttcaaggaaatcatggtgctggtaaaaaaaaaaaaaaaaaaaaaaaaagggagagagattttgactttctcttcttctggggatggaaaaactaaagccaggcctcagtgtcatctttccacccaggagcaagactgagcccttccactgtgggacattgaggcctgaataagacccttccaagcaaaggtgaaagaggctctgagtataagtatccataaacatgggctactgtaacataggaacccagaaccctaatcatcaaagccaatgaatgtctctaagaaagggagtgattgtcctgacagagttttgagagccaaaaggctttgtggactcaacctccaaaacagagcagatgggaggagggatggtgagaaggcttattcccaagccaagccctggagaggatggcaaagtggcaggtggaaagcgtggtagatgtggagtcccatgtgagataggatatcccagctgatgcctcacaaatcctcgcacttgctgcctctcattgtacctcctatttctatcttcagtaaaggcttgaggctatttggagcccagaagccagcagctgaagggaacaggcaattggccaggccagctcctcagcccaaggaaggcaggcctggggcaatgcccactggccagtaacatcagagggcccattggaaacacatctaagtccccgtgactcacaactgtcatagctgtgaagtagtgtcatctttcttcctgaagatttcctgtatcaccccaggagcagaagggatgattgatttttgctctggaaataagtaatgggtcactggggacatgaatagaactatagcttccttaagaagcaatctctcttaagaaattacaaagcaagcggctcccctgctcagtggtgtctgtggcattgtactcccagtctttcaggataagtctaaaacagtttggcactcaattccaagctcacctatggaaaaggaggaactctgaaatctgtagaataaataaagtaatgaggtatgcctactgtaaatggagaaaatccagccagtattattgaaaactttcaggctttaaaatttataacatggaaagctatactatactgaagtatctgagtctccccaaaaacaatgacgttagggaggaaatcaaatgagaggaatctaagattgacagttcaactagccaaatcgccaaataatctgcagtcacagagggatagtggactgttattaaataaacccctggtgaattttctttattaaagagcaagaagtcagcaggtttcaaagccccaggaatgtggggatgtagaccctttcagcgacagctaaaagtgagagttaggaagggtataaaacctctgctccccgttcacgagaaagccagccctggagagggaggcaccaggcggcagccccactctgcaccacacaacactctgttactcccgcctggcctattagtctctcccttagcctgacctaagtaactctaacccaagtaaggagaaaatcaaagttgggaatttcagcattcctgaacaagaaagttcgagggtcagtctgcaaaaagtaagccccaagatcaaggaaagggaatgagatctggacacagagctgcactcaacatctagcatgactctcagcaggatgcaccactgggcacagcagtgtctatgcttgtccagcagacatgtcagggtgagcttgctctcggcagaagagagaaacctcccactaagggaagaaggagctgggtgcatgagattggcccagtaagacaaaccttctcatcaaaataagaggggcagctctcacagtattgtggtcttggtcacttgtgtttgtcccctgagtcagtttccatggactcccatttaaaccctggagtcaggcaggcagggtcactagaagtctgtgaggcattaggactactctgtccccctctgacaaaatataacacagatggagaaagaggtgctgatgacccttaaatctccaaaggcctgaatgggggtggcccagagcaacaaactgcctacttgcaacaagcccacttgcagaagacaggacttcggcgggagaggagaccaaccactcctgaggacctgccccttgctgcctctcattgcacctactgtttctatcattgataaaggaaagatgttgcatgcaccactctatttcgcatttaaggtcaaggttctggggaaatgagtcccacaacactggcaggaagaacgtctactccatgacagggctgccacagtatggtagcagacaggacttttcatcaatgacagcctctggaaaccatggggagaaagtgtcctgcataaccaagcggaggcaaaaaccagggaagcatggattagacaatgaaacagttcaagtgaaacaacaaaacaattcaaggttgggggacataaaggcccagtcattcatagtactgcaaagtgattaatctaaaatgcaaatttgatgacatcagatcctgtttaaaatctctgccttttctccattcccacagatcctctcctatcagacataatgaactactgctaggattattgcagtagtcttctgtcaacagtctcacctcactgcactcccccacttccccactgctttcacaacaatccgtgtaaatctccaaactcttcagggccctccttatctctagcaatgttccttgacttcctacacccttggggcaaaagtctacacacattataggccttataacagcctccatccattcattcactcatttaaaaaatatttatcaagtgccaactccatcccagactactgctaagagtggtagggaacagtaaaccaaacaccaaaagtccctgactttaggaagttacattctatgggcaaaatttagcacccctctgtgttcagctcttctgcattcagtggtgtaggcacaggcttttaccagctcatggagaccaagggtgcacatctcttcccaactctgcattcagtgatattgctttggtagcttgaaatcaacctgggtggaaatatttacaccatggaaatcagcagtcactacaaataagcagacactaggctttttctttttcaggaacaggttattgaacatttaccagcatacttttgtaccttagcccaggctgctctctgtgcctagaaatctcttcttcttgtcatctgcctgatgaatacctaccttcaagacttaattcaaatatcaaagcagttttggacccaagagggagagcagactcctccctctgagctgcctctgtaccatgcgcacacccagaacaccttcagcagttacctagtcatgtgactgtcaccccactgtactgtaaatttcttggagccagggatgagtcaggcatgactcatcaatatccccagcccctggtacagtgcctggcccagttcctggaccactgtaaaataaattcctgttgaatacatttggagccaggaaaaaatatgtatcttattttaacagctgtcatcagacttcattttaggaaaggaatcaagtatgaggttgaatgagcccaaattgtggaaatgaccatgggatatttaggtatagtaatatgtaacattgagatttccttttctgagctaaaattattccatacctacaagatattcacaatgtgaatgccttatgtaaatggttggactggtgaatgttaagaaaaatggctgagttctgtaactgagttaatggggtgcagaacagggaagacacgagcaacaagcacggtgatccctagactgaatttgctcagaataaggaggctggagccagaagtgaccacaattaataagccccctgggaatttatgaaaatcttgtgaagctccagatacttcagaatccttggactagggctttaaattcatctcatctagacatgaaaaaacagggtggcctaatttgacagcttaatcaggaagaagtgggtaacatggatggatggatggatggatggatggatggatggatggatggatggatagatggatggacggatagatggatggatggatgaaaggaacagtagatgaatggatagatgcatatctgaaagcagaggttgtgaatggcttagtagtggaggtggcaagtgagattatattaggccattcttgcattgatataaagaagtatctggggctgggtaacttacagataaaagagatttaattggttcatggttctgcaggctttacaggaagcatgatgctgtcatctgcttctgctgagggcctcactaatcttacaataatggcggaaggtgacagggagccagcatgtcacatggcaagagagagagggagaaggcaccacactcttttaaacaaccagatctcatgtgaactaccagagcaagaactcactcatcattaggggatggggctaagacagtcaggagggatccaccccaatgacacaaacatctcccactaggccccatctccaacattggggattacatttcaacatgagatttggaggggacagacacctaagccatatcatttcatctctggcccccaaatatcatgtccttctcacattacaaaatacaatcatacctttccagtagttccccgaagtcttaagtctttccagcatcaagtccaaagtcttaagtctcatcagagactcattctccttccaccatgagcctgtaaaatcaaagacaagttatttccttcgaagatacaatggtggtaaaagcattgggtaaactttcccattccaaaagaaagaaattcaccaaaagaaaggagtaataggcaccacacaagtctaaaaccaagcaggacagtcattgcatttaaagctccaaaataatctcctttgacttcatgtcccacaccctggtatgaggggtgggctcccaaggccttgggcagatccacccctgtggctttgcagtgtacagcacacatggctgttctcaagggttggagtggagtgcttgtggcttttccaagcagagtttgcaagctgccaatctaccattctggggtctggaaggcagtggcccccttcccatagatccactaggcagtgtcccagtggggactctgtgtagaggctccaatcccacatttccccctgccattgccctagtagagtttctctgttggggctccaccctgcaacaggcttctgcctgggcacccaaactcttccataatcctctgaaatctaggtggaagcctcattcatgcttacattctgagcatctgaagacttaacatcatgtgacaactgccgaggcatggcttgcaccctctagagctgcagcccaagctgaaccttggtccctttgagtcatggcagaagccagagtggccaggatgcagggagcagtgtggcagcacagggaagcaaggccctgggcctggccccctaagccacttttctcctaggcctctgggcctatgatggaagggactgccccaagacttctaaagtgccttcaaggcctttttcccattgtcttagatattaacacttggctccctttaggtcaggctaatctccctagcaagtggttgctccacagcctgctcgaatttctctcctgaaaatgattttatttcctgcacatggcctgtgtatttgtccattttcatgctgctgatagagacatacccgagactgcatggtctatacaggaaaaaggatttaagggacttacagttccacatggctggggaggcctcacaatcatgatggaaggcaaggaggagcaagttatgtcttacatggatggtagcaggcaaagagagagagaactcctctttataaaatgatcaggtcttgtgagacttattcattttcatgagaacagcacaggaaagacttccccccatgactgaattatctcacacttggtctgtctcacaacacatgggaattcaagatgagatctgggtgaggacacagcccactcatatcagccagcatgaaaattttccaaactcttaagctctgcttcccttttaaatataaggtccagtttcaggtcatttctttgctcgcacatataagcattggctgttcgaatcaactaggccacttctggaacactttgctgcttagaaatttctactgctagataccctaggtcatcactcttaagttgaaacttccacagagccttagggcctggacaaaatgcagccaagctctttactaaagcataacatgggtgactttactccagttcctaataacttcatttccatctgagacctcatcagcctggacttcaatatctctatcagcattttggtcacaaccatttagccagtctacaagttgcaaacttttcttcatcttcctgtcttcttctgaaacttcgaaattcttccaatctctgcccattacccagttccaatgctggatccacatttttaggtatctttatagcaatgcccctctcctcagtacttattttgtattatgccattcttgcattgctataaaaaagtacctgaggctggctaatttatagagaaaaaaaggtttaattggctcatgattctgcaggctttacatgaagcatggtgctggcacccgcttctggggagccctcagggagcttacaccatggtgaaaggtgaagggggagccaatgtgtcacatggtcagagcaggagcaagagagagacagaggtatcacactcttttaaacaaccagatctcacatgaactaccagagcaagaactcactcttcaccaagtggatagggctaagccattcatgagggagccacctcctaccaggctgcccttccaacattgggggttacatttcaacatgagatttggaggggacaaacatccaaaccataacagagatgaatgccaagacagctggactaggtggggcaagccaggaacaggcttcagaaacagcctaggcaggaggcaggaagacaagacggcaggaagcagtgcagaacaaagcaggctcctcatcattcaacctcccctgagtgcagcaaaggggccttattgtcagcccctaactgatcattgataactaaagttacaacaactcatacctgtaagggccatggtgagttagagctggcaagagccctaatgatacacagtcttctcttgaaagaggagaagactgaggcccagagaagtgagtaaatttcccaacaagcagagagttgagactggaatctggcttcccaccccagcccagtgctcttggaaccagaggacggtcctcacccagtcagctaaggggagccttggcatgctggccaccaccagcccagtgatgctaggaaagttgcagtgcttatctatctgtgtgtgcctccctttgttcaaatgtaatgtagaaacaataatactgcctttcaggatcttcctgtaagaattaaattacttaatattttaaaacatagtggtgtcatatttgagctcacattaccctaagattcaccctaccatcaggctgctacaaggaattcaaagattcctgggtagagacctgatgaaaatgggcaccggttaaaataaaaaaaggagggataatttgggggtgggggtgtcatttacattgtccccaggtcctacccctggaattgcgcaagggccacaatagtcagaaatggattatttcatgggatgttcaatgaaacctcagttaaaccgtgagaccatcttgtcttattgcttaaaaccactgaaagctgaaagggttagatttatggagcttctgggtaacatcctctgaggaccctaggaatggtgaatgagggaggaagggagtagggagagaataatttaaacagagcagagccaggcaaactctccctgcatgagaaactaacaggaaaacccaggtcccatgtgagtaccaagttaaaggaccccagcaggccatgttggttccctttcccctttctggacttactgctccatcaaggctaagcagaccattggctctcccttttcctctgttctcctggctcccactacctctgcttttttcaacaacagatgtatttttcaaggatcctgctcctgggaagtacttctagcacttcacttatctcacctgatgcactatacctaattatcagcttaattgccttcttccaccactgaccagttacaatcaggtatattctatcttcgtccctgtggcattatcgctccaaaacaatagtagacactgcatatttattggatgaatgagttaatgaacgaatgcttggaactcttcctgacaatcaaattcaggccctagtcccacacataagtaattaaaagtcgaagtgaccatactgagcaagttcctgagctcttgctagtaaaaacagggcccttggagcaacattggtttttctcagaagcttattaaaaatacagactctcaggctgaatctaaacttgcattttaacaagatccccagatgattcccacacattgaaggttaagaagccctgttctaaggggtaacgtcttccagagagcttagctgcttccagtgccctacctcaagggtctgattcaaggaatgagatggaagtctgcaaatgcaggcagatcactaaggtttctggccctggggctccatcatcagtctaccctccactccagattggcctagagatccccaagtgtgaggcaaggaatcaagcgctccctgagagggtgtcaagccccagcgcctcctggaggcctccagctgtgcagaatcatgctcttggcagcacctggctgctattgttaggagagaatgaggagctgcgaggacagtggcactgtacatgctgactaaaaggcggggctcctatctgcatttggaatgacatacccgattctatttgggaaggaaacacaatggccctttactacaggatttgaatggcaggaaccagctaaatggactaggaaatgattaagagacaaaagtcaaggcattgtgtgtgcaccatgcttagcccagtcctgaaagccctattataatggccactgttcctgtagcccctcctgagccccaccaccctcctcagaaacactgtggctccttggacacactgcaaggcctatttgtctctcctcaaggaaaagggtggaaagctacagcaaactttgccagggactgggagggatggtgaggcagggagagatgaaggggcaaaagacaggtgggacaggaggtgacagccatagaccacaagcggatcagggaaggatgcagacggcagaatttgcaaatgttgtactgcagcttggaagagaggagagaaagaagggggcagggaaatatccactgctgtcccacatcatggggcaggatgtcaggaagcccaagttcaaaacccttgccccacatactggctatgtgactaaggcattttgcttgtgctttctggatctccttttcctggtctgcaacatgcagatgctgatattagccgtatgtggtgatatgccaatgaaattaactgaaatgaagcataggaaagtgcttagcacagttcttgacacataaactgtcaattctagatcagaaagaacaagaaattgcttcctttgcctgtcaactagtacataccgcaccaccccagtcctgcccatgtcaccccctgagaaaggcttaaggcatgattcatctcaacatattagaggttggtgcaaaagctattgcactttttgccattacttttaatacaacctaatatttgtatttaagtggggacttcaaaagagtcaatggcttctgtttcaaaagaaacactcggcggggcgcggtggctcacacctgtaatcccagcactttgggaggccgaggcgggtggatcacgaggtcaggagatcgagaccatggtgaaaccccatctctactaaaatacaaaaaaattagctgggcgcggtggcgggcgcctatagtcccagctacttgggagactgaggcaggagaatggggtgaaccccggaggcggagcttgcagtgagccaagatggcaccactgcactccagcccgggagacagagctagactctgtctcaaaaaaaaaaaagaaagaaaagaaaagaaaagaaaagaaagaaagaaagaaagaaagaaagaaagaaagaaagaaagaaagaaagaaagaaagaaagaaagagaaagaaagactctctaatcatggaaatggtatcaggaggtccgagaaggacctaggctgatatctcttgagtcatgaccgcaatgggaccactttcctactcagcctctgtctgagaccattgaatatgatctgaatccagctttctttgagcaaggttagagagaaatgctctgacagcagaaaaagacttggaatgccaggagctctgcagcatgactccagcagtgggggtcagtgggtggcaggagtcactggggaatcaggcctgggagagtcagggctgcaggtcacatggcagagcctgagtcccccatacagacatacaacctgggcctgccccccactcctggacagtagagacccgtaaccactgctccataggagttgggaagttagaaggtctacatttggttcatgaaccacaagatggggccaccaagatgacaatcattctgatagccaaaaggatctggatctcagcatggagagtgtagccactgagcactgatgagccacaattctcatggggtggggccaggaaggtaatgttctgacaggtggtgggacttggatgcatgggggtgtgggggtggcaagagcacagagccaagctgagatcaaaatggtggcccttagggccccttatccaaaacctgacacaaagagggtggcccactcctgcctccttgcagacagtcttgaggagagggcagtggaagacaagacaagggcttctagagagagtgtggcagccaggccgcggatgttgggacaagtgtcactgcactatttgggggtctgggaaggggatggaggtcagggtcagaggcacagcctcagaaaagctggacggagcaatagtgagtgcccaggtagcagactgcacatgcctgatgaggactggtccacccactcaaggagtccagggagaccagaggcagaggggtcagttggctgagaggcggccgtcagggtagaattggtgacagatatgggagaacatgttggtgcccattagaatcataaaactgaaatggctgcagaatcactagagtaattctaaagcctccagggaggctttgagtcaggtgctcaaagatcctgtccacattcagctggagtggccacaatgccagtcgtcacttcaaaacagacacccagaagaggcagcagggcccagcccttaggaaagagttggagaagatgaatgaagcagagctgtcacccaaaataaaaggctatttgtggtggtattaagtacaaagtgaagaaccaaggtgggaggtagactatatcttatgagaaatgaccacagtgaggtcacacattccttccttttatgcaaataggaagacccaggtccctatacatttcaataagcctttcttctttcccagggtcatccctccctgtaagctccaggaggctgcgctaatgctctgccctcaaagagagaactggaagggtatttggccaggtgtaccttcctgggctcttccaaggtgacagctctcaccctgtgctgcaggtggccctgtgcctggtgccacttctcactgcttaccagggcacatggacaccggtggttcccaaaatgggtcacagcaggatggcctgcatcagaatcaccagggagggctataagaaggcagacttcttctttttcttttcttttctttttttttttttttttttgagacagagtttactcttgttgcccaggctggagggcgatggtgcgaccttggctcactgcagcctccacctcccaggttcaagcaattcttctgcctcagcctccccagtagctgggattacagttgcccaccaccatgcctggctaattttttgtatttttagtagagacggggtttcaccatgttggccaggctggtcccaaactcctgacctcaaatgatccacctgcctcagcctcccaaagtgctgggatttcaagtgtgagccaccgcacccggcaaagaaggcagacttctaaacctagaaattctgatgcaataacatgtaggaaagagcctaggaatttgcaaaaatgtttcaacccccagacaattgtgaagcacggccaaatttggaaaatattgatctacacaaaacaatgcaactatccaaatattaaaaatgacttcacaaaagatagctaagagtttgtgtccaattttgtaaatatataagcaatatacattgtggtatataataaatgtataactccgattctataaacacacacacacatgcgcatatatctgagttgtaggatgatagaggtttttcttctttattcctttctcagttgactttctataataaacacttattctgttcataaagaaaatatgattttgtgagtgctggggagcagattatgacatatttggactcccagagaggcttagctcagattccgtgtgtgggtttcctaaaaacgcaatgcctcccagcgaggcgtgctgtccccttcctttcttctggagagtcttcgtatgtgtttgtttcaatacactcttcattctgactagcagactgcacggctggcttttgtaaatgaacactcatttcgctctattaaattaatatattgactttttttttccacaggagttaaggaggagatcggggctggggggctgggcatgcattcaggatagggctctagtcagcaggaaatgaaagagctgagcaaggaaactgaggttgatatcaacatggtggggaggagaggctgctgtgcggaggctcccctgtgctgcaggtcgccctgtgcctggtgccagggctctcactggggaccctagacccctctcaagccagagccccatcatgccagggctgagtctgctgttgctctccctggggcaggaggggagaagatctggtatgagtccagcgtgagtgcttcacactggtgaagaacaagtttctggagtgagaaagaactggattcaaaatctgagtctggcactgaacactcaggcatgttactgtccttcactaagcccagtttcctctcatctagtagggatgataacagtatctactcaatggatttcttgatcacgaccatcgtccagctcccacagaccccatcgccacccaccctcctcaggatgcagtgacaatgtgggcctgctctgaagactcagggttggggccagatggttagagaagatgtctgcttttttctccccttcagccattgagacaaatatttgttatgaatactgagattcttcattctctgcttcacttctgactggaggcagcctgaggggaagacttttttgagagggagaaactgctgggaaggtccctggctcttgagggagtgacactgaatattaagggtctggagtgatgtctggaacggctgcagcaaatcacttcatccctctgagcatcaatttccttttatttatttattttgagatggtcgtgctctgcctcccaggctggagtgcaatggcagaatctcagctcactgcaacctccaccgcctgggctcaagtgattctcatgcctcagcctcctgagtagctggaattacaggtgtgcaccaccacatctggctaattttttgtatttttagtagagatgggatttcaccatgttggccaggctggtctcaaactcccgacctcaagtgatccaccaacctcggcctcccagcatgctgggattacaggcatgagccactgcatccatccagtttccttttctttccaactagggataatagtgccttcttcacaaggctgttgtgagaattacataagatattatttgtgagagactgtagcatcatgattggcatataacagcacccagcaaatgttagtttctttcctcttttaatagccaacgtgcagggagagtttaattctggaaatatttgttgaccacttattatgacttctgtaatatttgaacgtgaatcattgacaagtcagtctgaaaactggctgagagtctgcgggcaggggatttggaaagaaaggcagtgggacgactcaccctggggaagagaggaatgtgtttgctcctgagggaatgagcccctaggttctttctggtgggggaagaagtctggagctggaggaggctgtctgggaggtggtgtggcctctgacttgcactctcagccttaagccaatggctcacacaatgctagtgtgattgcattttctgtgaaaatctggcagaactgagttccacagctgacatgactggaacaagaggctccattcatggacttagaatagaaccaacattagggcaagggctctagaagcttccaggggtggggtgctggagcgtttgagtcaagggcacttacgtctctgacaagtgaagaacctcagcagatctctgctttacccatacattttacaagatgccctgagtgcagctgtagagggatttctccagtcaaggatccttgacatgaatgctcaaaagatacattcttcctctacggtgcagtcatcaaggacagcaggacaagcagatatatcctcacctgaagtcataaccaggatcagttttccccaattccagctcttcaattctccaaagaggactttctgtaactaccttaggagaaacacactacagaataaacatcagcaaccagcacaggtgtgagtggagacatttgatccccagccctgtcattgttgaatctggtgtgtctaaaacctcacgaaggggcagaggagaacatggtgcagtaaacaacctgccccatgccccaacttacactgctggcagtaaatgaccctcacaactatctcctccactcattcccacagatagtgatatgttggcattaacaacacatctctttaaaaattcaattatatttgcgtctatttgacagactagaataattactatctgctgctaaggtttcccctgcagatgcaagaaaaaagtgaccttacattttctgtctgtctgattgtggcagccaagattgaatagggaaatacagagggtagaaatctaattatataacagtattgtggtcatttttttaaagttcttatcttttggagacacatattgaaatatttatgaatacaatgatatgattgtgggattagcttcaaataatacaggatgagtatgatttcatttacatgaagtacaaaagcaaaaagaaaatcacaaacccatgctgttgaggtgaggagagtggggcggagggtggagatagtgaccagtagataggacgaggtgggtatctgggatttgcatttacacaaatggctttgggttatgaaaattcactgtgctttaattttatagcatatgcttttctgtgcctgtgtatatgtatacatgtgtatgaacatcatacttcaacaaacctttttgaaaaatcataatgtgggaggaggggtaactgacgtgggggtgggagtggggagtgaccaaaacaggattgtctgggtgttcactgctgaagctgggtggtgggcacgcagcggtttattttactaatctcctatttgtgtcaatgcttgacattttccacaagaaaaattttatgaaagtatccctggaggtggccgggcgcggtggctcacgcctataatcccagcactttgggaggccaaggtgggaggatcacgaggtcaggagatccagaccatcctggctaacgtggtgaaaccccgcctccactaaaaatacaaaaaattagccgggcgtggtagcgggtgcctgtagtcccagctactcaggaggctgaggcaggagaatggcgtgaacccgggaggcggagcttgcagtgagctgagatcgtgccactgcactccagactgggaaacaagagcaagactccatctcaaaaaaaaaaaaaaccaaaaaaacaaaaaaaaagtatccctggaggtgttacgtctcatgtattcttaatttttttttaattatactttaagttgtagggtacatgcgcacaacgtgcagggtagttacatatgtatacatgtgccatgttggtgtgctgcacccagtaactcatcatttaacattaggtatatctccctcccccctccccccaccccacaacagttcccagagtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacacgaactcatccttttttatggctgcatagtattccatggtgtatatgtgccacattttcttaatccagtctatcattgttggacatttggcttggttccaagtctttgctattgtgaatagtgccacaataaacatacgtgtgcatgggtctttagagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatggtatctcattgtggttttgatttgcatttgtctgatggccagtgatgatgagcattttttcatgtgtcttttggctgcataaatgtcttcttttgagaagtctctattcatatccttcgcccactttttgatgggattgtttgtttttttcttgtaaatttgtttgagttcactatagattctgaagtctcatgtattcttaaatattattagttttttgagccgaggtctctctctatagcccacgctggagtggaaaatgttaatttttttttttttttttttttttgagacagagtctcgctctgtcacccaagctggagtgcagtggcgcaatctcggctcactgcaagttccgcctcccgggttcacaccattctcctgcctcagcctcccgagtagctggggctacaggcacccaccaccatgcctggctaattttttggggtttttttgttttttgttttttgttttttttagtagagacggggtttcaccgtgttagccaggatggtctccatctcctgaccttgtgatctgcccacctcggcctcccaaagtgctgggattacaggcgtgagccaccgtgcccgaccaaaaatgttaattttttaaaaccaaaggctcagtacgacaggagttgaagctctgatcggtcagagaagaggatgggtcatttgaatatgagccagagtgctgagtgtttgtgcaaatgtgatttttttttgcctaccctggtgaagccaccttaaattagtaattgtcatttaaaagggaaacagagagatatatgttagcatttgccaatatttgtatttatttactaattttattgattacttattaatatttctagacttcatatctgtactatgtacaaatatagtataaatataataatgcacatttgacaaaaagcttttaaaggaagagataaaatatgtaaatagatattctaatgtattatttctacatgccaatggatcttttttgggtgcctccagggtatatgatttggaaaacatactttttcttttcacaataagaactcgcaacaaagaaaaaatagatttaaactacacacacacaaaatctaaattctgctttgaatatcttctattagacaccagcctttgccctaggcatatatgaatatcctgggccttgaggggctagtagtccaataagggagaaggcatataaaaatataacttcaatatgatatggtggtgccaccaagatggaaatgggagcaaggcatcttggaattcttcctgcaggaaagaaaacctgagaggagatttgaatcttaacaaagaacttggcatgcaaataaatgtaagaaagatattcccaactgttacgggttgaattgcgtctccaaaaagatatgccaaaatcctaaccccggtacctgagaatgtgaccttatttggaaatagggtctttgcagatgtaatcaagttatgataaagtcattagggtgcaccttaatccaatatgactggtgtccttataagagggaaagagtcacagagactcacacagagaggagaatgccatgtgtagacacagacatacagggagtctcattctgtcacccaggctggagtgcagtggcatgatctcagctcactgcagccttcacctccctgatcaagcgattctcctgttccagcctccccattagctggggttacaggtgcccgccaccgtgcccagctaattttcctatttttagtagagacaggtctcaccatgttggccaggctggtctcaaactcctgacttcaagtgatctgcctgcctcagcctcccaaagtgctgggattacaggcgtgagcctctgcacctggcgccaaactttaactttttttttttttttgagatggagtctctgtcgcccaggctggaatgcagcggtgtgatctcggctcactacaacctccgcctcttgggttcaaacagttctctgcctcagcctccccattagctgggattacaggtgcctgccaccatgcccagctaattttttgtatttttagtagagacagggcttcactatcttggccaggctggtcttgaactcctgaccttgtgatccacccgcctcagcctcccaaagtgctgggattacaggcatgagccaccgtgtccggcctgccaaaccttaacttttttttttttttttttgagactgagtttcactcttgttgcccaggctggagtgcaatggcgcaatctcggctcactgcaacctccgcctcccgggtccaagcgattcttctgccttagcctctcgagtcgctgggattacaggcatgcaccaccatgcccggctaattttgtatttttagtagagataaggtttctccatgttggtcaggctggtcttgaactcccaacctcaggtgatccactcgccttggcctcccaaagtgctgggattacaggtgtgagccaccgcgcccagccaccaaaccttaacttttaaacgatcattcctagctgatttttatgcagcctgctcatttcttcaatatctttaacctctctaaaggaaaaacagccaaaccattttaaaaacaaagatctttctcgcctcaactctttccctcttctccccttcacaaaccttgttccatgccttgtcttccgatgaaccacaattctccactgaaccgaggtgagagtgatttgtgcaactatcactccactgaagttgaaacttcaatctttttaaagttcagaggctacttgtctcattgacacatgatagtaatccacactgaacactttgtgtgaaacactctgaactggacttctgatgttatgcttccctggttttcttcctatcttgggattttctcagcctcttgctgatctcacctctaaccatctcagatcttggccttcctctattcatacatgccgtaggcagtcttgttcattacagtgaatcaccgcccagaccattacctgagagtctgccttggatatccaccttggatatctcaaaggtctcaaatttaacatgtctgaagaacctctggctcttatctaccccacacctgcctgtggttcaggttcagtaagtggcaccatcccccactggctttctaaggtagaaacttgaaagtcaacttcgactcttccctcttcctcacctccatgaattctgtccgtcacaaggcctggtaggttctcaaatctcttgaattcatcctcacttctaacacatgaatcgagcccctatcatctgtcacctggagaatttaataaatttctaagtgatccgtttttcaaaattaactgcattatcgagctataattcacattccatacatttcacccatttaacatgtacaatccattgatctttagagtattcacagagttgtgcacctatcaatccattgtgtaacattttcatgacccccaaaaccccataccactctccgttccctccccagatgatctctttggtgcagttctttgctcacattttctccacactgcaatcagatatttttcaatacaattttaatgtcatgcttttgtttagaacatttattacccttgaaataaaatccaggttattttctgatttataaggccttttgaatctggtctttgcttgcttttctggactaatttccttcttcacaatttacaaactgaccaaattgaatgttttagttactttaatgggccttcttttcatacagttttttctgccttaagcaccattccccatggactggttaaatcttaggtaaccatacatcctagtttatgcttgttttcactatcactctcaaaagtgtgcctgtttggatggtaaatgatatggtaaccctggttaagttcaatttacacctcatgtaacttcctccaggaggctttaacaaaaattctatcttggttccttttgtttaaatttcaaatgcacctcatattacttaacacccaactgtattagtcattttgattgtcttcactgctgtgagggcaagggcttgtgtctaccctatttatctctttatcttcaacacctaaaagtgtgtggcacataacaagcacagaactgaacaaaacctatgtaaaggagtgtataggtcatgaagaaaaatttaatttcagtaaagtcattcaggcaactattttggaattctaattagtactgaaatgtctctgacaccatggagaaaggatttgtcaaataaccatcaaatgagttggaattaaaaaaaaaaaaaaacttcccaacatataaaaatgatataaacaagtagagtttatctcataaataaaagattgctttaatatcagaaaatcacataccatactaacagaataaaggacaaaaaccataggactgtgccaatagatactgatatggtttggctctgtgtccccaccaaaatcgcatgtggaatttttttttatatatatatacagagtcttgctctgtcaccaggctggagtgcagtggggtgatgtcggctcactgcaccctccgcctcccgggttcaagctattgtcctgcctcagcctccctagtagctgggactacaggcgtgcgccaccacgcctgtgcacctggataattttttgtattttagtagaaacagggtttcaccatgttggtcaggctggtctccaactcccgatctcaggtgattcgctcgcctcggcctcccaaagtgctgggattaccggcatgagccactgcgcccggcctcatgtggaatttttagtccgcacatgttagggtagggaactggtgggaggtgactggatcatgggggcagttctccatgctgttcttgtgatagtgagttctcactagatatgatggtttaaaagtgtggcacatccccctttgcacttgctctctctctctctccttctctcctttgtctctctcctctctctcttctctctctctcgtcgccatgtaagatatggcttgtttctcctttgccttctgccataattgtaagtttcctgaggcctctccagccatgtggaactgtgagtcaattaaacatcttttctttataaactgcccactctcaggtagctcttaatagcagtgtgaaaatggactaatacatagaaaaattatttgacaaattagaggacccatttatgattaaaactcaccaaattaggaagagaaagaaacttcctcaacctgatgaggaacatctatgaaaaatctacagctaatatgtataatagtgaaagatggaaaactttccccctaccatcaggagctaaacaaagatgtcagctttcaccacctctattcacaattgtactggaagtcctaactgaggcaataagacaaggaaaagaaaaaatttaaccctcaatagtttaaggaaaaatgaaaaggcatatggctttgaaggagtctcaaaaaacaaaacaaaaactctagaaataataacgtagccggattacaagataaagaccaatataagccaagcttggtggctcatgcctgcagtcccagctactgaggtggctgacgtgggagggtcacttaagccctgtagttcaaggctagcctgggcaacagagcaagacctcatctctgaaaaaaaaaaaaaaagtcaataaacaactgcattgtatgtactatcaactattaaaaaacattttttttttgaggtaaggtctcactctgtcacccaagctggagtgcagtggtgccatcatggttaactgcagcctcaacctcccagtctcaatcagtcctcccactgcagcctcctgagtacctgagactgcaggcacaagctaccatgcccggctaattttcatattttttgtagagatggggttttgtcatgttgcccaggctggtctcaaactcctgggctcaagcaatttgcccactttgatctcccaaagggctgggattatgttactgtgcccagccataaaaaaattaacagtgtcattaaagaaaaccatttagcaataaattcaacaagagatgtataagaactgtacactatataacattgctgagagagatttaaaaagatctgaagagagaaatataccatgttcatagtttggaggagttgatattggtaagttggtaattctctccaaattggtctgcagattcaatgcaattgttatcaaaccaccactatgttttttttcctttttttgcagaaatggatgggctgattataacgtttatgtggaaaagcaaaggtcctacaatagtcaaaacaatttttacaaaaagaacaaaggagacttactctaaactatttcaaaattttattataataaagataacatggtactgcataaggatagacatagatcaatgggatataattgaatccagaaagatcctcacatacacatgtatagtccatatatatatatatatatatatatatatatatatatatatattttttttttttttttttttttttttttttttgagatggagtcttgctctgctgcacaggctggagtccagtggtgtgatcttggctcactgaatcctctgcctcccaggttcaagtgattctcctgcctcagtcccccaagtagctgggattacaagtgtgaacacccagctaatttttgtatttttagtagagacagggtttcaccatgttggctgggctggtctcaaactcctgaccacaagtgatccgcctgcctctgcctcccaaagtgctgggattacagacgtgaaccacagcgcctggcctgtatagttgtgggtgtcaagccacctagatgccaaggcaagagaccgagggcacgagccgctccaatataataaaatatataaaacaacaagagttatactagatctagatcatagacatgattatatatgaatatcattaatcattagtttgtagcaattactctttattccaatattataataatcctcgctttataatcataacctaggaaaaaccaggccatacagagataggagctgaggggacatagtgagaagtgaccagaagacaagagtgcgagcctctgttatgcccggacagggccaccagagggctccttggtctagcagtaacgccagcgtctgggaagacacctgttgccaagcagaccgtggtctagcagtagcgtcagtgtcaagttaaaacactagctacttagcagaccaggaaagggagtctccctttccccaggagagtttagagaaggctctaatcctccacctcttgtggagggcctgactgatgtcaggcccaccagcagttatctggaggcctaaccatctccctgtgatgctgtgcttcagtggtcatgctccttagtccactttcatgttccatcctgtacacctggctctgccttttagataacagtagcaaaattagtgaaagtgctaaaagtgtctgatatgcagaaatagtggcataagctgtctctctctctctctctctctctctgcctcttcggctgccaggcagggaagggtcccctgtccagtggacatgtgacccacatgaccttccctatcattggagatggctcacactccttaccctgcccctttgtcttgtatccaataaatatcagcgcagcctggcatttggggccactactggtctccgcctcttggtggtagtggtcccccgggcccagctgtcctttcttttatctctttgttttgtgtctttatttctacaatctctcatctctgcacacggggagaaaaacccacagaccccgtggggctggaccctacatatagtcaatatttttaataaaagtattcaacagggagaggatagtcttttcaaaaatggtgcttgaacaattgtagatatataagttcatagaataatgtattagtctgttctcacactgctataaagatactacaagagactaggtaatttataaacaaaagaagcttgattcacagttctgaatggctgggaggcctcaggaaacttacaatcatggcagaagatgaaagagaagcaaggcacatcttacatggtggcaggagaaagggagagagagtgaagtggaactgtcatactttaaaaccattagatctcaggcaaactccctcactatcatgaggacaacataggagaaacaacccccatgatccaatcatctcccagttcccttccttgacacatggggattacaatttgagatgagatttgggtggggacacagagccaaaccatatcattctgccctggcccctcccaaatctgacaaccttttcacatttcaaaatcaattataccttctcaacagtctcccaaagtcttactcattccaccattaactcaaaagtccaagttcaaagtctcatcttagacaaggcaagtcccttccacctatgaacctgtaaaatcaataagttagttacttccaagattcaatgggggtaaaggcattaggtaaatgttcccattccaaattggtcaaactggctaaaacaaaggggccacaggccccatgcacatccgaaacccaatagggcactcattaaatcttcaagctccaaaatatcctttgacttcatgtctcacatcgagggcatgctgatgcaaggggtgggctcccatggccttgggcagccctgcccctgtggctctgcagagtacagccctgcagctgttctcatgggctgatgttgagtggcttttccaggttcatggtgcaaactaccattctggggtctgaacgacagtggccctcttctcagctccactagacagtgccccagtggggagtctgtatgggggctccagccccacatttgccttccacactgccttaggagaggttctccatgagggctctgcctctgcagcagacttctgcctggacatccaggtatttccatacaccctctgaaatctaggcagaagttcccaaagctcatctcttgtcttcacacccacaggcccaacaccacatagaagcttccaaatcatggggcttacaccctctgaagcaacaatctaagctttagcttggccccttttagccacagctcaagctagagcaggcgggaaacaaggcaccaagtcctgaagctgcacagagcagtggggccctgggcctggcccatgaaaccatttttccctcctaggcctccaggcctgtgatgaaaacggcttccatgaaggtctttgatatgccctggagacattttccccattgtcttggctattaacagttgactgcttgttacttgtgcaaacttcagcagctcacttgagttcctccccagaaaatgggtttttcttttcttccatatggtcaggctgcaaattttccaaatttctgcttcctgtgaattttccaaacctatgctttgcttcccttttaaacttaagtttcaatttcaaaccatctatttgtgaacgtatagtggaatgctttcagaataagccaggacacctcttgaatgctttgctacttagaaatttcttcagacagatacactaaatcatctctctgtacttcaaaattctgcagatctctagggcagggacaaaatgtcaatgtctctttgctaaaatataacaagaatgacctttgctccagttcctcttctccatctgagaccacctcatcttggacttcattgtccatgtcactgtcagcattttggtcaaaaacattcaacaaatctctaggaagttccaaactttcctatatcttcctgtcttcttctaagccctccaaactgttccaacctctgcccattgcccagttccaaagtcacttccacattttcaagttatctttatagcagtgccccactaccaattctcagcagttctcacactgctataaagatactacctgagactggataatttataaacaaaagaggtttaattgactcaaagttctgcatggctgggaggctctctcaggaaacttacaatcatggtggaaggcaaaggggaagcaaggcacaacttatatggcagcaggagagagggaacatgagcaatggggaagtcccatgctttaaaaccatcagacctcatgagaactctctcactatcatgagaacagcatgggggaaactgccccatgatccagtcacctcccaccagatccctcccttaacacatggggattacaatttgagataagatttgggtggggacacagagccaaaccatttcaaagaaacataggtgatttcctctataaccagggagtagggaaaactttcctaactgtggctcaaattccagaagtataattttgcttaccaaaaattaagcatttgcaagtaacaagacatcacaggcaaagtaaacagacaaatgacaaaatgggcaaaggtactcctagtgttagtatctctaatatataaacaacctttacaaataaaaagctgggcatgatggcttaagcctgtaatcccagctactcaggagactgaagtgggaggatcacttgaggccaggagtttaagaccatcctatgcaacatagcgagacccccatctcaaaaataaataagtaaaataaacagataataataaaagaacccaaaccttaggaaaatgagcttgtaggatgaacaataaacaggaaaagaaattcaaatgattctttatcatatgaaaatatgcttatctcattcatactaacagaaatgtaaaaaaataaaatcacagattctctttctcacatattaaattggcaaaaattagaaagtttgacatgactgctgatgggtaaacaggcatgctcacattgctgatggtcctgtaaattaccctcttactatggtggttgtggaggattgggcagaatttggtaaaattactaatgcatacgccctttgaccagcaattctgcttctaggaatctatccccaaaacaaactggcaaaaatacaatttttttttttgagacagagtcttgctctgccactcaggctggaatacagtggtgtgatcccagctcactgcaacctctgcctctgaggttcaagcaattttcctgcctcatcctcccaagttgctgagaccacagacctgtgccaccatgcgtggctaattttttttttttttttttagtacagacggggtttcactatgttggccaggctggtctcgaactcctgacctcaagtgatccacccatctcagcctctcaaagtgctgggattacaggcatgagcaaaactacttttttttttttttttttttttttgagacggagtctcactctgtcaccaggctggagtgaagcggcgcgatctcagcccactgcaagctccgcctcccaggttcatgctattctcctgcctcagcctcctgagtagctgggactacaggcacccgccaccacgcccagctaactttttgtatttttagtagagacagggtttcaccatgttagccaggatggtctcgatctcctgacctcgtgatctgctcgcctcggcctcccaaagtgctgggtgctgggattacaggtgtgagccaccacacccagccacaaaaaatactttttaaatgtacacacaaggctgttagtccttacaacagatagatacatacatacatacatacatacatacatacatacatacatacacacacatatatatatgagacagtgttttactctgtcactcaggctggagtgcagtggctgagtctcctctcactgcagccgcaacctcccaggctcaagcaatcctcccaccttaacctcctgagtagctgggacttgggactacaggcacatgccaccaagcctggctaattttagaaaattttctatagagatgaggtcttctgtttcccaggctggtctcaaattcctggctcaagcaatcctcccactacagcctcctacggtgctgggattacaggcatggcccaccacatacagccatccttacaacaatatttgtaggagcaaaaaggacagaaacaacccaattgtccaccaatagaggattgattatacaaataatgtcagattgatagagtagatcttcaaaacatattattattaagatgcaaagtggaggaaagtttgtctgtgtatagcaaaatgcataatatattatgtatataaaatacttgctctctctatatatatatatatatttttttggggacagagtctcgctctgttgcccaggctggagtgcagtggcacaatctcagctcactgcaagctccgctctctgggttcacacctttctcctgcctcagcttcccaagtagctgggactacagtcacccgccaccacgtccggctaattttttgtatttttagtagagatggggtttcaccatgttagccaggatggtctcggtctcctgacctcatgatccgcccacctcggcctcccaaagtgctgggattacaggcatgagccactgtgcccggccagtacttgctatattttttaaatggaaggataaactataaacatttaagaatggttaattacaggaagagggaagtaacaaagtgagggataaaaataaaagttatgggaggttaaggtgggtgaattgctttagtttaggagttggagaccagcctgagcaacacgatgaaatctgatctctaccaaaaaatacaaaaaattagcagggtgtggtggtgcacacctgtccctgctacttgggaggctgacttgggagaattgattgagcccagaaggtggaggctgctatgaaccatgatcccaccactgcactctagcctgggtgacagaatgagaccctgtctccgaaaacaacataataaaagtcccttttggccaggtgtggtggttcatgcctgtaatcctaacactttgggaggccgaggcaggcagatcactggaggtcaggagtttgacactggcctgaccaacatggtgaaaccctgtctctactaaaaatacaaaaattagccaggcatggtggctgatgcctgtaatcccagctacttgggaggctgaggcaggagaatcgcttgaacctggggggcggaggttgcagtgagccgagatcatgccattgcattccagcgacaaaagcaaaattccgtctcaaaaaaaaaatgtttctttcagtatctcctgttttgtaaacttgactttggaatgatgtaaatattttacataattatgaaaccaaagtaaaagatttgaggatgaagctggtgcatctaaatgagtatccagggggtagcataaccataccaataatagctttttatcaaaacagtaatttgtgcatcactagtggaatatacctcaaagaaaataagatagtaaaaatatgtattttcagtcatattattagtggtgatgttggtattagtattctgagaccgttgcatgtgtactgtgggttaaagcaaatgagcaataatctaatctgtcattagtagtgtagttcagaactgagattctctgcataggagaaaggagatgtaaaatagaagagaagtaaaaccctgtggtcctgagtttgcattgcaattatctgtatgaatgcactctgtattttactgtaaaagaaaacaaaacatatctcctttttatttatactgaagaggcctaaaaataatcaccaatcctatggcagcgagcatcctagcccttggacagtaattttgaattgacctttcccactaaaggagccaagaatttttggagaaaaggctgattccagatgagagtcaggaaatatagaaaggagcctagaacatctcattctaccagatatcaaggaagctatcaaagactactagagttggccaggcacggaggctcacgcctgcaatcccagcactttgggaggccaaggtgcgtggatcatctgaggtcaggagttcgacaccagcctgaccaatatggtgaaaccctgtctctactaaaaatacaaaaattagctgagtgtggtggtgtgcgcctgtaatcccagctactcaggaagctgaggcaggagagtcacttgaacctgggaggcggaggttgcagtgggccaagatcacgccattgaactccagcctgggtgacagagcgagactctatctcaaacaaaacaaaacaaaacaaaataaccgctagagtccaaagacttgtaacccaactaggcaacaagagccattggccaaagaaaagacagtatgagcaacggtaagaataataaatccaatggtttggaatataccaaatatgtttgacccttgagtccattttgtttttggcgggggggacagggtctcactctgttgcccaggctggagtgcattggtgcgatcttggctcactgcaaccttcgcctcccaggctcaagccatcctccaacctcagcctcctaagtagcggggaccacaggcatgcaccagcatgtccggctaatttttgtattttttatagagacaaggttttgccatgttgctcaggctggtcttgaaatcctaagctcaagcaatcagtctgccttggcttccaaagtgctgggattacaggcgtgagccgcccagcccagttttttctttataccatattccagctagtaaagaaggaatgacagaattagactatcactatttctcattccgtaatggatctaggcaatgatcaccaatggctattaatattttttaaaagagagactgctaaacattacgttggtagaattaacagactatctataatgtaatcttgcctccaacctccccatcaagtctgaatctaatcaagcctctatacccagctaccaatttataaaactatagatattagaagaacgtgttaaattataccaagaggatgcaatcagcaaaatctaggttttgtgcttcatggtggctcatgcctgtaatcctagcactttgggaggctgaggcaggaggattcacttgagtccaggagttgtgacaccagtttgggcaacatagtgagactgtgtctctatgaaaaagaaacaaaactagccagtcatggtggtgcatgcctgcagtctcagccacttgggagactgaggtgggagaatcattgagcccaggagatcaaggctgtggtaagctgagatcaggccactgcaccccagcctgggtgacagagcaagactctgtctcaaaaaaaaaaaaaaaaaaagtaagaaagaaaagaaaaagaaaaaaaaatcttcattttgtagacttgtacaggttaaattattcattttcttccacaaattggaaaaaaatataaaggaatggaggaggaacccacagggacgtacaagatgtatcaaccaatggcatcattatgtgttgactttattttggtcctaattcaaacaaacagctaaaaataaatatgactccaacaaaaacttgtacacaggtatccatagcagcattattcataacagctgaaaatatatgatgaactattattcagccatagaaaggaatataggactgattcatgctacaacatggatcaaccttgaagacattacgtggccaggcatggtggctcacacctgtaatcccagcactttgggaggccaaggtgggtggatcgcttgaactcaggagtttgagaccaacctgggcaacaaagtgaaaccctatctctacaaaaaatacaaaattggctgggcatggtggtgcgttcctgtagtcccaggtactcgggaggctgaggtgggaagattgcttgagctttggaggcagaggttgcagtgagcctagatcgtgccactgcacactagcctgagtgacagagtgagaccctgttgttttttttttaaaggtgttaaaaaaatttttttaaagaaataaaaaaaaaaattatgataagtgaaataagccagacacagcaccacaaagtatatgattccatttatatgaaatgtctagaatagtgaaatttatagaaatagaaagtatattagtgggttccaggggctggatgagaaaggggaagtgactgctaatgggtacagggtttctttgtggagtgatggaattcaatactggtgatggttgtattattttgtgaatatactataaactactgaattgggccaggtgtggtggttcgtgcctgtaatcctagcactttgggaggctgaggagcgtggattgcttgagcccaggagttagagaccagactgggtaacatggtgaatccctgcctctactaaaaatacaaaaattagccaggtgtggtggcatgcacctgcagtcccagctactggagggctgagctgggaggatcacatgagcctgggaggttgaggctgcagtgagctgagatcgcaccattgcactccagcctgggtgacacagtgagaccctgtctcaaaaatgaaaacaaaaaactactgaattgtatacagtcatgtgtcacttaacaacagggatatgttctgagaaatgcatcattagacaatttcatcattgtgtccacatcatacagtgtacttacacagacttagatggatggaagaacctaggctatatggtagagccttttgcccctaggccacaaacctgtacagtatgttactgtactgaatactgtagacttctgtaacacaatggtaagtatttttgtatctaaatatagaaaagatatagtaaaactggtaaaggtaatattgacacaggattctttctgtgaagcttcaccatctggaaatctccgcagccagcagcgcccctgcctggcactcacttggctccgggcttgcctctgggctcattctgtccatctctacaaaaactttttaaaaaaatcagcctggcatagcggtgcgtgcctgtagtcctcgctactcgggaggctgtgttaggaggatctctggagcctaggggttggaggctgcagtgagctatgatcatgccactgcactccagactgactgacagagaccctgtctcataataataataatacagaagccaggcatggtggcacacacctgtagtcatagctagctactcaggaggtggaggcaggagagcccaggagcttgggcaacataacaagactctgtctctctctttttttttttttttttttttttttttttgagatagagtcttgttctgtcactcaggctggagggcagtggtgtgatctcggctcactgcaacctctgcctcccgggttcaagggattctcctgcctcagcctcctgagtagctgggactacaggtgcatgccaccatgactggctaatttttgtatttttagtggaggcggggtttcaccatgttggtcaggctggtctggaactcctgacctcaagggatccactcgcctcagtctcccaaagtgctgggattataggtgtgagtcaccacgcccagccaagaccctatctcttaaaaaaaaagaagttaggctgggcgcggtggctcatgcctgtaatcccagcactttgggaggccgaggtggacggatcacgaggtcaggagatggaaaccatcctggctaacacagtgaaaccccgtctctactaaaaatacaaaaaaattagccgggcgtggtggcaggtgcctgtagtcccagctactcgggaggctgaggcaggagaatggcgtgaacccaggaggcggagcttgcagtgagccgagatagcaccactgcactccagcctgcatttataatcaaatatatatatatatatatatatttggaatttattgttgcatggtatgtgaatatttaaaaatatttcacttgtgttcaaggataatgtgtattctctttgtaaagtttatattctctgtgagctaattgattgtattcagcttttatgttaacttttgtcaacttttttattctaggaggcagtgtttaacattttcaatgaacactgtcaacttttctatttcttcctttagtttttgtcagttcttattctgtgtactttgaatccatatttttaactgcagatatgttggcaatatgtataatcttgcttctttgttaattttactagcatataatatttattgtctcttttcatgtattttttgcttgaattcagttttgtgagacattataattgttaacagatttctttgttttaaacttacctggtatatctttttccattcttctattttcaacctttcagcatacttttaagtatttcttttggtgacaacataatattagatttttttcccttaagtccaatttgagcgtctgtcccttaattagtgaatttatgctctttacatatatggtaattgtcataatactaggacttatttctttcattttgtttgggatttgttttcttatgctattttaggtgctgcatattcttcctattgattttttacgcttatcagcatacatttcttcccccaacaagacatagtattttgaaatgcttcatcacatacctgccaccatctagttcctactcttaccctgttccttctgcttcatgtagatatcatacagaattttagtcatggtttgtcctagatataatttctcctcttttctttggttgttgctttttttagactatagtgaacttgaacatttggcaaatgttttatgtctttgtgccctagttttcttatttataaagtgaaaataattccaccttcctcacgtggctttttgtgggaggtaaatgtggcagtgtgagtgagaatgcttgataacatgtgaataattatgtgagaggtgattatcagtcaaaaattaccttttattccaatgcccacccttttctacttcactcaagtactcttttcaatctccttttcagaattcgtatttccttttctttaccccataatcctttgtgcttttatgattaaaagaattctgtatgtgttcccaagcccagagctgctggtaggctccagcaagggagatgctgtgcggcctgtttcaccaggtttagcacagtaagctgggaaaacccaagggaaaaagcctttgggatgtcgatgagtgtggaaggtagggtgtcattggagctatcactattcagcaaaagaagggaactgtgaaggtggaggatatagcatttccttctttaacaaaagcaggcttggtgtgggaacagtgggctctataatgtaatgaaaactattttcagatactattgaaattaaaatgtattattgcagtgtatggcttaatgtaatggtaactttatttcttaccaggctcatattggcaacttattaacatcaaaattcttcagttataaggattttgatactttattatatacctgtgcagcagagtttgactttatggaaaaagaggtaagatgtgatttctagttctgtttcctaaggttttggcccatacatttttcataaagggtgcccctcttatatcagactctttatgtactgttatctcagtttgaaggaaaaggaaaatctggcaacttagagaaagatttttctatttactttagtgcagctccctgaaatatatggcctttactcatttcgataatttagaaatacacattcagactagcagtggttttctaggtgagtaaacacagaggcattaaaagttgccatttttcagtgatagcattaatttagtcaagctttcaagctcttacatttccactcattttgtggttatttaaacagatatttgctttgaaacatcaagtccaagcttttccttccaacagcatttttctttctaaaactgtattcagagatttagaaggaaagcagagagtagtttagtggattgtgagacagaagcctgcaattttgcttgatgttcttgaacaagcaactctcattccttgtgttacagtttactagtttctagtagcatgccataaacagatattgtgaagacaaaatgagataatacaaaggaaagtactttgatattttaaataaataaatatttaaataaacaaaatattaatttgcaatactttatgagctggtttagttcaataaacatgtatatatgtgcatttttaacaccatccacgtggtactgattaattatattatctgtgtcactccttcagagtggtatgtgtgtgtatatgaaactggccaacaatactctattgacatgttagtttccctcatgatcccactgtgttagcccagtgtccagagttccagaccagtggatgagagggcaccacacaggaaacttttatctaccggccatttggagttgagtgtgttctgaagaggtactgtttactccagtggcctgtcagtcttcatttattgtgttccggcaaatggttttgacacacagtggctgacaaaggtatatgagttttagtgttaaacctgctgaaacaaacaaaggaagcatatcttgcaagacattgaaatgcatgttcataggggttcaagactccttcacatattagagaattaggatgtggtgaagttgtttaatgttattgagaacatcatacatactgctacaatctgagagtattaaatgtaagttatgtaatgaaagaaataatttattgaggcatagcatgacttcagctaatttgaagaaaatagcaaagctgtttccagcataccattcctcatcactgtaagtatctgaattcttagggactgtgccatagagacagagtagtgtcaattcagggaatatatgttccaattatacacccatacaatacctataacatggtatttcctaacatgatatcatactgacatggaaagatgcttaagatatataagggagtaaacaaaatgatatagtcttattaatgcataattaacaaacataaaagtaaaaaaaagtgtaaaagagcaaaattttaagagtggttttttgggtggagagataatcgagaggtatagggcttttttattaaacttatttctattttttttctgctactaaagaaaatgtaaaagtcttttgttcccctcaaacatcaatcattattttgtttatgtgtgagaaactgtgtgtgtgtgtgtgtgtgtgtttgtgtgtgtgtatgtttcaatgataatatttttatcccccacaaaatatacaggaaaagcttattccatttaaggagctttacgtaccttagatgaatattaagttggtctctctagttagataagtagcatgcaaaaagtgagcagtaatcttttcagtgacatttcacacttacaggtgtttgggtactgtatttttagtgtttcaactcagcattttggggaagttcatttctatggaaatgcactttcctttttatgatggcagtcagtgagaagattggtgaatgttcatatttctctacttttagaaatttacctatttcattatttgaaatgaaactttatttggttaaaatgtttccttctaacaaaacatctctttgaatttcagactccactgagatacacaaagacattattgtttccagttgttcttgtagtgtttgttgctattgttagaaaggtatgtctatcacttaagagctctttcttataatagaatattttcttgtttttacatagtagttgcatatacttggccacatattaatctgatacaatgttttgtatgggcttactgtaacatattatatgttttcttaatgatagtttttgatagacatttatatatcttcaaaatattctatctgctagcataaaatagacatcggaaaatgatggctcaagtttcaatagtcatgtattttggaaggcatgatcagagaccatattgacccagatacaacttgcctgtgtaaattattactggcttttacctttaatgtaatatttccctaaaatatttaatacatacctttctaagtgatttgtgcagtgtgcagtaactcctggattgtgtttattattaatcagaaagaaaaaacagtatttgcaatgtgttgatgaactagataaaatgtttaggatccccaacttggctttgataataaaattctaagcccagatataaataaggtcaaagcaagtgtgatattccctctctttttttctttcaagaattgtgcactctgtaacccaatgtgtcttaagagaatgaatagaagttaatctgtgatggaaaaagagatgacagaacttaaaagtttcctgatttgtagccagtgatttctgtgttaatacaatttcatttatttgtagaatattctgtattataacaattgttcatattatatatttgtactctgctttgtatagaacaatttcacgtgagtatttaaattgtttattcgacagccctatggggtagacaaatgttatctccattttaacatacggaactgaaagatcaaagatgttaggaacctcacatcatgtccacttaaaagcaagggaagagtatgactcgggctctgcaccttcccccatcattgggctacgtctggtattcagctatgcactccaacagcacttttcatctctaatcagttaatagtcagttcctggccaggtgcagtggctcatgcctgtaatcccagcactttgggaggctgaggctgacagatcacgaggtcaggagatcgagaccatcctggctaacacattaaaaccccatctctactaaaaatacaaaaaattagccaggcgtggtggcaggcacctgtagtcccagctacttgggaggctgaggcaggagaatggtgtgagcccgggaggcggagcttgcagtgagccaagatcgcaccactgcactccagcctgggcgacagagcaagactctgcctcaaaataaataaataaataaataaataaatagttcctgctgtgtgctaggctttgtgtgtgctttgcacttttatatactttatgtggatttgaacctagtgggtactcaaaaactactaagcactggccatccagaacatatgcaaaagacagcaacgtgagtggtgacagatgatgaaaactattagctgggctgtttcgtttagagaagaaaagattcagatggaaagtggataattactttgaaatatgttaaaagcctgccccttgaaaataaggttacacacaatctggctccttagaatcatggccaattccaggcggtaggacttttgaccagaactgatctcaactgataaggaaagtgttatagattcaagcagcagctggtggattctaagggctggattacagcctgtcatcagtgttgtagagaatatttgtactggagataggattttagattagatgacctcctcgttattgctaaatatgaaagcacagtgactgtgttttgaatgcttccagctgtgattatcaacctctgagccagctctccagttttctgagtgcactgttaagaagaggtgttgccaacaacgttggcatggtggaagcagcgctgaatgtgaatttgaagccagaagatctggtttcaagactgcagttcttcttagtagttgtctacctacagggcgatcatttaatccatatgagcctgttgctcatttacaaaatgaggatgatataatctacccaacagggttgttgaatattagtgttgatcaaatactacacaaatataagattatgttgttgtgattattattttctgagttatctcttatctctatacttatatttttcattaaaagttttacaatttagaagatactttagttaaaatatcatttttcccaacacagcttttctaaagtgtttcaaaatctatttacagattattagtgatatgtggggtgtcttagctaaacaacagacacacataaggtaaatatgctattaagaattttgttacctcctctgttcatttattaaatagatatttacagtgtattaattttatactcacatgttgtgtacctaatatttgataattgatgtttttattgtggtcatttcccttcttggtgtttcttcttatttcctatctgtgcagaacacagcacatcacttattcatccttcagatgttatccagtacaatctgacagtagccctgcacataatctacactcgaaggacacagttttatacttcagttcagcagggaaagtaaattattatgtgagtggttttaggaccagtggactgccttttgggaaatgagcagggaaatataaaactggattcatacctcactttttgcagaaaataaatttcagatgaagcagagaattaggtatagaaaaaaaataaagccccaaaattaactaagagggtaggtttataatctgagagttagggaggcctacagtatgcttggtattttctgccatcacaccctttcatcttactctcttaccatttatcaccctttgtacttaaatgttgatgtgtgacctgtatctcctgaagggagggatcatttttgttcaacagtttatatacagtgcctgcaagatagtaaaggatagtagttgaatgagtgagtatttacatatgactaatgaacatgaaaaggtagtcttgatcctatggtaaagacattcaggttgaagtgaagaccttttcacttctcatatttctaaaaattaatagtatacccaatgcttgcaagagtgggaggtagtagatgggagggaaatttggcaataaacagtaaaacatatagtgggcctgtactttagccctgcaggttctaccagcgcaagtgtactctccagagatgctcacagaaatacagagatgatggggagaaatgtcttttgtagtattgtgtgtaatgtgagaaatggaaacatccaaaatatctactatgatccaatcatagagtggaatgttaggccatctttctggaaataggtccagtatacattattgaattttaaaaattgcctctgtgtgtgtgtgtgtgtgtgtgtgtgtgtgtgtgtgtgtgtgtgtgtgtgtgtgtataggatgattatacttctgtttaaaatttggagatttttatgtgtttgtgcatagaagtgatctggaaagataaatcctgtaattattaagagtgtgggattggaagatggagtgaaggtagttttaactttacttttattcttttgtaggattttgggaggacaaggattgtctaatgtatgtatctatattttctgttctttttttttttttttttttttttgagacagagcctggctctgtcgcccaggctggaggagtgcagtggcacgatcttggctcactgcaacctctgcctcccgggttcaggcaatttcatctgcctcagcctcctgaatagctaagactacaggcgaccaccaccatgcctagcttatttttgtatttttagtagagacagggtttcaccatattggccaggctggtcttgaactcatgatgtcgtgatctgcctgcctcagcctcccaaagtgctgggattataggcatgagccacctcacctggccctatattttcttttataatttgaatatacacacccttatattattccctcacctccaagtctctgccaacataatgataaattattgcacatactcctgagagaatccttgttctcacttagaaacaatttactgtaacatatacaggtatatgtttatacctgtaacatttgagttgagggctaagggggaaagaaaaacgttctggtttacaatgccgaaatttttcttcatttgaggtgaaattacttttgaagagctcaggaagaagctacaaagtttcagctgtagtatgcagctctggaagaggaaggtggaacttctcacagaaacaaagctgtcccttcaagagtaataactcacctatagaaataattataggaaaccattaagcttcatggggttttcagttcaaataggatcagagctcttttttggaagaggagtggcaatgttgacattttattttgcatagctaccaaagccagtgtaaaaaggagaagagtaggacataaattttaactatgaaagacgtgaatgccaatattctctttactcaaagacccaggaagtaaagtgggttagaggcagcatgatgtagtaaaaagtatattggctctgaagtcaggcagaatatagtcctggctgccacttagcagctctgtgattccctttccttggctgtaaattggggtaataaatggttgtaggattagagttaatggaatgtactaagcatattaacattgtaagtactcaacaaatggtaactgatagtttttatgtggagtgaaacaagaataaagaaagaactgtttcatctccttcactagccccctatgtactactgagtttgctaatatatcagtctttttgaggccaaattctcaaattagattatatgctacctggattaacagttttttgtttttttgtttgtttgtttgagacggagtctcgctgtgttgcccagaatggagtgcagcggcactatctcggctcgctgcaagctccgcctcccaagttcacgccattctcctgcctcagcctcctgagtagctgggactacaggcgcccgccaccacacctggctaattttttgtatgtttttttggtagagacggggtttcattgtgttagccaggatggtctcgatctcctgaccttgtgatccgcccacctcagcctcccaaagtgctgggattacaggcgtgagccaccgcacctggcctggattaacagtttattgatacacttgttcattcattaaaaatgttgagctgtaagtgccaggtattactctagaacttgggaacatatcagtgcttaagaaagagaaggtgtgcgttgtcaactcacacatttctgtctctgacacagacttctcccttgaactcagatttacacatataaccacctatttgtcatctctacttggttgcctagtgaaaatctcaaaggtttttttcattccatgctttgctgggttatcaccagtgagggagctgggacaccacagtgtgcctttgttgtcctaataaatacccatgtagtcaaataggatataatacaacattgtcattcttcataaattttcttaaaatagtatagcaccagttttggcatgtaacttttagttattttgatttgcctatatgtgtcctgagagaatgttatagaagttgtaaaactcctatttgcaagatgaaaatgcaaatatatgaaataagtgcttcaataatgaattgatagcaatatatttttttctgttccagaaaacaccagtttgatcatggagaggtaaagacttaatatcactataattttacttatcttaaagttgcatgcatttggactttcctttctagttccagtttctaactttgttggaattatcagcaatcatcttgaaaatagcctgttatgtgtttttatgagaatgctacatgcagattcactgaccattcatttgttaaaattaactaggaaacttatttgttctgctctgatcatctttacgctaacagcagttgatttctggagcccatttagacatacgtgtgaggtgtctattgcatgattggaaatcactttcctctctgctcaccttgcttgaggcctcagagatgtgattggttactgctcccatctcctagtggtccagtctggttttgagggcagttccaaggtggagccctcagatcttgaggcagcagtcatttcttttaccactgtcttttcttggtctgatggtagcatcaaggtagattaaaaaatgtgggctttattaaccacaggtttgactctgagaatcacagaaacacttgccttaatgactttataatttcagccttccactaaaatagaacagtttgaaagtgaattttaagaattgttttagaaatttcagaaaccaaagtagtagtattttttgttactaaggagaacatacccctttctgcatattgccagcttagtattcttaaacttcacaaacagtaggagtaaaaaacattttcttctttctttcagctggtttaccatgcattgcaattgttagcatatacagcccttggtattttaattatgagactaaaactcttcttgacaccacacatgtgtgttatggcatcactgatctgctcaagacaggtaacatgttatgttggagtatagccactgtgataattttagcctttattattgagtggccctaaaataatgaattacaaagtcttttaagtgattatagttaaagctcttcatggttttgtacttatctttcttaaagggtaagggccaaagctgatcattttctatctttctaaagatttaaaatagttgttggtgtacaacaaataccgatttagtacagactgagttcatgagtgattactgcaggtgctgatagaaagcagagcttaattgtacaaataataacttttttttgttttgacattcacatcacaaagaattctaacaatttcaagttataagtgcttgaaaattatatgttccttttttagtatcaaacttactctttttttctcatttggtgcacatttgtgtgcacattcttgacttgtgctttttaaaatttagtttaaaccttccttggtggtttgttgcttatttttcctggataactgcctccttgttctgtatttacagatttatgcttctccatagtgtcacctttccatcagtcaaccagcctaggtacaacagcagcacctcccttaaacatagcagatagtcagtgagcacctacactgtgcactctagggatggaggagagagtagtagacagaaaagtcaaaagccagtgtttataagccctcaagaaacttgaaatctagctctgtagacttgtagagaaagatcaagagagcaaagtgttgttatggtgtgtggactatttggatgtggaaaaaattagccagcctggaggttcccaatcagaatgttgtattatgttagaaaggcactactttccacctttctgaccccttcaggctggcacaagaaaggaggctggttggaagcctttaatcttgagtcttatcccacagcatgactgatgatataggttgatgcaaaagtaattgcgggttttggcattaaaatagcaaaacctgcaattgctttttcaccaacctaatagaaagtgtcacccagggcaggttttgcaagtgtggggttcctgctggtcacacaggacctcgcattcagaaggaccctgaacttggttgaatgtttgctgctgctgttttgaacgtcttaatacttttttaacaagagaccccacatttttgttttgcattgggccttgtaaattgcataggtggttgtggctttacttgaatctgggagtagagaaagcaggttgagaaaagagcttcctacattgtgttccacttatatgaggctgatggtagaattcttttgatctcaaagattattattttggggctttttctttaggataattaatcctttatttgggactctagcagaggccacattcttctctgggaagaagttttgcatgacagatgcatactactttatactaacaattaccgatgtattcttaatttggtttcagctatttggatggctcttttgcaaagtacatcctggtgctgttgtttttgctatattagcagcaatgtcaataccaggttcagcaaatctgcaaacccagtggaatactgtaggggagttcagcaacttgccacaagaatttatagaatggatcaaatatagtactaaaccaggtaaaaaaaaaaaagtcatattatttaactgtttttcccacaattttatataccactgcaaactccaaactcttaaaccctagttacttccactgatcttactctttctaagcaatgttgcttttagaatatctaaaacaaaggagatatcaatcctgtttaaatggtttgcatgggaaatgttatacatatgttcttagtaatttattctgccactttttatagattttaattttttcaaaatttattcacagtcataaatgccacatttaaaataattttactgtgcttatttttttaatgaatttttaatattagtccttcacattccttcttgaaataaactcatggaatgtggtattttattcatgtgtggaaagggagacttcgttgtcatctgagtatcaaatgattgaatactaaatcatcttccagaactctttgttactataaagctttcctagtccatttcatacttcttttctagattcaggaaagatttctaagatttttctttaaagaaagaaatctttaatgatgagatgatgaagctctattttccaaggaaaatagtttacccaggcctggctgccaactgctactttatcagccatctgacttcattcttttatttttatttttattttattattattatactttaagttttagggtacatgcgcacaatgtgcaggttagttacatatgtatacatgtgccatgctggtgtgctgcacccattaactcgtcatttagcattaggtatatctcctaaagctatccctcccgcctccctccaccccacaacagttcccagagtgtgatgttccccttcctgtgtccatgtgttctcattgttcaattcccacctatgagtgagaatatgcggtgtttggttttttgtccttgcgatagtttgctgagaatgatgatttccaatttcatccatgtccctacaaaggacatgaactcatccttttttatggctgcatgtattccatggtgtatatgtgccacattttcttaatccagtctatcattgttggacatttggcttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacctccacaatggttgagctagtttacagtcccactaacagtgtaaaagtgttcctatttctccacatcctctccagcacctgttgtttcctgactttttaatgattgccattctaactggtgtgagatggtatctcattgtggtttcgatttgcatttctctgatggccagtgatggtgagcattttttcatgtgttttttggctgcataaatgtcttcttttgagaagtatctgttcatgtcctttgcccactttttgatggggttgtttgttttttcttgaaaatttgtttgagttcattgtagattctggatatcagccctttgtcagatgagtaggttgcgaaaattttcgcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaataagagctatctatgacaaacccacagccaatatcatactgaatgggcaaaaactggaagcattccctttgaaaactggcacaagacagggatgccctctctcaccactcctgttcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggtaggaagaatcaataccgtgaaaatggccatactgcccaaggtaatttatagattcaatgccatccccatcaagctaccaatgactttcttcacagaattggaaaaaactactttaaagttcatatggaaccaaaaaagggcccgcatcgccaagtcaatcttaagccaaaagaacaaagctggaggcatcacactatctgacttcaaactatactacaaggctacagtaaccaaaacagcatggtactgctaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaaggtggattaaagacttaaacgttagacctaaaaccataaaaaccctagaagaaaacctaggcatctgacttcattctagttctgccattgaatcttgaagtcatgaacctgctgggcctccactctgctacctgtgaaataatttacacttgaaggagaccccttctcaccctcactgagtgtcttcctgagacattcctcttgacttccagatgcaatgtttgcaggtgccacgcccaggatggcaagtgttaagctctctgtgcttcagcccattgtgaatcatccacattatgaagatgcaggcttgagatcaaaccttccatgcaaacagacagtgagtggaggacaccagcaaagtaatgaggaatgttccaaaaggatatgatgaactgaggtttatcaagtcggggagcagaaggctgaaataagactgctaagctctaaacaaatcctttaagtcttcacagggcaggaaagcgacaactttgggggctatcttctctagcaggcagaaaaaagaagtaatactgtagcactttcccacaggttaacagggctctaaaatgtccaagtccttttcatcctgtaactccctgaagagtttagcttagagtgtttagtaaggttttctcataggtgatttttcttgagtttggagaagtcatttgaaatataatcccattcaaagaggagtttattctggttttcaccagtatagcctgttagaatgatcttgggtgttttctttatttttagatttttttgagactttaaaaaataatttagagatgtgttgtctaaattattttttaaaaaagattaaatttttcatgcagtttctaaggcaggtgaagctattcattttctaagtgattagatgaatcttattagcatcttcttttgcatatcaatggcatgtacatttacaaataagatttttcattaaaaaatcaatctcatcaagctaatttccagaccaattttgttaaataagtttagtatttctaaaatctagaaaaaaaaatgaagaaccacttaatgtgaattattgttgatatcaaagttgggactgttgcagcttcagagtagtcctgtagttgtatttcttgtagttcatccctgttcacacacagggtaccttactcttatatgtgatagattagtgaagaatttaagacaaataaataagtgaacaaacacaaagagaccaagtttgggaatgtaggggtgtgttaaaggtcaccctcttctccacaacttgtcctcctcctgccttctgcttttgacctcactgatgccccttcgcaggaacttccatggggaatttcctcctgactggattcttcttcattgtcttctagtctaattcagtgctttcttccaaatgtgttattgtatcattttaatcttgaaattttgttcccaattatttttctttaaagtgccagaacaaaaatagtatactcaatgtatagtcagaaagcagctgaagaagtgaagcgagaactgatagttaaaagtgaactattacattctagaaaagtcatggtgtgtaagaagatccaagtgagtatcaacacagttaacattttataatcataagacacgaaggttaattcaagcacatggcacatgctttgctggtggcgggggtgtgtatataacataaagtatacgtggaaaaaacttttttttttttaaataggctctctgttgcccaggctggagtgcagtggcataatctaagctcactgcagcctccgcctaatttttgtatttttagtggagatggggttttgccatgttgtcccaggctggtctcaaactcctggcctcaagtgctactcctgccttggcctcccgaagtgctgggactacaggcgtgagccaccatgcctggcctgaaaaaaccttcttgataatgatttggagactttcttttctagtctttataaatatctttttttaaaataatggtttgtatgtgcatactaccttaaagagattttattggaactagttgataatctcccaaattgttcatatttgcttttgatgtttttaaagaaacttttatttaaagttggatgtattttctttcaaaagacttccagggtctgaaaccaagtaatggggagtctcttttggtgaagtcaggcagctgagcaccaggggtcacattatccttactgggtctctgtgctacaccatgtcctgtcgatggatgggataccctgtcagcaaaaactcagaatgaaacttttctttcctggtgtttcacatcttacttgaatgggaaaatgactctactgtgacccacattctcttgggtttatagtttttaagtttctatttccaaagagatgtttactaagctgagtatagctccaagtgacagtaagatcttcaaagcagatgtgaatctaaagctatctagaaatgtggcacgtaagtgactggacaccaggtgacagtagcctgcttttaaagtaccaaaacagtcacttcatgaagagcacagtacaggaacaattttatcagaaataaacactattttatggaataataatatttttaaaattcttactactctgtaactaaacaaaagtgttcaagagattgctatatttgtggcttgatcatacttgcccaccatatatttcaatgacacatatggtattaagacaacattgttaaatactgagtcgtgagtgaaaaatagttctgtgacatagtatctacagctttgctcataaggcaactaaaataattgtcgattataaaatgattttcctatgaatgtgtgctatgtggtttgaattcagtcaggatttatagaaaatgttattttgtaataatttagaaaatgctttaagcgtttgtgaatatatatgaaattcatatactcacctttcacattgttatataaatttaggacagaaaagttctaagcatctcatgacgatcaggaaattatatgaaatgaatgataggctgacatttgcaataggaagaactctgttcttagcatagctttccaccagaatggggatcttctttatttctttgggcttcactctcttgaaacaactgtaagttactggaacataaaaataattttcgtaaccttttttctccaagctaacaatgagcctttgagagttcattttttgcctagacccctgcatagagtttgaatatgtgaaagttgcagaggctttgtgctgtagagtgttgagagagctgcctggatttgcatagctctaacagtctcatgtttgggtaggcagagcactgttttacccacacaagaagggatatgaaggcaaattcaggatgtatggcaataaactttgcacactaaacaaaatcagcagacattgaactgacttcaagtcacttacgagcactcagactgagagttggggtgcagaagagggtgtgctggatttccccatctgggccttgacttgccatttattgtgtctgtcacagcaggagttgagtgggaggaagctacgaaagtgactctctcatctgttttccccactcattaaaacaacactctccatctagtacaagatctaagccaggctgatgacacactgtcaggaaaccttggacaggtccactctgcttcaaccttgacacaaaacaaaagctgtgctttctgtcctgacagggaagcaaatggggagttcagataggagaggaaagtgaagaatgactaatatttatctagtgtttacatttacagtaggaagtttcttgacaaagctttctgccaggtttgggaccttccttatttccttggccttcactctccatttcagttatgatcagcctgaaacccctgtagattgctgggacgtgaaagtatgtccgaatgggggaagcagatggggaactcagttaggagaggaaggggaagagggaccaatatttatctagtgcttaatctgtgcctggcaattggtgagcactatgtttaaatgatctcatttacaagtggcttaattgtatggcttgattattccttaaatatttgacactgagtttaaatataaacattcaaatctatttgcatgcaagttgtagattagttttaaattaactacagttctctgctttcttttactccaataatagagttgacatagaatacatgtatttagaaggaaattattcagattttcactaatgctatttgcagatggctggcctggggaaaccttgggaaactcagatgaggactaaatagtgttgcacaaggcaaacagagctccccaagacagctgtttgccctctctttttcctaaaagctgttgaactcaggaaaactgtgggtcgttctctactttctgtgcgtctcactctctgccaccgtgggccctcagtgttgtaacagttcagccttgacatgtaggagaaaattccaaggtagaaaacccatgcccagccatatgatcataggtgttccatgtcagtagaaaccagtgtcagcaagggtgtgcaaaaagtgtgtacttgagccctcttcatgggaacactcgctggcaaaacatttctaggggatagtttgatgaagggaaggtaagaaaaaaattgtgcagtcctttggcagagtgataatgttgcctctagagcaggggtctccaagcccccggccatgaaccagtactggtctgtggcctgttaggaacccagtctcacagcaggaggtgagcggagggtgaacaagcattacagcctgagctctggctcctgacagatgagtggcagcattagattctcataggagtatgaaccctattgtgaactgcacatgcgggggatctagggtacgtgctccttatgagaatctaatgcctgatgatctgaggtgaaacactttcatcccaaaaccattgcccccaccctccaatccatggaaaaattaccttgcacaaaaccagtccctggtgcaaaaaatgttggggactgctgctctagaggtttagcttgcagaagggagcaccgcacaagactgcttgtagctgcattgctttataatggcaaaatgggaaaaaattaaagtatctgtctgtaaagaactcgttaaataatacatatgagaactagcagcttttaaaaacaatagagtaggtctttatgcactgagatggaaaaatagtgccacattttattgttcagtatagagtcccagaataattccatttttgtaaaaacaactcaagagcatctgtcaggattttccagagggacagaattaataggataaacttatatatatgatgtctgtgtctgtatgtgtatctgacattggataagaaaagatccagcagatagcaaatattgtatgttctcacttataaatgggaactaagctaccaggatgcaaagcaaaagaatgatatggactatggggactccggggaagcaaggagtggggtgagggataaaagactacacactgagtatacttgatactgctctggtgatgggtgcaccaaaatctcagtaactgccattgaagaacttatccatgtaaccaaaaaccacctgttttgcaaaagctattgaaataatttttttttttaaaaaaggtccagcaggatatatgctggattgtttatagaagtcacctctgagaaatgctattggagatgatggtgactttcatttcttaaaatgtatgtaggtctatatttggtacttttataatgactgattacttataaattaaatatgttatttaaaaagggaaaatgatgtacatccctgctacagtgtttgcctcatggtggagagtgaggaagggactgctactaaacataagagggacttgttgggaattttttttctcttatttagaaataaaactaaaaagggaagcaattatgacaaaacatgagcagttgtcaattctctataattttcccatatgtttttctgttttttaaaattcctcaaaaggtagatagcagtatccaacagttctatctataaaactgttcttgatttaaaataaatggtactgttattttgaaggacttatttaggcaaatgtcatatgatgccaattttacttattctattctttatatatattgcttttgagatttaattatgtatttagctaagatgtatgtccaacactaccagaatttctttaaattgattcattctagaatatcaactgtccagtttaagatgttttgacctactgatttttttactttatgacagtgttaaagccatatgcattcagtagaaagcatacttcaaatacccatacaaccattctgtttttcagtgtcagtacagcattcaataaattacatgagatgttcaacattttgttataaaacagcatttgtattagatgattttgtcaaactgtaagctaatacaagtgttcctagcatgtttaaggtaggctaggctaagccgtgatgttgggtagattaggtgtattaaatgcattttcaacttatgatgggtttattggaacataccccattgtaagttgaggagcatctatacaattaatgcaacttgcctctgaattaagcatatttgttctttataatttttttaaatcaatattgtcaggcctctgagcccaagctaagccatcacatcccctgtgacctgcacttatacatccagatggcctgaagtaactgaagaatcacaaaagaagtgatacttaaatggcctgttcctgccttaactgatgacattccaccacaaaagaagtgaaaatggccggtccttgccttaactgatgacattaccttgtgaaattccttctcctggctcatcctggctcaaaaagctcccctactgagcaccttgtgacccctcactccggcctgccagagaacaacccccctttgactgtaattttcctttacctaccaaaatcttagaaaatggccccaccccatctccctttgctgactctcttttcagactcagcccacctgcacccaggtgaaataaacagccttgttgctcacacaaagcctgtttggtggtctcttcacacagatgcgagtaaaatttggtgccatgactcggactgggggacctcccttaggagatcaatccctatcctcctgctctttgctccatgagaaagatcgacctacgacctcaggtcctcagactgaccagcccaaggaacatttcaccaattttaaatcgggtaagcggcctctctttactctcttctccaacctctctcactatccctcaacctctttctcctttcaatcttggcaccacacttaaatctctcccttctcttaatttcagttcctttccttttctggtagagacaaaggtgaagcgttttatctgtgaacccaaaactccggcgccggtcacagaatcaggaagagtcttcccttggtgtttaaccacatggggatgcctacatgattattcacccatgtttcagaggtgtctgaccacggagggatgcctgtcttggtccttcacccttagcggcaagtaccactttttggggggcaagaaccccccgaccccttccctccatgtctctacctcttctccactttcctgggggcaagcatccccccaccccttctctctgtgtctctaccctctattttctctggacttgcctccttcactataggtaaacttccaccctccattctccttctcccttagcctgtgttctcaaagacttaatacctcttcaactcacatgtgacctaaaacctaaatgccttattttcttctgcaatgccacttgaccccaatacaaactcgacagtggttccaaatagccagaaaatggcactttcgatttttccatcctacaagatctaaataatccttgtcgtaaaatgggcaaacagtctgagatgcctgacgtccaggcattcttttacacatcggtccctccctagtctctgttcccaatgcaacttgtcccaaatcttccttctttccctcccacctgtcccctcagtcccaaccccaagcgtcgctgagtctttcttctttccaatcttccttttctatagacccatctgacctctcccctcctccccaggctgctcctcgccaggctgagctaggtcccaattcttcctcagcctccgctcccctaccctataatccttttatcacctcccctcctcacacccggtcgggcttacagtttccttctgcaacaagccctcccgcacctgcccagcaatttcctcttaaaaaggtggctggagctaaaggcatagtcaaagttaatgctccttcttctttatcccaaatcagagagcgttaggctctttttcaccaaataaaaaacccagcccagttcatggctgcttggcagcaaccctgagacgctttacagccctagaccctaaaaggtcaaaaggctgtcttattctcaatatacattttattacccaatttgctcccgacattaaataaaactccaaaaattaaattccagctctcaaaccccataacaggacttaactaacctcgccttcaaggtgtacaataataaagtggaggcagccaagtagcaatgtatttctgagttgcaattccttgcctccactgtgagacaaatcccagccatatctccagcacacaagaacttccaaatgcctggaccacagctgccaggggttcctccagaatctcctccccaagccctggaaatctggccactgggccaaggaatgcccatggcccaggattcttcctaagctgtgtcccatctgttcaggaccccactgaaaatcggactgttcaactcccctggcagccacttccagagcccctggaactctggcccaaggctctctgacaccttcccagaccttcttggcttagcagctgaagactgacactgcccgatcgcctcagaagcctataggaccttcacagatgctctgggtaaccctcacagtggagggtaagtctgtccccttcttaatcaatacagaggctacccactgcacattacctttttttcaagggcctatttcccttacctccataactgttgtgggtattgacagccaggcttctaaacctcttaaaattccccaactctggtgccaacttagacaatatgcttttaagcactcctttttagttatccccacctgcccagttcccttgttaggccaagacactttaactaaattatcttcttccctgactattcctgggctacagccacacctcattgctgccttttcccccagttcaaagcctccttcacatcctccccttatatctccccaccttaacccacaagtataggacacctctactccctccttagcgaccgatcatgcaccccttaccatcccattaaaacctaatcacccttaccccgctcaatgccaatatcccatcccacagcatgctttaaaaggattaaagtctgttatcactcacctgctacagcatggccttttaaagcctataaactccccttacgattcccccattttacctgtcctaaaaccagacaaggcttacaggttagttcaggatctgcaccttatcaaccaaattgttttgcctatccacaccgtggtgcccaacacatatactctctgcctcaatacctccctccacaacccattattctgttctggatctcaaacatgctttctttactattcgtttgcacccttcatcccagcctctcttcgctttcacttggactgaccctgacacccatcaggttcagcaaattacctgggctatactgccacaaggcctcacagacagcccctattacttcagtcaagcccaaatttcttcctcatcagttacctatcttggcttctcataaaaacacatgtgccctccctgccgatcatgtccacctgatctcttaaaacccagcactttctacaaaacaacaattcctttccttcctaggcatggttggatactttcaactttagatgcctggttttgccattctaaaaccattttataaactcacaaaaggaaacctagctgaccccatagatcctaaatcctttccccactcctttccgttccttgaagacagctttagagactgcccccactctagctctccctgactcatcccaacccttttcattacacactgctgaagtgcagggctgtgcagtcagaattcttacacaaggaccaggatggcatcctgtagcctttttgtccaaacaacttgaccttattgttttaagctggccattatgtctccatgcagtggctgctgccgctctaatacttttaaaggcccttaaaatcacaaactatgctcaactcactctctacagctctcataatttccaaaatctattttcttcctcacacctgacgcatatactttctgctccctggctccttcagctgtactcactctttgctgtgtctcccacaattaccattgttcctggcccggacttcaatccagcctcccacattattcctgataccacacctgaccctcatgactgcatctctctgatccacctgacgttcaccccatttccccacatttccttcttccctgtttctcaccctgatcacacttggtttattgatggcagttccaccaggcctaattgccacacaccagcaaaggcaggctatgctgtagcacaagccactagcccgcctcttaaaacctctcatttcctttccattgtagaaaactgtcctcaaggaaataacttctcagtgttccatctgctattctactactcctcaaggattattcaggccccctcccttccctacacatcaagcttaaggatttgcccccacccaggactggcaaattagctttactcaacatgccctgagtcacaaaaactaaaatacctcttagtctaagtagacactttcactagataggtagaggcctttcctacagggtctgagaaggccaccacagacatttcttcccttctgtcagacataattcctcagtttagccttcccacctctatacagtctgataacagaccagcctttattagtcaaatcagccaagcagtttttcagactcttagtattcagtgaaacctttatatcccttacagtcctcagtcttcaggaaaagtagaacatactaaaggtcttttaaaaacacaccttaccaagctcagccaccaacttaaaaaggaatagacaatacttttaccactttcccttctcagaattcaggcctgtcctcagaatgctacaaagtacagcccatttgagctcccatatagatgctcctttttattaggccccagtatcattccagacaccagaccaacttggactgtgccccaaaaaacttgtcatccctactgtcttctgtctagtcatactcctattcactgttctcagctactcatacgtgccctgctcttgtttacactgccagtttacactgtttctccaagccatcacagctgatatctcctggtgctagccccaaaccgccactcttaactcttatagtaaataaataatctttgcaggcaaggctatgctgaacctccttaggcactctctaattagatgtcctaggtcctcccaattcttagtcctttaatacctgtttttctccttgtcttattccatttagtttttcaattcatacaaaactgtatccaggtcatcaccaataattctaaatgacaaatgtttcttctaacaaccccacaatatcaccccttaccacaaaatcttccttcagcttaatctctcccactctaggttcccacgccacccctaatcccgctcaaagaagccctgagaaacatcgcccattatctctccataccacccccaaaaatttttgccgtcccaacactttaccactatttcattttatttttcttattaatataagaagacaggaatgtcaggtctctgagcccaagctaagccatcgtatcccctgtgacctgcatgtacacatccagatggtgggttcctgccttaactgatgacattccaccacaaaagaagtgaaaatggcctgttcctgccttaactgatgacattgtcttgtgaaattccttctcctggctcatcctggctcaaaagctccccaactgagtaccttgtgacccccactcctgcccaccggagaaaaacccccctttttcctttacctaccccaatcctacagaagggccccaccccatctcccttcgctgactctcttttcggactcagcccgcctgcacccaggtgattaaaagctttattgctcacacaaagcctgtttgttggtctcttcacatggacgcgcatgaaagctacatgacaggattgtttaaaaactaaagtaatttaaggggaaaaaaggaaatgagatcaggaatgtaagaagtgccctgctttctctgcagttatataatgcatactgatttttaacatgtacattcatttttctaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctctaatggttttaatgttttgctaagtcatgtgttgttcatatcccaaaaacttttataggtaactgttttcaaatagaaaatgttttatttggtcaatttgaatgtcattctaattataaaaatgactcatacctttcatgcgcgtccgtgtgaagagaccaccaaacaggctttgtgtgagcaacatggctgtttatttcacctgggtgcaggtgggctgagtccaaaaagagagtcagcatagggagataagggtggggccattttataggatttgggaaggtaatggaaaattacaatcaaagggggttgttctctggtgggcaggggtggatctcacaaagtacattctcaagtgtggggagaattacaaagaaccttcttaagggtgggggagattacaaagtacattgatcagttagggtggggcaggaacaaatcacaatggtggaatgtcatcagttaaggctgtttttacttcttttgtggatcttcagttactttaggccatctgaatgtatacgtgcaagtcacaggggatgcgatggcctggcctgggctcagaggcctgacattcctgccttcttatattaataagacaaataaaacaaaatagtgttgaagtgttggggcggcgaaaatttttggggggtggtatggagagagaatgggtgatgtttctcagggctgcttcaagcgggattaggggtggcgtgggaacctagagtgggagagattaagctgaagggaggtcttgtggtaaggggtgatattgtggggatgttagaagaaacatttgtcgtatagaatgattggtgatggcctggatacggttttggatgaattgagcgagcttaatgtgtagggaagggagggggcctgaataatccctgaggagtagtagaatagcagatggaacactgagaagttatttccttgaggatagatttccacgatggaaaggaaatgagaggttctaagaggcgggatagtggcttgtgctatagcatagcctgcctttgctggtgtgtggcgattaggcctggtggaactgccatcaataaatcaagcgtgatcagggtgaggaacaggaaagaaggaaatatggggaaatggggtgaatgtcaggtggatcagagagatacagtcatgggggtcaggtgtggtatcaggaataatgtgggaggccagattgaagtccgggccaggaacaatggtaattgtgggacttaacaaagagtgagtacagctgaaggagctggggagcagaaagtatatgcgtcaggtataaggaagaaaaagatttcggaagttatgagaaatgtagagtgagttgagcatagtttgtgatttttagggcctctagaagtattaaagcatcggcagccgctgcatgcagacatgagggctaggctaaaacagtaaggtcaagttgtttggacagaaacgctgcagggtgtggtcctggctcttgtgtaagaattctgaccatgctaaccatgcctaggaaggaaaggagttgttgttttgtaagggattgaggtttgggagattaatcggacacgatcagcagggagagcatgtgcgtttttatgagaattatgctgagataggtaacagatgaggatgaaatttgggcttgactgaagtaatgggggctgtctgtgaagccttgcggcagtacagcccaggtaatttgctgagcctaatgggtgtcagggtcagtctaagtgaaggcaaagagaggctgggatgaagggtgcaaagaaatagtaaagaaagcatgtttgagatccagaacagaataatgggtaatagagggaggtattgaggataggagaatatatgggttgggcaccatggggtggataggcaaaacaatttggttgataaggcgcagatcctgaactaacttgtaagccttgtctggttttaggacaggtaaaatgggggaatggtaaggagagtttataggttttagaagcccatactgtagcaggcgagtgataacaggctttaatccttttaaagcatgctgtgggatgggatattggcgttgagcagggtaagggtgattcgattttaacgggatggtaatgggcatgtgatcggttgccagggaaggagtagagatgtcccatatttgtgggttaaggtggggggatatgagaggaagatgcaaaggaggctttgggctggggagaagggtggcaatgagatgcagctgtagtccaggaatagtcagggaagcagataatttggttaaaatatctcggcctaataagggaactgggcaggtggggataactaaaaaagagtgcataagagtgttgtccaagttggcaccagagtgggggagttttcaggggttttgaagcttggccgtcaatacccacaacagttatggaggcaagggaaacaggcccttgaaaagaaggtaatgtggagtgggtagcctccgtattgattaagaaggggacggacttatcttccactgtgagagttacccaaagctcggcgtccgtgatggtctacagggcttctgaggcgatcgggcagcatgagtcttcaaccgctaagccgagaaggagtcagtcagagagccttgggccagagttccaggggctccgggagtggctgccaggtgagttgaacagtccggtttccagtggggtcccacacagatgggacacggcttaggaggaatcctgggctgcaggcattccttggcctggtggtcagatttctggcacttgtagcaagctcctgggggaggaggttctggaggaacgcctggccgctgcggttcaggcgtttggaagttcttgtgtgctggagatgtggctgggatttgtctcacagtggaggcaaggaattgcaacttttttctattattgtacaccttgaacgcgaggttaattaaatcctgttgtggggtttgagggccggaatttaatttttggagttttatttaatgtcgggagcagattgggtaataaaatgtatattgagaataagatggccttttgaccttttagtttctagggctgtaaagcatctcagggttgctgctgaacgagccatgaactgggctgggtttttatatttgatgaaaaagagcctaaacgcttctgatttgggataaagaaaaaggagcatgaaccttgactatgcctttggctccagccacctttttaagagtaaattgctgggcaggtgggggagggctagtcacagaacgaaactgtaagccggaccaggtgtgaggaggggaggcgataaaaagattacagggtggaggagcggaggctgaggaagaattgggacctagcttggactggcgaggaggggagaggtcagatgggtctgtagaaaaggaagattagaaacacttggtgatgcttggggttgggactgaggtgacaggcgggagggaaagaaggaagatttgggacgagttgcactgggcacagagactaggaagggactgatgtgtaaaagaatgcctggatgtcaggcacctcagaccatttgacccttttacgacaaggattatttagatcttgtaggatggaaaaattcaaagtgccattttccggctatttggaactactgtcgagtttgtattggggccaagcggtgttgcagaagaaaataaggtgtttaggttttaggtgaggtgtaagttgaagaggttttaagttcttgagcacacaggctaagggagaagagggaggaatggagggtggaaggttgcctatattgaaggaagcaaacccagagaaaagagaacgtagagacatgaagggaaggggtttgggggttctttccccctagaaaagcgggacttgccactaagggtgaaggagaaggggttgaggggtacttgcccctgccccaggaaagcagagaaggggtagagacaaggagagaaggggttggggtacttggccattccccaggaaagcagagaaggggtagagacaaggagagaaggggttggggtaattgccctttccccagaaaagtgggacttgccgctaagggtgaaggaccaaggcaggcgtccctgcgtggtctgacacccttgaaacgtgggtgtataatcagagaggcgtccctgcaatgattaaacaccaagggaagacttccttcccagtccgtgaccggcgccggagttttgggtccacggataaaacgtgtctcttttgtctctaccagaaaatgaaaggaattgaaattaagagaagggagagattgaagtgtagcaccaagattgaaaggagaaagaggttgacggatagtgaaggaagttggagaagagagtaaagagaggccgcttaccggatttgaaattggtgagatgtttcttgggctggtctgtctgaggacctgaggtcgtaggtggatctttctcatggagcaaagagcagaaggaggggggattgatctcccaagggaggtcccccgatccaagtcacggcaccaaatttcatgcgcgtccatgtgaagagaccaccaaacaggctttgtgtgagcaacatggctgtttatttcacctgggtgcaggtgggctgagtccgaaaagagagtcagcatagggagataagggtggggccgttttataggacttgggaaggtaatggaaaattacaatcaaagggggttgttctctggtgggcaggggtggatctcacaaagtacattctcaagtgtggggagaattacaaagaaccttcttaagggtgggggagattacaaagtacattgatcagttagggtggggcaggaacaaatcacaatggtggaatgtcatcagttaaggctgtttttacttcttttgtggatcttcagttactttaggccatatggatgtatatgtgcaagtcacaggggatgcgatggcctggcctgggctcagaggcctgacaatacctttatcaattggttactatttcaatgccccctttaaaatttgctatgcaaatgagtatatgcttgtacttgacttccatatttgtgctaaagtgagcaaagttatctatataaagaaaacacaatgagttgtgacaaggatgacgtgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctttgcggaactatctgtctgttttgcttccttgtgctctttttgttctctgttctcctgttaatgaagcttttcctgcccattattaatccaaactcttgggccttgtggttaggaaattcccttaacttccagccatgtggcattatcatgtctctttctctctctcgctctctctcctctcctcctccccccaacattttctgtcaaataagtactgtttactcatttagttgcttatcaaatacttattcttggttttaaaaaaattattggtaactgtacttttcttattttttagcattattcaaatgtttacattttaatactttaaaccactttaaaattttttcatgtttaattgtagttttaagaaaaactattttgaacaaccccaaatatagtgcatctagaaactaatgtatatttgagtagacatcacttatagtggaacagtagactgtagtacatggtaattttccttttactcttaagatacaataaaacatgactaattttcctgtcaaaaatgtaaagaataacaataaatgaagtttttatattttacttttaagattgcctgtctttactaagacaaagccttaagccttatgttataattttggttctaaaaatcatcatttcagtatgaggaatgagtatatttcgtcctcctctttagttttcttcttcctatttatttttattttgagaaatttctacaccttctttgaattccttgtatgaatttttgtttcctagaagttaatttgtgtgaaatgagattcttcaaaacgatgaaacctcgtagctctgagaaaaggttttagggttttaaattctaagcaaaccatgactatggctgactgactacacatttaattatacagcttctctttcttaaccacaggcagattaacctcattgtggattgtccttcagaccttagtcctcaggcatggtttctggtgcccattcctggaagccgctgttccctttctaccttcttaccagagcccaagggcaggcctggtctcgaggaagcagcagcttgctgacatgagtcagctgcaaaggctgaggagtgtgccctcagagaagcagcgccccccagtcctgccccagtgcccagagccgcagctcctagggatgctccttccctggaggcggcccaggagagggactctggcagcgttcttcagatttgtgaccactgtttctcatttgctggttgactatttttatttcttaggcttttgctagttttagaaaataggaaagcagcccgtgatttgtggattaaaagcaacatttgagcgatgatgcacaacagtccaggaaaatgggcagtgacacttgaggctgaggatgggagtcgacatgagcagggagagggaggtgcgcgctgcttatctgtgattgttgctcacctgagtgtggctgattgtgtacatccagcagctacaatttttaaaaattatatttttacatttattttatatttttctcacccccagtaatttccttccaaataagttcacatgtaataagtagaaattctgtacaggaaaaaagcattaaaaatactattataactgcttcatttgctgggaaccattacaagtagtataaattagctttttccagaaggatcctcttgtagcagggtttatgaatgtaacccccagcaaaatgtgactatatattaggagagccagtttggagcagaggcctgaaggtccctgctatgcagccgtggccacagctcacagcaccagtgctgtggagcatccacacctttgatggcaatgcagagtgatagcaggttccataggtgtgacaaaacagcattaaagctcagtattttgcatatttttagcatttaaaaatatttttgctttagtgtgaggaaagtaaggatgggcaaagaggcgatcaaaatagctattgctatgacattttagaaaacaaagttggggccgtatttctttaaaaagataagcctctaaaaatgcttggcaaaaaaactatagtgttaaaataggccagtgatattaatgagaaaatgaaagtatatatcaggaataaagtgatattgcataggagtattgtatttttatgaattttgtgccagttgtttacatgtactatatatgttaaataaaaaaatcatgaaaaatgagggaaatgtttttcttgattgttattttcatttccaccttgactgtgatcaagttcggcctcgttttgtagtcagatagccatgaactggtttgagtcagatggcagtcctgagaagagagggagggatcataacagtgggggtagactctggtcttgttgttggtagtggtaggcactgagattatccgaacttttcctgtatttatggtagagtcacttacattcctttatccttttcatcaagggacacagtaattcattcaaactatatattgggaataattaaagggttgctaaaagctgctttaatgtatttaaaaaatacgttggtatcaacattttctaaattgtagctcaatgtttttacttgatacaaacatcaacttcttggttctttctctatgtaggaaagacatttcagctctcttcattcctgtgtaattactttcttaacacaatgacaccttgattctgacatctttggggaatgaggtgttctaatacagtttaaaagtagctcctcttttaattagcaggcatcagcatcacctggaaggcctgtagattgctgggccccaccacagaggtttctgtttcagttggcctatggtggggccccagaacttggatttcttaacagttctcaggtggtgttgaggctgttcgtccagggacgatacttgagagcctctgctctaatcggtgggtacagactggctggatgactggcctccagggggcgctccattcctcacagcaatcccaccagagctggttgatggacactctaccaggagctgaattttaccacgtaccttctttgcctgttagggggcactgcttcaatgaaacttgcaaggagcaaagaacagattaggaaatttttaatcggaacactgatatgaattatagattatttacatattttgaagctgcaaactgcacctcgtttcttttcagttcagagatggaaaaggagtgaaaatccttgaaatagaacttccttttgtaggattactttgtctagaagacaatacataaattcaatgatgtgtggggattgcaaaaattcattttccactttattacttttgttttggcaccacaaatccgaatcttcttcctttattagaagtcagccaataatcagcgctaggtcacagattgcttgcttctttcttcttcctcctttttctcctgcccccaactagaagtttctaatttgaatcaacaaaattgttctcaatgcagaaaaagaggagctacttttaaacttcattacattcctgaattggtctttatttcacagcatcgttatcaggacgaatacattttacattagaaattgaaaaggatattaaggtacaaaaaggtcttgaaaactttccttttacatttcctcccgtgagagagattttaaaattctgaatgaatatataagaattgaagactcgatttgattgtagtgtaattaagagatagttttcctttttttcaaagagattaggataacattgatactggatccactttcaaagcaatgttttctatagttttctatactcagttatctttaacccaaaactctaaataagtatgcacagtgttgtcaaaatgactttcaaataaatggtagcactacatggtattctgcttcataggcatgttcttttaaatgcagcataatatcatttcgttgatttttttaagtatctggtgggcctttttcctgtaggcaaatttaatatcttggcggggggagttgaattttgcagacttcagctcgtttggttgttatgctgattactctgatacccttagtccttatgcatttctgaaaaaatagaaatgaaaatacgaaatggccactgctaagtagatttggcataatgtcatgaaaactgggaaagaaagatgcctgcaggccacctctggctctgccccctgctgctgatatcctgctctttggccaggctcctcaagtcttcactctggtatccgcttagtgaacagacttcagattcggaggcctcgctcttgctctggaaaattctcttcccagaagagtacaatttggtaatcccttgagccctttacataggtaacaaatttgacctttttgaacagacttatatggcagtaattctcaaacttatctgcacattaaaattacttggggagcttcaaaaaatcctgaagcctttttcccacccctagagatgtgtggcctgagatttagaattttttttaatccccagtgattctagtgccctagggctaacattttagaacttgccctccctacttcacctctgaataacaagatttccacatctccacccagtcaaagtaggaatggcaagcgtctgtcatgtacactttattaattgtgattattaatttctacattatttctaatcatggcacctagtgttgagtagactcttcaggaaagaattctgtcttcagttatggatgctgccaatggcagggagaagggggagagtggcagtgcaggtgccacatatttgtaaaccctgattagagtgtcaagaagaaatgggaatatagcagcaaaaagaaaaaatacaaatcactttgaaaatttattgtgtgaggaatcatgtgtcttctctgcagatgctttttgcccctcctggaatatgcttttcttagtatgtatttcagatacaactcaaatgtcacctcttctgtgaggtctttcctgactgcctgccatttggttgagtgcattgcctcccactgcccacgtgcccataactcccacgcacacatttatcaacatgacttttcccccactctattgtgttcttcataaaaagaacatgtcttactccattctgaatccacagtgcctcttagcacagttcctggaaagtagtactgcttaatgatgttttgaaataaaccatactttattcaacaatgcagtaaattgcagatggcaataaaagttgtttttaggactaaaagacagtttatgttttccagccatggaaaagaaataacaaggaaatgcaggacatcatcagatgaggtaaatatcataggggaaaatatccgtgtcaaacagctaaacaataattaacctcatagcatatccttggtaggtactttcagacatggctagtgaccatatgaatttattggaaggcaatatgataaagacacatacatctgtccaggggcgggactcattgactgatttcagtgtgtggctcaggatactgtggtgaccagccatagacacatttgctgctgaacagggagcaaggaactctggtaatttgattaaaagtctgggaagagggattttccaaaggatgagaagggactgatgtgttattattgggtgtagatattagggaaaacagatgacaacagttgcacaattaatattgtcataatagagacaactacgctggaatccataatccatcctttacaaacttagtgaaatagggcatgtttcttgaacatcagtttcttttaaaagaatatggcttttaggatagtaattagaaacaagaaatagacaaaggaacaatcacagcaggaaattttaatatacctctccttagaaattgagataataagcaaaaagatcagtaaggaaatgcatgatttgagtaataaaagcaacttgatttaacagtcatatgtagaactgcacccaacaagtgaagagtatacattctattcaggtatatgggacatttccaagaattgacagtagaacatgagctcctgaccaggcacagtggctcatgcctctaatcctagcactttgggaggcagaggcaggcagatctcttgagcccaggagtttgagaccaaccagggcaacatgacaaaaccctgtctctacaaaaaattagccagggtggtatgtgcctgtattgccagctacttgggaagttgaggtgagaggatcacttgagcccaggaggttgaggctgcaatgagccatgattgtaccactgcactatggcctgggtgacagagtgagacccctgcctccaaaaaaaacaaaaaacttgaacatgagctccaagaaagcatgactttttggcctattttgtttacagatgtaacctaagcatctagaacagtacctgacacatgtgggtgcccaatatttgttaaaggaaagaattgatcatacctggagccaaatggcaattctttgggggggaaaaaacaatcttaaggattgaaaatcctttagttggaaatcagcacaaatgaaacagttttaaatattaattcataatttatgatgaaaatttgagaaaaaatagaacaattatatgctacaaattgtgtgtggaatatgactaaagcagttctagagttttttttttggcctttagcctaaaatgcattcattaagccaaaaatcaataaatatctgtatcaggaatataaataacagaatagttcccccaccccaatttgaagggaataatgagcagaaattgatgaaacagaaaacagatcaacaaagtcaaagttggtgtattagtcctttttcacactgctgataaagacatacttgagactgcgcaatttacaaaagaggtataatggacttaagttccacatggctggggaggcctcacaatcatggccgaaggcaaggaggaggaagtcacatcttacgtggatgtcagcagacagagagcttgtgcagggaaactccaccttataaaaccatcagatctcatgagacttattcactatcacgagaacagcatgggaaagacctgcctccatgattcaattactgcccaccagggtccctctcacaacatgtgggaattcaagatgagatttgggtgaggacacagccaaaccatatcagttggttatttgaaaccttaatcaggagataagagagaaggtgtaaaagataaggaatggcaaattacagaagctgcagagagtaaacaggtaatggggatattataaacaaactttgtcaataaatttggacactttgataaaatgtctaaatttctagaaaaaacagagctgaaccaagaagaaatagaaattagaaataacagtcatcccccagaaagaagttggattaacaactttttaaaatcttcccttgaagaaaacaacatatccagtgttataagctattcctaccaaacattcaagatatggattattccagtcttacacaaacatccaaaaaatagcaaataaactcagttctttagatgactgcaacattaataccaagagcacagtagggtcaatgcaataaaggaaaattgcatgtctattgcaatcattaataaaaatgtaaacaagaacctagcaataaagttaacaagatataaaaatatcagttctcaaatttatctaaagttttaatcaaaatttcagtaagactttttatggagcccgacaaacaatgtaaaatttttataggtaaagaataatcaagataagtcagaagaacataagataagggcatttttcctataagatgtcaaggtttattacaagacctgtagaagtattggcacaggaatattttaaaaattgactaatagagcagaatagatggcttgggagcaagtgtgcatacatttaataaatgaggctgtgataattgattatccatatcaaaaacaatggtattgagtccctacttcacattatacacaaaaataaaactccccagatgaatcaaatatctaaacatgaaaagcaatattgtaaaacttagaagacaatataggataatatctttaccttctcaaggagatttccttaaagaaggacttcctgagacccaaaaaacactacctgtaaaagatcaataaattcactgttatggttaataacttctgttcactacaagatatcaaaaagagaatgaggtaagccacgatgcattcaagatatttgcaacttgagtacctgacaaaagattagagaatagagaactgcaaacagtaagaaaatgcaaagaatcctttagaaaaactccaaagacacggacatttcaccaaaaaagaaatacaaacagctcataaacattaaaaaaaaacccaacctattcataattagggaaatgcaaaatgaaacaatatttataatttataacattggcaaaatttttaagtattgagaaacgtggaacatcatgaactctcctttactcccagtggagggtaactactttggaaataaatggcattacctaataaatacaacccagcatctccactccttagatacataccccagaaaaattcctacgtgtatgcaccaggagcatgtttaacatgctcacagctgcattgttcaaaaaagcagaaaacccagaaatcacttgaatgtgtgtctggagtaaatagtagagaggataaagacattgagtataatcatccagtatgatcctatcaaatatgtaaaatggtaaaatagcaataggcaacagcatggatgactcaggaagatgttgagcaaaaatatgtgtatataatttgcagaaaaatacatgtgatgtgagttcgtttatagtgtcttatttatgaggccagcagtggctatgtaggataataaaaccacagattattagaagaaagtgtttgctgacaaaattgaagccaatatcttcttttttacaaatgaagaaactgaggctctgggaggggaagagattttcccaagctcacactaatatttagtagtacagctgaaattaaaaaattggtccctgggtcctaaccaagaaaccgcattcaccatgggcttggggatatactgaatctgctcaacacttagctgtgtgaaccagcacaagtcaattacgttcttgaaatcacattgcctcctgagtgaaatgtgtacaagaaataatgagaatctcatatggctgttaggacatttgcattgaagtactgtatgcaaaagtttatagtccaaatgtaatgaatcctggttctttacatcctacccatgatagcagcagacggggaggaggctgaaatggtatggtgtcatcagccgaacacacacccaggcaggaaagcaccatactccaatgacagataaagagcccaggacttctctgggtatgcttacacacaggagggcatataggtgtttctagttaagtgtctttatgccccttgacttttgcttttgatactcatgctgaatttatttctggttccagatgactagacattcactttgcaaataattgttgtggctctatgtttgctccagacacagagcttttattatcacccaaagacccctatgggaaccaaaagaatcaagctgaaccaagatttctgccagaatcagtttcctgaagccaggaggctttatcatgttgtgcaaaggactttttttttttttttttaagaaaaacagactcctttattgatttctccctttaccccgcctctccttgccccttattttgccctgactttgggatctcaccctgcgtggaaaaggattggagggcattcctactttagggggcaatatgtgactccatctctcagctctgactcaggacctttggcttggccctaagcagaggtgtgggaggctggggctctctgatgcccacacagggtcattgggaggttggctgaaggataccaagcagattgctgccccaaaatatgactcccttgcctatccaggtgtctataaacccatcattagaaagacagtctttaagactcatttccagtacttctgaaaaagaaagcaaattctcctgaaagcataacacactaagcccctctcaatcagcagtagagagaggctgggccaacggaaaggtcaaagtcatgagccaggtgcacccagcttctaattctagcttggccatttactatctgaaatcctgaacttctgcgagcctcagtttcctcatcggaacgtatggaatcaatactacttagcttgcagtgttgttgtgagaggcagcgacaagaaacccaatgcaatgctcaacactcacatcaatgggatcctatacatagacaccattattgtcaacacctttgtggaaagcctccccttaaggaggctgaatggagaaggcacagcattcttcttaatagatgtccactttgatgtgggtctaatgttagggggtgatgtcaggactctggacacactgcattctgaagcagcaaacaggcagcaaaaagatagttgagccaatgggacaggagcagcctctgtcctggccaagaactgtcactcagctctccacaaaccaggagcactatcccacccaggatgacttctgggcaaggcaaggcctccacgggtccccagaggaacacgtggcatatgtgagactcgagtcagactggagtgcatgttaaggcagggaagaggagtgatgtgaaaggaaagggttgacaggtagagccttcaataagatgtggcatgccttcactggagaagccaggaggatttctgactaccatctcacaggaagagaatgtagaccaaggaccatgaagggaactttgtaggattatggaaacttcatcatgtccttctgatgtatttctgtgctttgctgaagggttcagtgatttgcccaaagttattcgaatcaccccataaggggcagaagcatgtctcaaaccctctggtggagctttcatctcttggggagagaaaatctaggtttcatttgaagaactgccatttagactgcttggctggggaagaacaagacagtactcagctgaacagcttgctgaggaatatgggctgggagaagagcttggaaaaatgcgtggcagcctgatgtcacctatgagggtcaagaggtgagcagggcagcggggctgaaacactgagaagagagcagcccagactcagactcctcagactgggaaccaggggagactaaaaatcagggaagaatgggaaactggccagagaggaaatgctgtttacatccaggccggagttccaggcctgggaaggcaaagaagccctagggcagtggaatccaatagacctttctgcaacaatggcagcgttctacaactgtgctgtcagtaaagtgggcacaagccacaagttcttatcaaacccttgaaatgtggctagtgtgatcgagaaatacttttaattttatttaaattcaattaatttaaatttaagtttaaatagccacatgtggctagtggctaccacatgggacagtacagccctaaagagtcaggctgtttaaattttgcaacagcagaggacccttgaattgattatatttgatagagtaagggtggacagctcctgagactcaagttcaggcagggaggtctggaccaattgagatggacgtctgtgctggaaattctaagaactgacccacattagctggagaaagaagccattgttccctcccatgcctccctgcttcagcctttgctttcactgaagacttggcacttggcatctctcactcattggtcaggtgacaggtgttacctgcccagtaactagtccttaccccctcttccttccactcagctgggaatcctcctctgtgctcccctagcacctgcaatgcctcacttctagtcccctctttatttatctgcttgactagctctacgctgcacatagcaggtcctcagtgagagtttacttagggctgacaggggtcacatgatagagcatcacattcttgctatatgacctcaggcaaattaacttttgagctagctggggaatattcttcatgacagaactagtaggacttcgtttcacatctgtgttccaatttaacatactcagattgagcacctgctgcatgtcaggcaccaggcattatagaatgagtaaatcagactccctaccatcaaggagatccacagttaagttcaaggacatacaagttttatcaaaagcagactggttaagagcacgtgtcttggagtgggtccgagcagggtaggcagcctggctttgccatgctctagaggcaaaggctgagtgatcttaggtgatgaattcactttctcaagttctgtttctgtgtctgtaaaatagcatcatgattctgtccggcccaggtgtgaggtttaaatgagatcttatttttcttaccaagttactgccagctctcagtgcttaatcttccatttaatataacaataaaaacagctggggatcctgacacaggtgcacggctcactcttgctggcctttgatcacagcagcagcatctttcctatggctgttctctcctcctcaccctgcaccgcaggcagcctgttttcctttaagccctccaaacactgccaactcaagacgcagcatgtcacagacttgcactgaggtttgggacaactggaagcactgggtcacagttactgccatcatgttgtcatttctgccacaaggaatttcttgctgactatgcttcttcccgggcccctgcccactgcccttctgtggggcactgtctcttgctccccctcgctttcattcctccactgctcaagagaccccacccccacttccagtcactggaagccacttctggccaaatcctagattcctctgcattatgcaggacaatttatttcctttttgtcttactttcttatctaggttatctgttcctaggaggcttcctgttcataatcaaatgtgtcaattcagttgtttttcccagtcagaaaatcagaactctttttaaagattgattcactgaccatcaagcttaagtagcaggcagcttcagaaaataacatttcctcacccccttccctttccttaatcccaaagccaggaacaaatgagcaaatctgtgggctgggtgggtctgattactaaccatttttaatactgcaaacccctggggttttctttttgtgcatttcttaccaggtgccatccggaatcatttcttactgttcctctttgcttttcattgagaatagaaataattcacccacacatatggagataaaatagtcttttggaggggagaggggagaaagtgaatcttctgtcaaaatagtctgggccccacatctgcccctttcactcagcctttgctgaaagtgggcctggctgggtggggtagccgggggctctgctcagcgcagcgtctgtcactcccagcagagccagggctgtcttcagagctggagcagagaagtgactaagtgatgacagagaaatagctgccaattccaagtagaactgccacctctgaggaggcacagcattgtcttttcagatggcattttcacaatgagctagctgcagagcctgaggacccgattggattcttgtccaaatgcccaggcatccactaattcacagagttgcagagttttacgctaggaagaaacaatcaaacttgatagtgaagggcaaagttgtaggccgtgagcttgatttggagagatagaaaattcctaatgaaaatttaaagaataccaagatttctgggtgaatgctgaggaaagaagagtagtcttattctagagacttcagtattagctgctgctctgacactaacatcctgtgtgatcttggacaagttccttacttctctgggcttaagttttctctcttataaagtgaggacataggatgagattaataattttcaaattgtgttccaaggatcttgtagataatatgttgggaaaatcctgggatctataacatagaatagtttggtaatgactttctcagaaactttaatgtgctaatatgcaccctgactttccagaacaaagttaaagtgcaagttttcataagcaactaaaaagattctaatggaaaaggtggcatccaagccactgtgtccttattgacacaaatgatgcttgttttggacatctggctacacagttcagggaggtggggagaagctaaaggaggtggaaagaggaacagcacaagtcttgaagatgcagaaagtgagtcccgtgagaagagaaaaatcaatagtaaaatgatgttaaattaaaaggaaagatgagtaaaaggcattggattgatctccatttatataaaggactttaatgaagaattggagaccatggaggaccaggtgagaaagagtgacttaaaatttaaatatttaatagtaagaaaaaaatgtccatattagctcatgttattaccattcccagtgctcttcattcctatgtgtgaatacagatttccatttggtatcattttcattctgcctgaaggacttccttgaacatttcttagagtgagtgtctagcggtgatgaagtctttcagctatcatgactgaaaatgtctttattttgcccttactttgggatatacttttactggtcataaactctaggtttacagttttttctcagtgctttaaaaatgtttctcactgtccttctactttcactgttttcaaggagaactctgctgtaattctcgtctttgtttctctgtgtgtaatacattgttattctctggatgctttcaggatttgccccttttcactggttttaaacaatctgattgtatgtgtcttggtacagttttatgtttcattgagcttctttgatccatagatacacagttttcatcaaatttggcaaattttcagttattctttcttaaaatatgttttctgtccacacctctctctccactgtctcttggaggctccaactgcataggtatcatgctcttataattgccctgcagctcactgatgcttctttcattttggggggaacaagaggagggatcctttttactttcattgtttcactttgaatagtttccattgctatgcctttcagtttagtaatctttactttagaaatttctaatctgctgtggatgccatccagagtattttttatctaagccatgatcgttttcatttcctcaaatttcatttggatcttttaaaaatgtcttctatgtctctactcaactttgtgaacatactgtagtacagttacaacaaacacgttaatgtccttttctgcctgctccatcatcagtgtcagtttctattgattgactattctcattctgggtcatattttttagcttctttgcattgcacatttgacaacctttgattaaatgtcagacattgtgaattgtaccctgcttggtgctgattatttttatatctctgtaaatatctttgaactttattctgggaagcagtcaagttgctctgaaacagtctggtccttttgggtcttgagtttgtcattgtttaggtgggtccagagcactgctcagtctagggctatgtattccctaccactgaggcatgactttcctgagtactccaccagtctaccacaaattatgtttttttccagtctggctggttagaacaggcactattcactatcctgtgtgtgccctggacactgttctctgatccttccaggtggttttccctcagcctcaggtcatttccttaaaaatatatgctaatctgtgctttgctgaatacttgaaaaggaacctccacagatcactctctgtgcagttcttgcctttttggtactctgtcttgcaaactctacctctcttcatctttctagactctcagctatgtttcctgacttcaaggaatctgtcaagttctatccaggcttttcctcctgatgctataggctgtgaactctctgaaaaaggtattaagggacaatgacagggctcatctcattagtttagtcatctcaggaatcactgtatttgttgcctaatatctagtaacttgaaaacatttatttcatatactttgtctgtttttcttggttatttcagtaagaacatatatacaacatatattcagttcttgttactctatatctggtggaaatagaagttcttaactttatattttagcagaaagtttaagttaaatgtaattttgtttttgctaccacttattataaaaacaaaaatcattgaattgagagacccaggaatagtgtagggtcctcatgtttggagatcttaaccaaggggacagatggcattagttaagggggcttatttattaaaaattccttctgatgtatgtgacagaaaatgaatccaaaccttcagcaaacacacacacacacacacacacacacacacaactttttggcttaatactcttctgggaagtccaaggagctgagctgagccaagcagatctatcactcaaagtttgaatgacagttccaaacacacatgttctgttgacttgtgagccaagataaagagaacaatcctcttctcaacagaaatagtctgattatccctgtttgagtcatgtgaacacttctggattaattagtttccagagaaataaatatttcagttactctgagagtttagtttaatttggaattttttctctagcctctctgaattccctgactccccacctatctccatgattgacagtctcgttagaatctcatgcagtcggggagggaccctggctggtcaaaaatttacctgtgaaacagcagggagctatatcagatgatctggcaaaatttccacctactctaaaaactttagttctaaggatcaaaatgttattaaaaggatttgaaaaatatcaactatagggcttcaaacaatgcattataaattgattctcaagaatcatttcttaagtctttattgtttttctaatttttaaagtaaaacatgcttactattaaaattttggacaattgagaaaatctcactactcagagaagaccccaataacatttcagtgtatgtctgaattaataaataacttgatttatttgaattcaaagaaagaagaccttaataaagactgtaagctctctttatcttacatgcttataggtggagttgaacaccaaatcctggcatttatgcccccagtaaaaatgagcagatttttccattaattatggcatatgtgcacttgtgaaggtcttatgcctctaattacttgctaatgtctgctctgccctgtgcactactcaataagatgcacatcattcaggtccagtcattgctgctgtattctgttgcatccaagcttcaatataatttgcattttattttgatgtatttcagaagaatcttatatacatgcaggagtggtgaggtatgtgttgaatgaaacccatggttaattttgtgttgattctacttatccaattcctgcattcatccttcatttactcatgtattcaattaccttttatggaattcatactatgtttcagggacttacagggtagttgagaagtaaatgtgaacaaaatagacataatttatttctgctcatagcttgacatttagtggaaaatatggaaaaaataaacaagtcaatgaaataattacaagtgctatgaaggaagcagagtgctgagacttacagaatttagacaaggcaaggttcttctctgctttaaaccttccagagctccccatgggctgtgcaatgcagttccaagtccttagcatggcattcaaggctctttaaaacatcacatcttgcctgatgttcccggccactgatgctctcaatactccaggcacaactaattactggccactccctggacatgtgtgttgtgccaaggagctcagatattgacctgtcagtgataggagtggttctaagcatggtggtgacacattctcatccaatgtacactgtggatggtaattctgcagtctgtaagagggcctggtcagggagagacacgagaacctgttagaaagcatcaatagggcttcagcaagaggatggcgtggcctgacatgtgagtgggaagcacagatctatgagatactgaagtgatccattctttaagacttggtcatggattggctgtgagggcgaggaaaaggggatagcaaatgacttccagctcctagccttgaacaggttggtgagctgcagactgaggcagtaaaagtcacagaaaagtggtcttaacgtagtaacactcctttaatcaacatatacattcttccagagaaaagtaagaaatagtttttttcctctgggactggttagaatcttacgagaaaagtatccagacttcttgccagtggtgcttgcacatcaaagggcgtggcgagaggattatgttacgagcctctcatctgggggttcacaactgtgatctgcaggctgcaacttgcttctaaacagagctaatttttcttgcatttttcaactgggaagttctccacagaattcctacttttcatatttgaaaaatcaagatgatttgctaatattctgacatgacaacaactggctaaaattgaggggtgaccttctccttccgaaggcatctgcacctttggttcaccacaaacctcaccactccctaatgtctatctcgactgcagactgagtcctcagtgactgccatgttgcagggcccctgtgcgataagtgcagggacatggaagtctgagaccacagagcacatgggtgatcacggctgtaaacacacaatccatcttccctaattgccaaggaggcttgaatttcctccaaggtgctccaccagctgcctttcccctggtagtgctcccaggccatagctgctctccccacccagtgtatgctggtgtcttggttggattgaactcaacactgcaccctgtaccaaggagtcctgcaggttaactgcagcctatcaactatttaagcactattaacagtaatattttccatattaacaggaacaagtatcaaccactcattatattctaggcactcttccaagggctttgcatgtatacaggactccttgaatgaacctggggtagacacattattcccatcttatagatgtggaaacacacagagaagtaccttatgcaaggttacatggtgtgtgattagcgagaaagaggatgctagattaaacccttggcagtactgaagtatctcttgacgtgtactattgtttttaaatacaatactgttatttttaaataaaaattattcctgttttactaatttttcaagtttagtgatgcatacttgaaatcttccaatggtcacatcaatctgaaatcactgattaattctaaatggtgtgccatatggagctttcctgtcctgtgtctttgtgcacgtgtttctctcacaagaattgtggttccctcctcctcctcctcccatgcaagtcctgagtcacatgtcctctgttctgggcagcttctggtagcaatttgcatatgcctttacagttgacatggccacattttctgagatggtcttgattttaaatatttggccccactgttatactttctcataccttggagccagattgtggatccttgattcagaatatgtgactgacatatttatagccctttccatctctattgagttggaacactcagtgggagtggggggaagatgctgaagagtgactttcccatctcttgccttggctcctctgcccaccacattcatgatgatgttgctcacggttctccccttgacacttgctttttcgtctttacctactctctgtgatcttaacggcctccatgctgttgactcccaaacatttgtgtattgcatctccctgagctttatagactcaactgtctgctgaacacatttgtatattccataagcttccccaaatcagtatgtcaaaaactgaattcataaactccctttattccccaaactggcttttattcctcatttttgctgcaaaatcaccatccacctaagtttctcccactgcattgtccccccaacatccaaccaatcaccagatcttgccacttttgcctcttgtgtatttctggcagctgtcacctctctcgcaccctatttctgtggtcctggttaggctcaggatccatggcctctcactggggccatgacagtggcctttcacttagggtcctgtgtggcaggctcctgcaggcttctccagactccaagtctacagtgcagatcttgccttctgtgccccagtggctttaagggggctgtctttactgtgttcccacttaaaagtgttcccacttttaaggctggtaattcccaccacacaccttgtttcagtgcctattcatttgctaattggtttccttatgttgatgtattagtttgctaatgctgctctaacaaaatgccacaaactgactggcttaaaacaatagatgtgtattcccaaacagttctggagagtaggattctgaaatcaaggtgtcagcagagctgtatgagtccattcttgcactgctataaagaaatacccgaaactgggtaattcataaagaaaaggtttaattggctcatggttccgttggctgttcaggaagcatagtggcttgggcttttgggaagacctcgggtaacttaaaatcacggaggaaggtgaaggggaagcaggcacgtcttacatggccagagcaggagcaagagagagaggtgggaggtaccacacacttttaaacaatgagatctcatgataactcactcactataccataacaaaggggatggctctaaatcattaatgagaactccacctccatgatccaatcacctcccaccagaccctacctccgaaactgggaattacaatgagacttgagatttggacagggtcatatccagaccatatgattctacccctgccccctcccaaattttatgtccttctcaaatttcaaaatacaatcatgccttcccaacagtcccctaaagtcttaacttattccaacattaactcaaaactccaaagtccaaagtgtcatctgagacaaggctagtcctttccatctatgctcctgtaaaataaaaaaacaaattagttactcccaagatacaatgtgggtacaggcattgggtaaatactcccaaaagggagaatgtggtcaaaataaaagggctacaggccccatgcaagtccaaaactcagcagggcagtcattaaacctcaaagctccaaaataatctcctttaaccccacgtctcacatccagggcacactggtgcaaggaatgggctcccaaggccttgggcagctccaaccccgtggcgttgcagagttcagcctctgctgctgctctcaagaactgatgttgagtgcctgcagcttttccaggtagagggtgcaacctgctggcgaatctatcattctggggtctggaggatggtggccctctgttcacagctccactaggtagtgccccactacccaactccacatttcttgtctgcactgccctagtagaggttctccatgaggctctgctcctggagcaggcttctgtctggacatccaggcttttccatacaacctctgaaatccaggcagaagttcccacacctcaattcttgcactgtgtgcacctgcaggcttaacactatgtgaatgcttctaaggcttattgcttgcaccctctagagcagctacctgagttataaatgggtccctttgagctacagctggagctggactggctgggatgcaggtagcagtgtctggaggctgtgttgggcagtggggccctggtcctggaccaaaaactatgcagtcctcccaggcctctgggcctgtgatgggaggggctgccacaatgctctctgaagtgccttcaaagccttctccccattgtcctatcagcacttggctcatcttatgcaaatttctgcatctagcttaaattcattcccaggaaagaggttctttttttgtaccacaaggccaggctgcaaattttccagttttacactctgcttcccttttaaatgtaagttccagtttcaggtcattacattgctcatgcatgtgagcacaggctgtttgaagcagttaggtcaccttgaatattttgttggttagaaattttttctgccagataccctaaatcatcactctcaagttcaaggtcccacagatccttagctctttgctaacacataacaaaagtgacattttctccagttgccaatatattcttcatctctgtctgagacctgggcctcattgtccatatgagtattttggtcacaaccattcagtaagtctctaggaagttcaaactttccctcatctttgtcctcttctgagctctctgtactcctccaacctctgcttattacccgattccaaggttgattccacattttcaggtatctttatagcaatgcaccactccaagtaccaattttctgtattagtctgttcttgcattgctataaagaaatacccaagactgggtaatttataagaaggtttaacggctcatagttctgcaggctgtacaagcagcatagtggcttctacttctgggcaggcctcaggaaacttataatcatggcagaaggcaaaggaaaagcaggcatgtcttacatggcaagagcaggaggaagagagtcgggaggtgccacacactttaaaaaaaaaaaaacagatcatgaccactctcccactataaaaccagtactaatgaggcatggtgctaaaccactcatgagaactctgccaccatgatccaatcacctcccaccaggccctacctccaacactgggaattacaatccgacatgattttgggtggggacacagagccaaaccgtatcaatggccatgctcatgttccagtttctgtggttgtaggcaatgcttggtgttccctggtgtgcagctacataactctaatttctgcctccatcatcacacagcaacttttcaaaaaaaaaaaaagaaaaaaaaagaaagaaaaagaaaagaaaaaagtagtaaggaagatagagttgtactcatgtaaggctcaggttttgtcagttataagttaatgacaacagggcaaaaggagtttaagatattgccatgatagtggcagaagtattaagatgacagatctgagctggatggagaggtaagtgaaaaggttactaatggaactactaatgagaattaaaaaactggcatattgggtttgactctcaaactttccaaagctcttcgtatttatctgctttaatccaacagttttatcaccaactatacagtgtgctgtgctacactgcagggggatgcagccgtaaataagacaatcaacactgatcattttgtagaaaagcatgaagactaataatattcatttatcttatcttttagagatggggtctcagtcttgtcacccaggatggagtgcagtggcacagtcaaggctcactccagccttgaccttccagggttaagtgattctcccactgcagcctccctagtagctgggactacacaccaccatgactagctaattttatttatttatttttttggtagagacagggtctccctatgttgcccaggctggtctcaaattcctgggctcaaacattcctcccacttaggcctcccaaagtgctgggattacaggcataagccaccccacctggccaaaactagtaatagtcaatagaatgatcagtacaattaataagatctaggtacaaggtagtaaaaatgtgagaaaggatacttttcacctcatggtaagacatggttatcaggaaacattctttaaaaactgccttaaatagctcttgagacagctgcaagtaaagttgggatgaagaaaccattctgagtagcatgaatagcataaaaaagcataaagcatagcgaaagcctaatcagaagataaggcttatggaaaaacaatgcaaggtagggctgtaaaggtaatttaaagccaaattagagagagccttaaatgtggtaaggaatctggacttcattcagtaggcagtggaggggcagttcaagtctataaacatgatcaatgatgtgctctaaaaagaaaccattttgtttggggtgaggttcaggcatcatctcaagcttctaaagatgatgatcagaatcagatgattctaacatgccagcagggtagaaagacactagcctaaggaaagcctatgcatatctctcaatcttcatcaaacaaaatttggaagaaaccacctattactagctaagtttgacctagcaaaatcaaaatttaaaaagcagaccattcccataacaaaagaaaaatagatattgaatatatacaatttatttaataaattaatgtcattcaaaatacagtgccagaacatggtgcagttgaacatgctagtaatgtttgtcatgaagcacctgtgctcatgttagattggcggcgccccactactgctagtggttcctgggattaatgccagagcagcgctagttatctgctcttctgcacagctagtgcagagaattcctgaacagttcaccttactaatcctaacccccacacgcacacaacaggttaaaaaaaacacaccctgacagctaacagatctatacacaatcactctacagtaatgcttgttattaaattaagatgtaatgacctggttaacccactctaaatcttgaagatggagaactacatcagcagcagatagttatatgcatgagccaatgttaacataatacagaaagtggaggctttttctgattaaagctccacgcagacccgcacaatgagtggctggcaattcttactgcaagcctagcaacttaagtccacacctggtaaatgaccagctgactggaagacctgtattctagatagacaagtataagttagtgaaaagagaatacatgcacctaatagtatagttagactgatcctgcagtcatagctttccctgtgtaataccataaaattatggaagatcttcctcaactagagtataggatttagacatttctataccaacacggacattagtgttaagtgcagttgaattaattacactgaaaactgtattccaggacttcagaacagaagcacgggaatgaaacacacatactaaaataacctcagcacaatttgtgatacatcacactaggaacaggaaactacttttataaatgaactttttgaactgtacatacacagggctaacaatgttagataatccagattcttatactctcatgattacacataaagtttctcaattattgaataatctatttcatattatggaagcatatctttctgtaagactcactgatatatattatactgatgcaaatattaagtagggcataaaaataaaatttatcaaagatagaattttatgtactcatatttagttctttcatagcctcttttgtttagcaaagaaaatgacaaagcacataactcaggcgtgcactccctgaacttccccactatacaggtggtagtgcaaccatttctccatccagttcaaactcttctgtcccatccgttgaaaaaagataagttggtggtttccatggagactcttcaaggcaggatggatagagtttccccacagtgcatcgaaaatctctccccaagtcccacagtacacgttcagatatatgctgccgcagagaccaccggtcaagttccaggtcatattggtaggtgacgtatttagctcgctcatttaagtgggtttctcgcataaacacacatagagaatttgagatcacaacagctctaacacaggggtcagagtacctcttagcagggatgttggctgccattttccactcatttttattcacatcataaatttccacagttactgaagacccatctacagtgccagaggggagtcttatgccggaattggtagcaatatgcaaccctccaatatagaaaattttatcaccaaaagctgcagctgaagcaaaggacctactagtctgtctcatggccatttctacccatgagtcagaccttggaaaataacagtacatgaggttcagtgtcatcacataaatgcagtcatgaaccacaactgctgcactccattgccaagcacaaggtaaagggcttaccatcgtccactcatctttctcagtgtcgtatctttctacggtcctccgattaagttctccacctacgctatctcctccaattgcatagatatagccttcacagcaaaccaaagatggctttatgcggacaaaaagcattggggtctttggaaaccaggtattttgctgtgcatcaaaccaataaaagcaattcacagttctgaaggcagtctgaagtttgcttgttttactgtgatttgtttttgtgtttttcagaggaacttgaccccctgctatgtagatatcattatcaggagttacaacggtcccaaccttatgcaaatcagctggtgggctacataacttgtaaactttttctgcttgggggctgtaacagacagaagagtaaagactacaaggattttctgaagatgcttcaatgaaaatcatcatttcctctttagtcatcccaagtcttggtttgaaaaacttgggcatggacttatacagaccttgaaccaccactgacttatcattgggtggcagaccttgaaaccaagctctctgtgttacttctgaaagtgcatcaattctgatttggctaagaacagaagacaaatactgggatcgtgattctgtgttatactctagccacagcatagcagcttctcgaacggtttcttccttttctacatttaaattgtcactactgagaatatctatcagtaggtcatgtgacagctgcatgaacgcgtcctgatgatacacagcagtgaacttgtgctccaccattcttttagcactctgttttaattcctcacaactgaagagatcagcaaaactcaacaatcgtacacaattctctgcatttatttttttaattaaatattctcgacaacgttgtaacacatcttctacctagaatgagaaggaaaaaaaaaacaggctgatagggccaggacagacacattttacttttatgtaagacgtaagtatattaatcagatgcccatagtgtaatttttattttcagatacacacatctgggctgagataaggtcttctggtagtaataaactcagaagactataaaattttgcagtattttttcctgctcagtggcctacttaactgttctatttaggaaccagcagtacaacaataaataggctcttaaaaaacaaaacagccttaaagaataggtaaggaaattcacacataagtcatactttcctagactttatatataattgagagaactatatgaaaaaatgtaaataaatcatagtatagagaaaattattgttgttgaataactggattctggtttcctcaatttgaacacagtcacataaaaccagaaaatcatgcacaatgagtaagagtagttatttgccattcttatcgagaggtaagataacaaagcaacacgaaatagacttacgtgcagttataaatcacctacatttaaatgacccatcttagccactgtaagcttcctagatttgttttttcttaagaaggtagatctcagttgaatcagatgtgctacccactatacttattcagcatcacagtgattaactagaaactgtttacactgacaagtcaggttgcttggatttaaaacttaattggccaattagtacctggaaactacttattaggaaagaagcttcacatctctaaacttcaattttctcttatataaaatggggaaataatagttatctccctcaaatgagccctgtaaggatcagatgagaatatatataaagtatcagtacaccatctggtactgaaacatatgatcacttcatgtggttgatagtgaaagtaatattggtagtcatagaatgccccatctcaggcttccagggcaacacagtctaagaggcagagtcctgttttgcatttgagcaagcagaagtagtatacggttttcgttaaaatggcagaaaaaaaatgttaaggagcagtgtcaatatttacagtaacaaagtattctggaatcagattttcttaaaattccttaatgccttagtaattctgagaaatgcctgcttttaaaagaaggaccaacaaaaaattagctggatgtgctggtgcatgcctataatcccagcactttgggattacagggaggaggattacttgagcccagcaatttgagactgcagtgagctatcaccatgccactgcatggtggcatgccactgcattccagcctgggcaacagaacaagacatgtctctaaaaataaaaagtaatgacaacttgcaaactatataaagacagtgcttccaataagcatttctcccgttcaagtttggaattactagtgcaccagcaagctaccccagcctcagtttccccagagttgtgggtagagtagaacactaacgataaagttagtgtaataaggagtaaaggttggccaggtgttgtaactcgcacctgtaatcctagcactttgggaggcctaggtgagaggagtgcctgagctcaagagtttgagactagcctgggcaacataagatcttgtctctacaaaaaaatcaaataattagccaagtgtggtgatgcatgtctacagacccagctactcaggaggctaaggctgggggatgacttgagcccagatcgaggctgcagtgagctgtgatctcaccactgtgctgcagcctggacaacagagcaagaccctgtcacacaaaaagttgagtatccctaattcaaaaattcaaaatccaaaatgctccaaaaactgaaatgttttgagtgctgacatgacacttgaaatactcacgggagcacttcagagtctagatttttagattagggatgatgtaaatctaacatataatgcaaatatcctaaaatctgaaaaaatctgaaactggctgaactggatttctggtcccaatcattttggataaagggtactcaacctatggaagattaaaaaggaaggagactacataaagcatgaactgagttctggtttccagaattatacccaggtgttggcattcaaccagtgtcatgcatactcattcagtgcatatttattaagtacttaacaaatatcacgaacagtgctctccaaatttaacctttgatctaaaggttctccctctgaagaaacttagtgaaatacagtgttattccaaaacaggagatgaaatgaagaaaaaaactcttatattcctcttaaaatttaaaaagggaacatgatggggaaataaagagtaaaacagtttgtcatacataaatatatcaaccatcacttgttttgtttaaatacttctccttaattgctcaatatggtcacatagccattataaatatttatcataatttccaccaagttttctgtgaaaaatagtaccatgaaaaattagtatatctaagctctaagcaaaaaaaaaaaaaaaaaaaattgaaacacttaaattcaataaacactgttaaaaattactttaatttggctgggagtggtggctcatgcctgtaatcccagcactttgggaggccaaggcgggtggatcatttgatggcaggagttccagaccggcctggccaatgtggtgaaaccccacctcaactaaaaatacaaaaattagctgggcatggtggtacatgcctgtaatcccagctattcaggaggctgaggcaggagaatcacttgaacccaggaggcagaggttgttgtgagccaagattgtgccagtgcactccagcctgggcaacaagagtgaaattccgtctcaaaaaaaaattactttaacttgaaatcaaaattctcaggtatattaggtagtaaaacacacgaaaccagtataaaattttcacctatctcttttattaacagatttacattcccatcacaaaactacttagtttactgggtaatcaaatcctattgtttttcccttacacattttgtaaaaagaaaaaaaccttttaccttctaaaacacgtaataagaaaattacatagataaaagacattactgggccaggcatggtggttcatacctgtaatcccagggctttgagaagccaatgcaggaggattgcttgagcctgggattttgagaccagcctgggcaacacagtgagatcgtgtctctacaaaaaataaaaatattggcccagggagtggtggctcatgcctgtaatcccagcactttgggaggccaaggtgggtggatcacgaggtcaggagatcgagaccattctggctaacaacggtgaaaccccatctctactaaaaatacaaaaaattagccgggggtggtggtaggcacctgtagtcccagctactcgggaggctgaggcaggagaatggcatgaacccagaggcggagcttgcatctgagctgagatcgcgccactagactccagcctgggtgacagaatgatactccgtctcaaaaaaataaataaataaaaataaataaataaataaataaataaaaatagtagctgggcatggtggtgcacacctttagtcatcccagctactcaggaggctgaagcaggaggatcacctgagcccatgagttcaaggcttcagtgaaccatgactgcaccaatgcactccagcctgggtgaccgaacgagaccccatctcaaaaacataaataaaaaatgtttaacaatgtttcctcacaaaataaaccacataataaaccaataagctacaactcatgtatgtaactgagtaaaaaaatgcttacctgtaggctggacacagtggctcacgcgtgtaatcccagcactttgggaggccaaggcaggtggatcacgaggtcaggagatcaagaccagcctgaccaacatggtgaaaccccgtactaaaaatacaaaaattagcacctgtaatcccagctactcaggaggctgaggcaggagaatcacttgaacctgggaggcggaggttgcagtgagcggagatcgtgccactgcactccagcctgggcaacagagagagactccgtctaaaaaaatatatatatgcttacctgtaggaagcaagctgtttcataaagctgttctacagtgctgtcattcattgccaagttacccgtgtatgcataagttattattatctgtaaggtggcagcatcgacattcctcaggtgtacatgggtttgtttgctttcacttagtccactcataaacatggccctacaggggagatgaagaaaacaaagttgtaagggttttgtgtaaaacaaatgtagagctgaaaagaacaattagacaataagaggtgtttatttagggtatttacttataagagaaactttttctttttttgagacagggtcttgctctgtcccccaggctggagtgcagtggtaccatcatggctcaccacagccttgaccttctgtgctcaaacgattctcctcagtctcccaagtagctgggactacaggcatgcaccaccacacccagctattttttcttttatttttagtagagacaaggcctccctatgttgcccaggctggtctccaactcctgagctcaagcaatctttcctgcctcagcctctgaaagtgctcggattacaggcatgagccactgtgcctagccaatgaaatttttgagggagacagataagaataaaatccagtcccaaatatataccagactattccaccatgccattttgagtgaaaatctcaaaattctattcacttcttatattcataccatgaaataatactcagcaataaaaaggaactaagtattaatatatactttaacataaatgaacctgaaaacattatgctcagtgaaagaagccacacacaaaaaaccacatagtatatgagtccgtttatataaaacgtctaaaaaaggaaaatatagagacagaaggtagattagtagttccttagaactgtaagaatggggtctgtgactataaatagacacaaagtgataaaagtgctctaaatttagattgtggaaatggttgtgtaactgtaaatatactaaaattcatttaattatatacttaaaatgggtagattttgtggtatgtaaattacatctcaataaagctgttaaaaattcatttactcaaacaattctctaaaaatatgcaggacactttcctaaaaatctattatatacaggaaatcatgatggaaaggcaactggcatcatggagaatactaagtagaatgcccatatataggtaagagaggaaaataggagagaaaagcttctgcatgtagcggtcaacagtgagtgtcacaacagtcactaacttgggcactaacttgggcccctcaaggacagagatgaagaagccattcaaaatggataaaacagggtagaacataagaagcaattgttcaaggggcatagcttgaacataagggctcatgcaggaaaccagaaaatgaattggaaagatggagagcagtcagatcacagagggcctttaaatgagacaagagagtctgagcttttccttgtagatagtggggaaaaccaaagggtttcaagtctgaatttagcatgacaaaatgtaagtgataaatgtaggatgaatactctaagctgacagactataagagctaaaggctagagacaggaaaactggctatcaggctatgacaataatatacctaagaggtaagaaactaagttatattggcagaaatgaatacaaaaaccactatagctgggcgcttggtggctcacacttgtaatcccagcattttgggaggccgaggtgggcagatcatcttaggccaggagctcgacactagcctggccaacatggtgaaaccctgtctccactaaaaaatacaaaaatttgctgggcgtggtggcaggtgcctgtaatcccaactactcaggaggctgaggcaggaaaatcacttgaacccgggaggcagaggttgcagtgagccaagatcgagccactgcactccaacccgggcaacaaaagtgaaactccacctcaaaaaggaacaaacaaacagacaaacaaaacccactataaagagccaataggatctggtgcttttctttttctttttttgagacagagtctcaccctgttgcccaggctggagtgcagtggtggtatctcagttcactgcaacacccaactcccaggttcaagcgattctcctacttcagcatcccgagtagctgggattacaggcgcccgccactacgccggctgattttttgtatttttagtagagatggggtttcaccgtgttagccaggatggtttcaatctcctgacctcgtgatccgcccgcctctgcctcccaaagtgctgggattacaggcatgtgccagcactcccgaccagaaacagcaaatacttaatttcataatattgtaacaggctgaagtaccacaacagaagtgctgagtaattctcaagcaattctctcattttgggtctaaaatgaactataaatgttaccaagaaatattaaaactattattcagaggtacctactaattattggtgggatagacagaactggtaactcaaactacaaaggaagaatgtatttagttcagaaggcaaaatctctacagtagatgtataggagcattagatgtaaagatctcgaaatctacaattctgccagcagaatctagttgaagaacacttgtgaaaagctcaaattatatcctgtggatatgaaactgtcccaggcacaagattttaatgatggatggcttcaaccccaaacacatattgaactatttttatttatttaataaatatctgatttgttttaggtataatacacagttgtcccttggtatctgtgggggactgattggttaacaaacttcccagacttggctgggtacagtggctcacacctgtaattccagcactttgggaggccgaggcgggtggatcacttgagatcaggagtttgagaccagcgtgggcaacatggtgaaaccccgtctctactaaaaatacaaaaaaaattagccgggcatggtggtgtgtgcctgtaatcccagctacttgtgaggctgaggcacaagaaccacttgaacctgggaggcagaggttgcagtgagtcgagatagcaccactgcactccagcctgggtgacagattgcgactgtctttaaaaaaaaaaaaaaaaaattgtaggcatagcaaaggcaacaactggtgtttgagccttagcttctgcaatcatcatgggatgtgttagggaatgtgaagtttcggtatcttcatacaaagtcagtcagccctgaaaggtcaaatgaaatctatcctgtctatagctgccattaaagaacagcagaacaggcggtgcgcagtggctcacgcctgtaatcccagcacttcgggaggccaaggcagacggatcacaaggtcaagagtttgagaccagcctgaccaacatggtgaaaccccatctctactaaaattacaaaaattagcccaggcgtggtggtgcgtgcctgtaatcccagctacttgggaggctgaggcagcagaatcacttgaacccaagaggcagaggttgcagtgagccgagatcgcgccactgcactgcactccagcctggacaacagagtgagatcgtctcaaaaaaaaaaaacaaaaacaaaacaaaacagcaacatcaaactcactaatgattgctgcttatgtctgttaatatttgtagtagaaatatacaggtccacatttaattcacctttattctccctgtccctttcaaatattaagtcaaaattacctaaaagcaaagaacaaataaagcaatccatctatgccttggcttctattctgctcaggaaacgtacaacaaagacgcaaaagatcataaaaatgtaaagttaagctttatgtatttgttattagcaaagagtaactaaattaacttctgcattcagaggcatagagaacaccaacgttactagttattaaatatttaaatctggcaaagagtctagttagtataaagaaatatcacaaatggtaatagtaaagagtgagaaaaaatatattttgtaaagaaaagtcttaacctatctaacagcaccaatttttaccctctaaaaattactatttgagcctataacttgtcagtttaaaaacagagatcactgttttctaaaggcagcattttaaaatctcaaagtgtaaattatcccatttttctttctcttttaatggaaaaagaatattctaaacctttctgccttcccaacattaaaactttaccttagttaattgcaacacatttcttgtatttcaacctttataaaacttctttcatgtgtctcttacacatgcaagaatgagatttgccaagtactacatcatctgaatagaaaccttaagcaaaacttaaaaacaaaaattgagatgtggctttttaaaaaattaaataacatttcaaagaatttctatttaaaacattaaaagtacttacctgaaataagagctacatgttgcaagaaccatcttatgacaagggaattcagtgccctcaacaattaacactatgtcagtaaacaactgctgttcataaaacagtttcaactgttccaacaatgacacagcatattcagtattgatctgcctctcgtcttgagtggacatgactgtattccattaatatctccaggaacagattagaaaagtccgtcttactgatggaaggtcaagtgaatacttcagaaataaaggagaacctacttgctgttatctgcagcattcagtaccaagactgacacattcactaatgagtaatatcttgttacacagacttagaatcactcctaggtcatcctgtgttaattaggttcttcagagtttttcaacacagtctgcagacattgtgctcaaatctgcaattgtgcagctcatgagtgaaagagaaaaatacacgaggtagattttgtggcaacatcctatgttcagcggatcctgtggagtaactaaaaagaaaaaaagttcagttgtagtatctaggccagtacggttttagaatataacgtttaaaatggcagccttaaatagaaatcatatttatttcaagttcaactttagacattaccataaaagtgaaacatgacaaaaatgaagattcttagtctacatttaaaattaaaaaacaagaaaattaccagttgtaatttcaagttaacttttgccttctatacaaaatataactgtcacagaaaataacgaacacatgaataagtacacatttttaaagctctttcaaaatagacaacttaaattaccaaagccagatctcttagttatttgtctggtagcaacaaatgatcataatatttaagaaaaaatatttttttaaaaaaacaaaaaacctgctctcctacacagagatttctcgttctccgaatatattttaaacacgttcacaaagtcttcatatttaatttaaactatacggtaaatagattcaaactgttaattttcaaatttgccattcaattcactaggagaactatatgtaatttgtttctttgtggagtggttctttcctaggaatctttacaaataaaagtatattttacttaaaaaaaaaaaacataaaatgtaatgggtatatgttcctacccagaaaactccatattacacaaatatgaatgttctccgaattaatatgtaactttaatacaaatccaatctaaatcctattttcaagggatttatctggaagaatgcacaaaggttgctaagatatttgaggggaagaagggcaagtttttaatgatttttatgaaaatattaaatgtactataaaactgccataaaaccaagtacacataagaaaccagagatgactggccgggcacagtggctcatgcctgtaatcccagcactttggtaggccgaggcaggcggatcacaacgtcaggagttcgagaccatcctgaccaacatggtgaaatcctgtctctattaaaaatacaaaagttagctggccgtggtagtgtgtgcctgtaatcccagctactcaggaggctgaggcaggggaattgcttgaacccgggaggtggagattgcagtgagccaagatcgcaccactgcactccagcctgggtgacagagcaagacaccgtctcaaaaaaaaaaaaaaagaaattagatatgataaagataaatatggtatctcaagttaggaagaatggtttatttcaacaaataatgttggaagtggctaactgctcaagggggcaaaaaaacctaggctttagtcatactgcataccattcatcaaaaaaaaaaaccaaaattccagctgaataaaaatttaatttggaactcagtattcacaacacatggcaaaggaattacaaatcaggaaaagaggaaaatcccaaatagaatgctactaatatgttaactataaaaactgccacctcttttttcaccaactgttaagatgaccattagttaccataatgagaaatgactccatcattagaatcactgttatttttcctcacaaaataccatccattatgtcaaagagaatgacatacacttcctgacaaactatactattacagtaactgctaacttgatatacagtcaagtttccagccaagttaactttgaaagtaactaaaacaggtgcaaaggcagagtgagactctgggtcatttaaggtaataactttgctcttccagaacagcatgtcacactataaatctgagttctactactataatctctaaggcaaataatacttaaaatcactggctatttccacacattaataatgcagcaaggcatagtgttgttgagggtgtggaaaaacaagcattcttacacagaggagtaagttgatacatacccacaatcccttattcaaaactcttgacacaagacacgctccagaatttacacttttccagattttatagaggtattgtgacacatgtaccctacattatgaaatcctctcaagaagtctcaggtagcaatggataatcaaacatattatctttgctgaggcaactatgaatggtgtcaaaaataaagactatatatagcctcacgttacttcaggtcaggttttactagcaaagattttttttttttaacaacttgatttttcagagctttttgaatttcaaaattgcaagtattaataatacttggcactggaaatgcttaataccaatctactaatcctacttctagaaatatattttacagaaatatatgcattaataaagtagaagtcctaatcccagtagctggactcaaaattgtccccatccatgtttaaacaaggtgacagcaactggtggccagggccaagacagacttaaatcatgccgctagaccccagaatttcttgcaggctagcggtacaggctcactctggtcatttcattaaccatataataatatgattttctgcaatgattttggggaggcctcatttacgactgggttttgccagatttgattttttatcgtatccatgaaaccgtattaaaacaattgaagtctgcttctaaaaaagtacaaagtcatactcattaacacagctttattagattcccctatttcccactcttcttttgtaatccaggatacattttcttcctggagaggcagcctacgtaaaagttaccttaaaataggcagaaaaagtaagtcattcagatatgacactaagtaaataaacaagtacaattaaaaataaaattaaagtcaggagtggtggctcatgcctggaatcccagcactttgggaggctgaggtcggtggatcacttgaggtcaggagttcaagaccagcctggccaacatggcgaaaccccatctctactaaaaacacaaaaaaattagctggacatggtagcacgtgctgtaatcccagctacccaggaagctgaggccagggaatcacctgaacctggcagacggaggttgcagtgagccgagatcgtgccactgcactccagcccaagtcacagagcaagactccgtctcaaaaacaaaacaaaacaaaaacaaaaaataataaataaaattaagtatctcacccctctgggagcatggacttcaaaaggtattaactaaaaatgtgaaagcttggccaggtgtggtaactcacgcctgtaatcccagcactttgggaggcctaggagggcagatcacttgaggcctgaggcctggagttcaagaccagcctgaccaacatggcaaaaccctgtctctactaaaaatacaaaaattagtcgggtatggtggctcatgcctgtaatactagctactctggaggctgaggctgcttcaagctgaaactcacttgaacccaggaggaggaggttgcagtgaactgagatcacaccactgcattccagcctgggcaacacagcaagactctgtctcacgaaaataaaaataaaaatgtgaaaatttgcaaagtttaggacgatcaaccaaccatcttcaaatgcccacaacacaaacattttctgtaaaaggctccttccctcctaaaacttgaaaccagtactctaaatcctctgaagcaattcagtatgtactatattaattaccaactgatgtgacgtattttacaaattttcccttttcaataattacattttgtatatcattctatatctaaaatcagcttcaaaacgtcacagaccctgttatctgtagaagccagcttccccagattaattctcaggtatcaaggaaactgttgacttaattttcttttctgaatgaatggctaaattccacaaatgtttattgaatactaagtgccaatcattgcactttacatactcggattcagagaagccaaacactaaagctccaaaacaccaagggcttttactcttactacagattacagccacagctacagctgtcattcaaaaacatggtgttttaaaaaccagctattctagacaaacttaaaagccaagaagcaagcaaatgagtgaagcaagctgggtatatgaaacatttttcttgaaatgtagctatcttaatctttttctttcaaacttttaatagagacatgagttcaagaaattttactctttaccgtaagaaaaattgtagtacaggtaaaatgagcaaaggtatctggtgctcagccctactactaacagtggatcacacaggaggaaggaaaaacttattgaagacctatttaaaccttctggattttcttaatatatgcaatgattacctgatttttacaaaataaacttttggccagctgtgctggctcatgcctgtactcccagcactttgggaggccaaggcgagagggtaccttgaggccaagagttcaaggctgcagtgagctatgatcatgccactgcactccagcctgggcaacagcaagattctgcctctaaaatttttaatttaaaaaaaaaaaaaaaaaggctgggcacagtggctcatacctgtaatcccagcactttgggaggctgaggtggacagatcacctgagttcaggagattgagaccatcctggccaacatggtgaaaccccgtctctactaaaaatacaaaaattagcctggtgtgatggtgcgtgcctgtaatccctgctactcgggaggctgaggcaggagaatggcttgaacccaggaggaggaggttgcagtgagccgagatcgcaccactgcactccagcctgggcaacaagagagagactcagtctcaaaaaaataaaaataaaaatagtaataataataaaacttcaaaaggtacactattctctcttctcataacaaagacaaaatattttaggctttgggagccataaggtctctatcccaaagatttaactcttgctgcagcctgaaagcagccaaagacaatatggaaacaaatgttatttcaataaaactttgtttacaagaacaggttacaggccacatttaccaaacgctgctttatttttaaaaatttatatttcttttatatatatatgtgtgtatgtgtgtgtatatatatatatacacatatatgtgtatatatatatatatacacacacatacacacacacaaattttaatttttttttttaagagacaggattgtactatgttgcccaggctggtcttgaactcctacgttcaagcgatccacttgccttggcctcccagagtactgggattacaggtgtgaaccgccgcacctggccttacactgcttcttgatgaaatatttagtcagtgactaaaatacgtacctcaagttgtttctgcaagaataatgtttctcttcagatcacaaaacaaggaaaagcacaaactttaaattcctgaacgcggaattaaatataattcttaatctaatttatatatattccacttttcttctcaaccaaaatattctaacatcttttacctagtcacacaactgctttccccaattcctgctagttccgtggacttccgaaacatgttcttatctagtgtgagtacctttaattaaggttaaaaaaaaaaaaaaagacatctctccccaagataacctgccaaaaaaaaaatccatactgagaaaaagctattcaaaaacacttaaattactttgggaaatccctgttataagccacaattcctggtatcaggtgcttccagattagtaagaaagtcctatattctaacactgatcattagaatatattccatagtaaaaaatgctaaccagcataagaattaaattggagtcatgcaaacacaatataatgaaattcacaatcttaataaagtgcaatgtactttgacataaaaagtgtacatattcttactccttcttttaagtcctgcgctcaattcagtgtttttgactgatttgcttgatcgcagagaatggcaaagataaggttaaaatgttatacacaggatgaaatcctctcctccactgtctacacacttttttttttttttttaaagacagagtctcgctctgtcgcccaggctggagtgcaatggtgtgatctaggctcactgccacctccaccacccgggttcaagcaattctcctgcctcagcctcctaaatagctgggattacaggcacgcaccaccatgtccggctaatttttcacatttttagtagagatggggtttcaccacgttggccaagttggtctcaaactcttgacctcaggtgatctgcctgcctcggcctcccaaagtgctaggattacaggcatgagccaccacgtccggcctctacccactgactttctacgaattattacaggacaaagtcctatttatttttaaatccgaagactacctacagaagtcaaaaatttataaactgattgaaaacaaatgcttctaatacattttctctaggatgcccaagtctccgaggttctgagtgaattccaacacataaaagttttgaaacattgttactaaatgattgtcaggattaaatcagttagcaatcgacagtaacatatacaattctacttaaaaatctgaaactcttcccacaaaatattatttctagagatgacttaaagtattgggaggatatgcacaggttatcgaaaatactacggcattttatcagagacctgagtgtccttggattttcatatcccaaggggacctaggaactaatctcccactgaaaccaagagacaactgtgtttctatgcaacaaatttaagttggttgtctgaattcctcacttaactttcctataaaataacagtattaaaaaggtgtttaacttctcactataagcagcaaaacatgcctgaaagtctatcagcaaagaaaatttacaaagtaaatactactttaatactcataaagagataagtgaccatgaaattgttttacagattctgattattaacattaaaggataaggaaccaagattaaaagtatgaaatgttgaaatttttaaaaaatcccaaatacttttaaagatgtcagaggttgatggcagtgttttggctttttggggggaggcaatgaggggggatagatgtctaatttcactttgaaatcaagttttcattcctagaggtgtgtactttgtagcatcctcccactgagtagcctggaaacacaaatagaagcaaagcaagcttttccaatgttaaccaggcagaatatagagactgaggaacgaataaaggattaaagaactattgaatgtgataaagaaaccaatcagcaattaactgagctgtggatgaaaaaggaagaaaggataaaaagatgggaaggaggctgctagcaaggcctgctacaataagcacagtagtaggtacaaagtttccattggacaggaggaataagtgttactgatctgttacacagcatgttgatgatcgcagttaacaataatatactgtgtatttcaaaactgctaaagattctaaatgttctcaccacaaaaaaaataagtacatgaggtgacagatgtaaatagcctgatttaatcattcctcaatgtgtacatagattgaaacatcacattgtagcccacaaatacatacaattatttgccaactaaaaataaaataaattatatagtaggaatgaaggaatgataggtctccctccaggaggggcagtgcggctataaatcattcacctgtaggaagcacattcaaattgtacattactaacttagggagtgctgcatctcccaatgctacaaatgtcaatagagaagattaaaaatttttgttggaaaagatccaaggcgttctccatggaggtcaaccgttgaaaaataattgagtacaaacccaaactacttgggttaaagccccagttctgcaacttaatagctgtgtggccctttttaagttatttattctctatgcctcagtttgctcatctataaaatgtagttaaaagtacaactctcttctcaatgaattgttctaggattacatttcatacttggttcagtacctgacacacagcactacacagatattcgaaattatttttattaacccacccactggtgaagcttttgcagcactttcccaactcctggattccacaccttcaccaggtccgaagattccaatttcaaggtctcagcactccaaatacagttctcttttttcattctgtctaaatggtattttacataagagaaatccaatgttttcagagaatattgggacttttttgcaaacatttgacacttgaaatctgaattcagtgttctaaaatattaagataatttttcctttttttttccttttctcacatattttgatggtacaaataatgaaacaaactagtgcttaaaagacgaccaatcttgaggaggctgatgtcagtgtaaaaaactaaatgagagtccagaaaggcaccagtcataaaacaagcctttctttatttcaatgagatagttttctccttaggaaggacaagagatgggtgctagaaacagtttgctttcaagttatcaaaacaaccacgacagttgagaatgtctggaaaagaccatttgttttttagattgtcaactgctacacaaacagaattttctggagttgtgacaggcatcaattaaaaaacaaaccaaaaaaaaacaaaaaaaccaaaaaaacaaacacctggccttttgaagaatctatcaagttttaaaaatttcagcatacttgcagtgagccgagatcgcatcactgcactccagcctgggcgacacagcgagactccgtcccaaaaaaaaaaaaaaaaaaatttcagcatagcttcctctgctctagtcacattcagagcttaggtctgttctctctttccaaccatactgatagatgacatggctccatcaggttaattacgctcagcaccctaagtaaattcaggtcacaagtacaagctgtactatattatgattaacaagttatctcagttttaaaaaattaaacaagaacataaaggcaatgccacctgcgatacaataatcatatgagtatactatgtccttttattttgggtatcacttttcctttttcctctcacctctgcgcagtgacttaagaaagctggggaaaagtggccaggcgcaatggctcacaccagtaaatcccagcactttgggaggccgaggcgggcagatcaccaggtcaggagatcgagaccatcctggctaacacggtgaaaccccatctctactaaaaatacaaaaattagcccagcgtgggctactcaggaagctgaggcaggagaatggcgtgaacccgggaggcggagcttgcagtgagccaagatcgcgccaccgcactccagcctgggcgacacagcgagactccgtctcttaaaaaaaaaaaaaaaattacttgagatcggccgtctgcggtagctcacgcctgtaatcccagcactttggaaggccgaggtgaggggatcacgaggtcaggagctcgagaccagcctgaccaacatggtgaaccctcatctctactaaaaatacaaaaattagccaggcctggtggggcgcgcctgtaatcccagctactcaggaggctgaagcaggagaatcacttgaaccctgaaggcggaggttgcagtgagccgagatcgtgacactgcacaccagcctgagtgacaagagactctgtctcaaaaaaaaattacttgagatcaacctgtcatttctaatactgagttatttaagtatcagttggtctattcaaactctacaaaactgaaaagattaagctaacaaaggactttgaaattttcactcatattttatgacaccaggatcaatcctttttcctggccttacttgtcttaggaatgtgggcaaagagaagaggggaagggggactcttttctaaatgtgtaacatttttggaaaaaccaatgttatcatttggcttttaagactgcattcaagtttctaggaattcaccttgcacattcaatgttcaatgtttaggaatgaaaagctcaacatttctaccaaccagaagaaaatctatggaggagcatggacatatgtactgatacctctattccttcccatctccttacatgccctgtgaataacataagttaacattttataatgcttcttatgagagcaaaaaggggagtagagttacagcactcataaagtcttcctacaaaactgtgcaaagaaaacaccactatgtggaaacgtgtggactacagagcatgctcaacagaaaggccacagcactcccgagttactgacagaaaacaacctcttgaggattccaggccccaacctaaaagggcttcaataagcactaagccaacagaagatcaaagtgaagaagtaagcttaacattagttatcagccagatggaaagaatagcaaaattccacatcatcgagattagaaaacaaccgactggcttttcaatttactttagatcagaaaaaaaagtcggggaaaaaagtccttatcaaaggttaaccaaactaagtcattcacaattacaagagatctaagacccatactactcaaattcggcaaaaatgtacaactcagagggaagagggggaagatccctgttaattagttgcctcgataaaagaaaatatcattttggtcagtgcacagcgttgatagggtttcgtttctcaatgcctaaatgctgtgagcccgacgtacagattcaagtataaacaacacgtgaccagtcctgttgcctacgtcttcataaggctaattgacacagaagatagttcacacacacacccttttaaagttcattttgtattttgaattcttttcctattttcactggaaggggtcaccgtggtagcccgtgggatggacgctcctctaccttttgaggcaggtagagttcttagatagctaagcccaagggaaaaaaagatgttaactcaaaataaccgccccacaccaaactaagcgatttttctattccccggttgttcaatccgtagggagaaggaggtggtcgaattcaaggaagttaaagatttcacaaagtaaacacgtacacaattttccgtttcaaagggcagtttctgctttcttttttaagtcgatatagaccataacaggagctctgttcgtctagacctctcttggttagttcagatgtacgcggggggaatacagaaggaagggggtgtcctccttcggcccaccatgtcgcgaacacgtcgcgagtctttaagggaaacagctttacttcggtaagggcgggcgcgagccgaggccaaggcgccgcccgggagccccgcgggcgccgaggcgcccggtgccggggccggaaacgcccagctagcggcgtaccgggccgccccttccccgcggacctgcccggagctccgccgccctggggccgccgcggggtgcggagggcggcgccggccgcccgcgcccctcccccgcccgcggcggaagcgtctcgggtttgaaagatgccgcggccgccgcctcccacccgccgagccacaaagggccgagccccctcccgccacagccctcctccccggcccctccacaggtcgccgcgggctcccagcctgcccggcgctactgtcgcctgctcacccgcgtccctcggtccggaggtgtgggatccgctccagccggtggccccgtccacactgggcccctccggcgcggcggcgggggcgtggccctcccgccgcggcctcgcctggggtctcgcctccgcctccggccgaggaaggctggcgccgccgcctcttccttccggtttcccctcgcaccctccctcgcttggtccgtccagcgcggaaagcagcgtcctctgcgggcgccgccgcacgctcctcagggcccgaccaccgccagactcctcccccgggagccgcgccgcccgcccgcccgcgccgccttgtcagtccggggccgcgagacgccgggcccgccgcccccgccgcccccgcccccgcccccgccgcgcgctctcgcccccgcccgcggcccgggaacgcgcgcgcaatggaccgctggccagcctgccgcgcccgccctcgccacgccgccctcccgcctcgcgcgcgcgcgcgcctgtcggcaccagcggcagttttgcagtttcccgggtcctcgcgaccgtcccccgcccctcccttactctagctgcccccgcccttttcctctgccggatgccaccggaaagccaaaacaattggggccgcgcaggcgcgaaagaggaaacggaaagagcaggaagggcgggggcggcgcgaggtgacgggaagcgtaattgaagggggttcccgggaaaggtcatgggagagcccttgaggggcgcgtgcgcggcagaggggcactccgagtagccgcggcggccgaggccttgggcctagacgggcggatggagaggcccgacaagttcattgctaggaaatctagagagcaaaacaccaattgttatgctgaaggaggtgttttatcccttggaatttcccctgaaatacagatttttgcaggctggctcggaaagtgggaatgagtaggactaaacaataccagaccgggggcaggagaaagttgaggaggcgttgggcgggtcgctttgttgccgcagcacctcttctccaaaccatgccctcctctctccagagccgcttcggcttttcccaaggccaaggaagaagtcagagcagcacccaaaagggcccgcagttgggggaggttaggggaaaagggagagagagacatctgggtgcggacggcagctccagcgtctgaagccttccgttgtgtgctgcaatgcggcggctgcacgcccccaaccccccgagttccaaaagagcgccttcagcgttgcttcgcaaagcgaagcgtttgtagcagcagctaatggctgtggcccgtactgttttagttaacttggcacagcttgctggcaggcaggctgtaaatttgctaggagctattcgtggatcaaaaaattgtcagaaatgcccacacagactccacctaccttcctaacttacagtcttggcacaagcccaatctagagaatatagatgactaattataatctgaaaggccatacagtacattactgaagggagcctcttcctgtaaactaggctagatcaactgaatgcacaccaagatgcgtgttatcaggaactactgataaaggattgttttactgtagaatctggaaactacattcaacaaatcttcattgagtttccagcatgctaccactgtacttagtctaattaagtagttaagtggtatgatatcaaacaagctatacaaaagattaaagtcatttaacacacacttgagcacctactttgtgccagattgggtatgagagatgcggtctaaacatgcagacaacaacaacaaatgatacctgcggcaaggagttcgtgattcatcctgtgggcaacaaaaagccacttaagatttttaagcaggagaatatcttgataagattttagagaaaaaattctaaagcatgatagatagcagactggaagcagggatactagttaggacgctgttaatgcagtccagacatgagttggagagaaagtccaaactaacagtgtcagtgagaatggagaagcagagatacatttgaaaactagccagctatgataaataagacttgattacctagaggatgaggggaaataagaaatcaaggataactgagttttttagttagggtgattagatggtgttatcagtgactataagaggagtaatgaattgtgaggatgaaagagaggactaaagttgtccttttaatggctgtacagttaggaatgcatttgggcccacatttttttcgaaaagattccattataatagcttaaacaagacctcaaatctacaggtaggcagttacctttgttggttcaatagctcaagaacagcagggccatcatttctgtgattctctcgacattgacttcatggttgcaatatggctgcagcagttttagccttcgcacctttgttcaaggcaagaagaggggaaagggggtggcttccaccatccatggtcttttttttcttcaggaaagtgaaagctttctcaggatactacatctcccaaactcagcagacttccacaaacatctcattgtctagaattgtaatttggccacctataaagattacaaaagagaaaaacactgggaatggatattgggtcagacaagtcagacaaatagcagtcggctagttagttaatatttaaagcatccttctttaacacttaaaaccctgagagctgttaggatggattgatgttcctaggtttcaaaaaaggccaatcgctttggtgtgttatcttaactgggaaaagaacaggttgaacatttatactcaaatagttgtagttgtttgccatcccttatctcaaggttcccatccccttaaacaaagtctcacaggggactggaacaatgaggaagaagggactggtgcagtcaggggagggtgactcccgttcagctttccttttgcagctgccatcttagaataactgtaggttcttggcatcgttaatttgatgttccgcctaaaacaccatcttaattcccttagagatcttgtctctgagcttagaaggctctgagtgatcacagcaagttccagtgtccattttagggagtcatacatcagtatcttctagcagttacacaaactcttttggaatgtacagcatctctcttgtgatctgtatccaaaacattatttcatgcaacccttttccattaacaaggcatctttccttttaattattaataagtcatctttcctttcaactgatggccacaaaaagtatcatcctaaaactgtactttaaacattgttatgattctagaacagaaagaagatagtaatgattcctagaaaaataaacatgcagccgggcacaggtggttcacgcctgtaatcccagcactttgggaggccgaggcggggggatcacctgatgtcaggagtttgagaccagcctggccaacatggtgaaaccccatctctactaaaaatacaaaaattagctggccgtggtggtcggcacttgtaatcccagctactcgggaggctgaggcagtagaatgaccaccacgcctagctaatttttgtattttttgtgtagaggggtctcgccatgttgcccagtctgcattttctttttctgagacagggtctcactctgtcgcccaggctggagtgcagtggtgtgatcgcagctcactgcagcctcgaactcccaggctcaagtgatcctcccacctccgccccccaattggctgggactacaggcatgtgccaccacacccaggtaatttttaaaaattttttgtagagataggatcttgctacattgcccatgctggtctcgaacccctggcctcaagcaaccctctggcctcagcctcccataatgctggaattacagatgtgagcctctatgccccacccagagtctatgatcttaaccactctgctttactgacttctgtcctcctaccaaattgcttcccagcatcacttcaaatcttaggaactgccatattatctcagcaatatagtttaagtagtatgagcagaaaggaaaagggggtgatttttcttctcccttctctcttctaatcaggtaggaaaaatatgtctcagaatcccgaacagagtacccctgatgtcttcttggccaggataatgagattgttgttatggtctccagtcattagttgggagagagagaggaaagagttcccctttctctgagcacattcctttttttttttccttcaatctggacaacatcttcgttctctcagcaaggaagaagtagatgagaccaccaaccatgtttcccacaaagacaatcaaaccatgagacccacataggaaatggaagtgtataagcaccaaactgagttttatcctcaatctgccattcagtagctgtatgattctggcaagttatttaacctatctgaacctggtcatattatgctgaatgaatgaggaccgggtgcaggtagctcatgcctgtaaccccagcactttgggaggcagaggtcagcagatcacttgaggtcaggagttcgagaccagcctggccaacatggtgaaatgccatctctactaaaaatacaaaaaaaattaggtgggcgtggtggcaggtgcctgtaagcccacctacttgggaggctgaggcaggagaatcacttgaatctgggaggtggaggttgtagtgagcagagatcgtgctactgcactccagcctgggcaacagagggagactccatctcaaaaaaaaaaaaaaaaaagaaggaatgaggattcaagacagtgtaacaaagtgcgtagcacatagtaagcatttattaaaaacagtttttaatatcatattctttttcacatgttaaacatagaattaccatattatccaataattccatttctaggtatgttgacctaaaaaaatagagacaaatctctaaatttaaaacattttatgtaggaagcaaggattgcaattcagggcatatgtacagaccaagtggtttttgctacgtccaaagaagaaagagaaggctggaggttttataaaaaggagaaatattacgtattcttttgaaagaaagtgcattggcactagtaaagttttgaggagctggcaagttctgagtagtgagagacagcggtgggtaaaattagtcgcagaattgcagcaggctgttttagtagctattagataaaactggtttcaggcagtttcagcagccagcttacagagaattacattcttagagcaatgttttgtgccctaagggctttttttccctggtctctcaactctgttttaattgaatatgacaagaatgacccaattcgtatgatcaattttcacaggtagatacccaaaagaattgaaagcagcaatttgagtagacatttgtacaccaatgttcatagaagcattattcacaatagccaaaaggtagaagcaaatgtctgtcagtggatgaatggataagcaaaatgtatataaattggaacattactccaatggaatggaatattagccttttaaaaggagaaaattatgatatgctataacctgaaccgtgaatacattattctgagtcaaataagtggaacacaaaaagacaaacattgtataaggtacacattgtataaggcacttataaggtacgcagagtaatcaaattcacagccacaaaaaagtagaatagtgcttgccagggaatggtgggagaggagaatgaggagatgttgtttaacagatgcagaaaaattttgtgtgtgtgtgtgtgtgtgacacagtttcactcctgttgcccaggctggagtgcaatggtgcaatcttggctcaccgcaacctctgcctctcgggttcaagcgatcctcctgcctcattctcccgagtagctgggattacaggcatgcaccaccacgcccggctaattttgtgtttttagtagagatggagtttctccatgttggtcaggctggtctcaaactcctgacctcaggtgatccgcctgtcttggccttccaaagtgctgggattacaggcatgaagcaccgcacctggcctgcagaaaacattcttatcagcagagacggggagtccaggctaagtatattctataaaaacagaccttgttaaagtacctcttatcttccttcagtctccctatctgttttagttacttttccaaaattgtctttgttcagcctaatatatgaccacttagattttgccacttctttgggtcttcattttcctgtggaggctcccatgtgcctgtaaaaatatataggcttttctcctgttaaatctatcttatgtcaatttaattctcagtctcagccagagaccctaagagagtagaggtaaagttttgcctctactatatatgtgtgtgtgtatatatatctatatctatctatatatatatagcttgtttttttagagatggggttttgctatgctgcccaggctggagtacagtggctattcgcaggcacaatgataacacaccacagccttgaactcctagtcttaaatgatcctcctgcctcaatctcccaagtagctgggactacaagtgcaggtgccactccacctggctcaaaaacaaacaaacaaaaattaacaaatgaaattctgatacatgttaaaacactgatgaaccgtgaaacactacgctaagtgaaataagccaggcacacaaggacaaatattatgattacatttatatgtatgtggtacctagaatagtcaaatttagagagacagaaagtagaatagaggttaccgggggtttaacaggtaccgagtttctgtttgggatgatgaaaaagttctggaaaaggatagtggtgatggctatacaacattgtagtaaacataccgaatgtcactgaattgtacacttaaaatgattaaaatgataaattttatgtatattgaaggggttaaatagttgactaagttaaagacagttgaaaaacagcaggtgcaaaagatcactttgaactttgtgctgtttcttttatttgtttatttatttatttattttgagacggagcctttctctgtcgcccaagctggagtgcaatagcacgatctcggctcactgcaacctccacttcccaggttcaagtgcttctcctgcctcagcttcccaagtagctgggatgacaagtgcccgccaccatgtctggctaatgttcgtatttttagtagagacagggtttcaccatattggccaggctggtctcaaactcctgaccttgtgatctacctgcctcagcctccctatgtgctgggattacaggagtgagccaccgcgcccagcctgtgctagttcttaaaagcagaagatgaaattcccttgtgaaagatactctccgtgttctagaaggaaaggcaataaccttatcttcaacaatgagatgctgaaactgagagaatacaatgttgaaactgagagaatactgtacagactttgctagaataactcttactttttttttttgaggcagggtctcactctgttgcccaggctggggtgcagtggcatcatcttggctcactgcccccttgacttctcaggctcaagccatcctcctacctcagcctcccgagtagctgagactacaggcacaccaccacacctggctaattttttgtattttttgtggagacggggtttcgccacattgcccaggctgatctcaaactcctgagctcaagcaatccactggcctcagcctcccaaaatgctggaattacaggcataagctatcatgcctgaccaagaataacttatcttttagctcccccatgtaatttcgtcacattttcacagtttactatttacattctttgtctaatccagaatggaagtaacgtactctaactgcttcttggggtcttcatttctttataagggttcctgcgtcatataaaccttgtaaagtcactttgaatgctcttctcctgttaatctatcttatgtcaatttaattctcaggcctagccaggaccctaagagggtgaaggtggagttttcctgcccctgtaatatcttagcaaaaaaaaaaaaagtttaaaacaaaacaaaacagcactggacagaagcctggctttgccaattactagacccgtgacctgaggcaagttacctgacttacccaaacctcagttttcaggtctatagaatgaaaataataatagtacctacttcctgggtcttttacgaagttaaaatgaggtaacttggcaaagtattacattgtttaaggcttaattcttcctagctttaagggaaaatactcattctaaaaatcatgaatgtccttagtacgttatctagcaaaattgttactgtgacaatggcagagatcaaatgtactatttttgatacttggccacatattttgtcttttcaaggggaaaaccctctatttcaggaaaatgttttaacaggcatatttattcttaagatgagggcctacaggctggatgagacatgctctgcatgagaaatgaacaggaatttctgaggttctaataaaaaaagttagctgagcaggtagagaaagggtagagagcagtgtggctgaattctaagagaaaatgtctttctggtggagacgatggaagcagtttttagaagaggatttctaagattcatttttaaattgtgtgctggccaggcgtggaggttcaagcctgtaatcccagcactttgggaggctgaagtgggcggatcacttgaggtcaggagtttgaaactagcctagccaacatggggaaactctgtctctacttaaaatacaaaaattagccgggcgtggtggtaggtgccctaaatctcagctactcagaggctcagacacgagaatcgcttgaacccgggagacagaggttgcggtgagtcaggatctcgccactgcactcccgcctgtgtaacatagtgagactctgcctcaaaaaataaaataaaataaattgtttgctgtactattctgtgatataaatacactccaatactggccttcctggccacgattcaactgctaggtgcacaactttgattctgtgttcaagagggtaaagagaagggacaaagtctatcagtgcagagcatgagaagggaaaacccttattgaagcatgtaagggagacctaggactcagccagaaacaggaacttgaaatcagggatctaaaaggaaacatgtcccaggtatccaaacagatatttacaagggatgatgggcctcccaatgtgtatagaatgggggaaagagctaaattttatttaaatctcaaagtatagaatgaccccagctgatacctgagttgggttgtgtaaatgtttttacattccaagctaaatgccatacttctcataaagcccatgatctgacaacccatgggtcattaatcggtatacaggaaagacctttggaacaagacctaggagaagtggatcttagttcaactcttaattagctgtgtaataatggtgaaatattgattgtttattctcttctgatcacatgttcccaatttagaaagtgggatgatcactgagaagccagctttggggtctatgctgcttctagaacacctcctttcaaatttctaaagctagttgtggtagttagctttaaaaatggccctcggtaggccgggcatggtggctcatgcctgtaatcccagcactttgggaggctgaggcaggtggatcacttgaggtcaggagttcaagaccagcctggccaacatggtgaaatcccgcctctactaaaaatactaaaaatacaaaaattagctgggtgtggtggtgggagcctgcaatcccagctacttgggaggctgagacagaagaatcacttgaacccgggaggtggggttgcagtgaactgagagttgcattgcactctagcctgggcgacaggagactctgtctcaaaaaaaaagaatgccccccagtgtattttcagccttgtgtaatcctctccacattgtccagtttggtatgtgtgaccaatagaacagggcagacgtgatggtgtatcacttttgatgttaggttataaagactgtagcttccatcctgggagcattctctctctctctctctctctctctccccccgcacctctctagctctcgctctcattctcactctgtctttctctctggggtgttttatacccacccatccccattccctctctttcatcacttgtacatggggaagctagcccccatgtcatgaggacactcacacagtctttggagaggtgcaagtgacgagatctctggtcaacagccaagggtgaaccgaggccaaccaacaacttgagcgagtttggaagctgattctccggctgcagtcaagccttgggatgactaccaccttgtgacagaccctgcacgagaagcacccaggtgatccactcctcaattcctaacccttagacaatgttagataataaatgtctgtttttgtttgttttgagatagggtctcactttgtcacccaggctggggtgcagtgacatgatcatagctcactgcagccttgaactcctgggctcaaacagagttgagcccacctcagcttcctgagtagctgggactataggctcatgccgcctgctaaattttgggataatctgccacataatgatagataactggctcacatctgtaatcccagcactttgggagaccgaggcgggcagatcacttgaggccaggagtttgagaccagcctcgccaacatggtgaaacctcatctctactaaaatacaaaaattagaccagcttggtagtgtgctcctgtggtccccactacttgggaggctgaggtgggaggatggcttgagcctggaaggcagaggttgcagtgagccaagatcaccccactgcactccagcctgggcaacagagcaagactatgtctcaaaaaaaattaaaacttaaaaaataatagataactaatatattaatgaaattcaaagatacttcacatttgtttgaacttattagtagttggcagtaatctgcaaacaataatctataaatctaaccattcaggcaacaactatttactgagttcctatgtcttcctaacacaggctattttaattacagctgtgatgtgattatttttctggccttgagcatagaattgtagagatctgattgaaatcctggtgttcatagttagagagaatttggaaaagctccttaacatctatgtgcctgtttcctcaactataaaatggtgataatacaatattatgatgaataatcaagttctgaaccttagtcttaccttaaaacataatttgaaagtcaaggcataaatagatttttaaaacttaaagtatcttgcccagactataaacaaggctatttgttattttgctaattatttttctttcctgcagccattggaagatcatggtccttagatgaaataaataaatatagcaatttaaacagggtcagctatgtttttaatatacttgcttcctccccttgccatttattgctaatttttcagtcacgtgtgaaatccctgataaggatctgcacgttacaaatatccacaaatttcatattttctctcctaattattagaagttcagatacaggctgggtgtggtggctcacacctgtaatcccaacactttgggaggctgaggcgggcagatcacgaggtcaggagatcgagaccatcctggctaacacggtgaaaccccatctctactaaaaatacaaaaaaaaattagccaggcgtggtggcgggtgcctgtattcccagctactcgggaggctgaggcaggagaatggtgtgaaactgggaggtggagcttgcaatgagccgagatccggccactgcactccagcctgggcaacagagcgagactctgtctcaaaaaaaaagttcagatacaattattataatagaaactttattctagcaaaatatgaatacacacatttttcagtgacagaaaagtagtcacaataatatgaaaaaatgatatataaattcagtgaaaactagagaaataaaaatctgaaactgtgagttatttctcaagtaaatgaagagaatatcaagaatctttcccagcacttttttttttttttgacagagtctcactccatcgcccaggctggagtgcagtgccagtgatctcagctcactgcagcctatgcctcccaagttcaagagatttctcctgcctcagccttccaagctgggaccacaggcacacgccaccatgcccggctaattttttgtatttttagtagagatggagggggttcttaccatgttgcccaggctggtctcaaactcctgagtaaaggcaatccacccacctcggcctcccaaagtgctaggattacaggtatgaaccaccacatccggccagcacttctgatctataaatacaactgtcctcaaccaacagtttacttcatttattgtaatacattcataattcaaagatgtgattgccactgaaaagtatttttcaggggaggggttgggaaggggaaaaaattatttttcaaaggaagttattggctgggtgaggtggctgacacctgtaatctcagcactttgggaggccaaggcaggtggactgcctgagtttgagaccagcctgggcaacatggtgaagcaccatctctacaaaagacacaaaaaattagccaggcatagtgttgtgtgcctgcagtcccagctactcgggaggctggtgtgggaggatcatggagcccaggaggtcaaggctgcagtgagttgtgattgtgccactgcactccagcctgggtaacagagcgagacttaatctcgaaaaaaaaaaaaagttatttactgtgaagagaggcagaatatgccacaccaaaatatgccactttagtataaggattattttgagctacttgaaaaacagcagatgcaagaagggcaccctgatctcttttcttcccgaaaacaggaaataagaactcccacatgaaagatgccctccttgtacgaggagaaaagaaacattcttcaatgggacatcatagctgagagaattcagtggaaatgaccttgttaaaataattattgttttggcaggtgcctgtaaccccagctactcgagaagctgaggcaggagaattgcttcaacctgggagtcggaggttgcagtgagccaagatcgcgccactgcactccagcctgggtgacagagcaagactccatctcggaaaaaaaaaaaaaaaaaaacaaatatatatatatatatatatatatgtgtgtgtgtgtgtgtgtgtgtgtgtgtgtgtgtgtgtatatgtatatatatgtgtgtgtatatatatgtgtatatatgtatgtatatatgtgtatatatgtatgtatatatgtatgtgtatatatgtatgtatatatgtatgtgtatatatgtatgtatatatgtatgtgtatatatatgtatgtgtatatatatgtatgtatatatatattgtagcatccacacataatttagtcacttttctacaactgcctctcgttattcaacttaatataaaagcatttagatttcgccacttctctgggtgctcatttccttatgagggctctaaatgattcagggcaggtgagccccaaaattggggcttaacccaggaagtttcttggcttcacccagcaaagaattcaaaagtgagctggcggtgttagacagcaacatttattgaagcggcggtgcacagccgcagaagcactgctccttgtggagtggggctatccagcaggctgtgtgcccagagtagcagctcaaaggcaggtctgtagtcatgttcacatctgcttgtaattatatgcaaattaaggggtgaattatgcgcaagtttctaggaaaagtaatgcagacgtttctaggaaaacaaccccggtcgtagggtcgttaccaggaaaggggtggcaacttctgggtgttgccatggcaatggtaaactcacatggcacattagtgggcgtgacttatggaaagtagtttcctcaatctggtcccctctttgagcctcgcctttggaatcccacctcctacctcaccgtgtcatttaaaacatataaatttgtatgcttttctctttttttatttatggcaatttatcaggctcagctaaaaaccctcagggtagaggtaaacttttgcatccccttttctgaaatagaaaaactggcattcgtatcagataggttcattctatctgcgagatggtaatttttttttttttttttttttttttttttttgaggcggagtctcgctctgtcgcctaggctggagtgcagtggcgcgatcttgacgcgctgcaagctccgcctcccgggctcacgccattctcctgcctcagcctccggagtagctggtactacaggcgcccgccaccccacccgaagaattttttgtattcttagcggagacggggtttcaccgtgttagccaggatggtctcgatctcctgacctcgtgatccacccgcctcggcctcccaaagtgctgggatatatattacccgggcgtggtggcgggcgcctgcagtcccagctactccagaggctgaggcaggagaatggtgtgaacccgggagatggaggttgcagtgagccgagatcgcgccactgcactccagcctgggcgacagaaggagactccgtctcaaaaaaaaaaaaaaaaaaaaaaaagaatcttggatctgattttgggctggatgttgtgcctcatgcctgtaattgggaggctgagctgggcagatgacttgagcccacgagttgaagaccagcctgggcaacatggtgaaaccttatctctacaaaaaaacacaaaagttagctgggtgtggtggtgcatgcctgtggtcccagctactcaggaggctgaggtgggaggatcacttgagcccagggaggtcggggctgcggttacaccactgcactccagcctgagtgacacagcgagactctgtctcaaaaaaaaaaaaaaaaagaatcttggatctgatgttgatacacacgaaaagggtgaaagcaaatgttccccaagacagtacagagatgtagaataattcttagaccttaggttactgttaaaagttccaccatgtatgggtggatctttcatgtgaaactttgaaaactaatatgaaagccactcatataatgcagttctattgctgaacatgaaattctattaaaattgagatttttatgtcctgaagctctggttctgattgctcactccgaacaagtttcctttagtacacctattggatatattgctttacctggttgaacatctacattaaaaaaatgttttacaggccaggagtggtggctcacgcctgtaatcccagcactttgggaggccaaagccggcggatcacctcaggtcgagagtttgagaccagcctgatgaacatggagaaaccctgtttctactaaaattacaaaaaaattagctggactggtggcacatgcctgtaatcccagctactggggaggctgaggcaggagaatcacttgaacctgtgaggtggaggttgtggtgagccgagatcgtgccatcgctctctagactgggaaacaagagcgaaactccgtctcaaaaaaaaaaaaaaaaaactggaagtttaacaggcgaaagaaaaagctctctgcacagagaggggtcccggagaaaatgggttgctacttctgcaatgaaatgcagaaggtgtttttgtttgtttgttttttgagatggagtcttgccctgttgctcaggctggagtgcaatggtgcaatctcagctcactgcaacctctgcctcccggattcaaatgattctcctgcctcagcctccccagtagctgggattacaggtgcctgccaccacgcccagctattttttgtattttcagtagagacggggtttcatcatgttgaccaggccggtttccaactcctgacctcgtgatacacccgcctcggcctcccagagtgttgggattacaggtgtgagccaccgtgcccggctgaaatgcagaaggttctatagatgagcttgaggaggtggtgtctgatttacatagggcatgaaagattgatctgaccaggtgtgttatttgcatagcacacaaagaagctggctgccccaccctaatcttttattatgcagatggattttctacctggctggcaccatgttgcctgttcctttactgcacacatggtgacaaagaaaagggaagatggagcctccatgttgaacatgcctgggcctcaattagcccttttctattggcacacctgtgcaagtgtccagcttgcttatcatggattacatgggattttgtaaattatcccagtgacttcactattacaatgtcccagtttagaggtgagtactggaagcttagctcatccagtcagagagcaagtggcacgaaagagtcttggtgttgagtatccctgccaccctccaagcccttgtgctgggctgttaaacagcagtcccttgactcagaggccgtttctgccctgcagtgatcataaagactaactaaattcaggcaaaatgtcaagataaggcctttagcttcattataaaatggaaactaaagatacattgatagtaattctctgtataacttatcttgcatctattacatgagatatttcagaaaatgttttgatttccgttatttcctaggaaacaaattgctgagttccacctgaaggaagactttactaatgccaatgtcatgttaggaagatctttcttcatttcaactaacaaagctctggtacaccagtgaacaagttaaataatgggatatataaaaccttttcaactagaagtttgtttgtttttgagacgaagtctcactctttcacccaagctggagtgcagtggtgtgatctcagctcactgcaacctccacctcccgggttcaagcaattctcctgcctcagcctcctgagtagctgggactacaggggtgcaccaccacacccagctaatttttgtatttttagtagagacagggttttactatgttggccaggctggtctcgacctcctgacctcgtgatctgcctgccttggcctcccaaagtgctgggattacaggtgtgagtcactgcgcccggcctcaactagaagttttaaaatagtaaatggaattgcatgtctgtgtgattcttaagccattttaccttctcgcccaaagtgactctatcactgataccaaatcaatacccatcacgcatgttgccatatgtacttctgcctcacctccagggaggcttagctaaggggaaatgatggggtcaaatcaagccgagggatgaactgcagacagatgggaactgccctggggatggggtctatgtcctattcatttttacaaataaagacctgacacgtaacactgataataacactgacagatgtgggcagcagtgatttggagtatcatatgttcttccctttcaaccactgtacactctagaaacaaagaaatgtttgtttcgtaaacacaacttctttatactcagaacctaggacttaagtcaattgacacaatcatcttccaataaatactagaggttaagttggtgactaggtgccaaaaaggtgtagtgtggttgaggggtataccaaggttatctgaaagaacatgctattgttggattcatggcgttgtatatgtgggagaggacagaggtgcctccaagaactccctgggtggtagactgaaaaggatggtggtgcacatggatgggtcccctgcatgtcacctctaaattaagctgtgatgaagacgtccctgctacgctataactcactgtcctaaccgagcaccttaaaatagggtttgaggagatggtgaaaagtgataacagcgttgccagatgacatcccaaaggcaggcagaagataagagcttttccaaagctgctctcctgagaaggcctcactttttgcctaagtagtacctacctcagtacttggtttagagactccaggaaaccctctctaacccaaggctagattaggtgaccctgctatgatcctatagcacctgttattacactttgataacctatttcaggacatgactctggagactcacggcctcaattctgtcctcaaccagactccatctgttccttagggccgtggttattgtagcccctgtggcatccccatggaatagttagtgtgaagcctggtgcagagtatacacccaggtacttgcggaatgaatcatgtagtcttaaccttagaggactcatctggccttgtccctgtttccaccagcattccacaccaaacagaacacgatgtacagaggctgagattaggaatgagttggccagaatcacagaaggttggagtaggaaaaccatagtgaggttcttgtgaaggcttcctgattataggtgacccaacatccttgcttctgttgtaggatctggaaaggcattccactttctattaaaaccatccaattcctacttccttagattacatggcaagatgaaagggagtggattttccttaatgtgttggtgtgaagacattgaatctgattgcctttttaacacttgtacaatagcagtacaagtagtgtggaaaaaactgactctgttagtagtacttagtagttacttcaatggactggggctgtctttacagtaggaagacatcaggactctagaaggttggaaaaaattgacagtaggtggataagaagcacaaaaatagaatggggccaatcagtggatacttctgctttgtagttctgcccatagttggacctttgtcctagaggctagatgaaaagtctggttatgtttggaagctgttggactcctgtggcaggttgcatgtgtggggacaagactctgagacggagattgtgggaaaattcacattggtgttcttgggaataacatctcagagggcaaagggaatgtgattgggcagagggagaagttgggctctgagacaatcacaacaaaggcctcagccattcccacctagggctttcttgccagtaacagggactacaggaatgtgccaacagagctggccaatttttttatttattgtagagatgggctcttgctatactgcccagcctggtgtcaaaacttgtggcctcaaatagttgactattttagattcatcttgtaagtggtatcatggggtatttggcctttcgtgtctggcttatctcactttgtataatgtcctttgggttcatccatgttgtcataaatggctagatttgcttctattttaaggtaaaggatattccattatacatggatagaccacattttctttctccattcactcatcatggatgtgtagtttgcttgcatgtcagtgctactgtgaataaagctgcactgaacctgagtacaaatctcttcaagattgatttcaattccttctgatatatacccagaagtgggattgctggatcatatggtaattctagttttaatttgttgagaaacttctatactgttttctacagtgctcacaccactttactttcccatcaacagtgtctaagggctctttcctcacgtcctaaccaacatttgttatcttttgggttttcttcttttttctttttttttgagacctagtctcgctctgtcgcccaggctggaatgcagtggtgccatctcggctcactgcaagctccgcctcctgggttcacaccattctcctgcctcagcctcctgagtagctgggactacaggtgcccgccaccacgcctggctaattttatgtatttttagtagagacagggtttcatggtgtcagccaggatggtctggatcttctgacctcgtgatccgcctgcctcagcctcccaaagtgccaggattacaggcgtgagccaccgtgcccggcctgggttttttttttaaacagtcattctaacaggtatgaggtgatatttccttattattttgatttgcatttgcctaatgattactgctgttgagcacctctgcatatacctgctggtcattcttctttggaatcaatgtctattcagttttttgctttttttttttttttttgagacagagtctcactctgtcacccgggctggagtgcagtggcacaatctcagctcactgcaacctctgcctcctgggttcaagcaattcttccgcctcagcctcctaagcatctgggactacaaggcgcacaccaccatacccggctaatttttgtactcttagtagagatagggtttcactataatgatcaggctgatctcaaagtcctaacctcaggtgatccacccacctcggcctcccaaagtgctgggattacaggtgtgaggcaccgcatccggctctttgcctattttttaaattttattttttgagacagggtcttggtctgttgcctcagctggagtgcagtggtgcaatcatgtctctcactgcagcctctaactcctggccctttgcctattgttataataaacaggtcatctggttgtttgctattgagttgtaggagtttattatattttgtagatattaacccatgattagatttatggtttgcaaacattttctccctttccatgtattgcctttttgttttgttgatgtttcctttgctgtgcagaagctttttagcttgatgcaatcccacttgtctatttgtgcttttgttacctgtgccttcaatgtcatatccaagaagccactgccaaggccaatgtagtctattccctgttttctcctacgagttttacagtttcagattttagtttaagtccttaaaccattttgagcagatttttgtgtatagtgtaagataagggaccaatttttttttgcaggtgcatattcaaatacaattttagttgctaccactggaggatgtactagtagcatcaagtggttacaagccagggatgccacacaataccctacaatgcacagaatcgaaccctaccacttagaattattcagttcctaaaataaatgagtccgaggttgacaaaacggctgtaaaggagagaaaagtgctagatagagacatgggatcaagggaggattttatttttttcagagacagggtctcactctgttgcccaggctggagtgcagcagtgccctcatagcccactgtaacctcaaacttctgggctcaaatggtcctcctgccttggcctacaaaagtgctgggattacaggcatgagccactgtgcgtggcctccggatttttttttttcttttaaagggagacttgagcttgtttaaatgctgctggatagggaaatgggccactttatatactgtaagagaatggataaattggtagactcttttggagggtaatttggtagaatctgtcaaacttaaaatatgtaattccattattaggtaactattctattgaaatacttgcatacatacattaagatatttactcaaggcaaggtgcggtggctcacgcctgtaatcccagcactttgggaggccaaggtgggcggatcacgaggtcaggagatcgagaccatcctggctaacagagtgaaactccgtctctactagaaatacaaaaaattagccaggtgtggtggcgggcgcctatagtcccagctacttgggaggctgaggcaggagaatggcgtgaacccgggaggtggagcttgcagtgagccgagatcgtgccactgccctccagcctgagtgacacagcgagactctgtctcaaaaaaaaaaaaaaaaaaaaaaaaaccccaaagatatttactcaaaaatttttattttcagtcttctttgtaggaatgagaaatgggaaagaattgcattctgataaatagattaatggttaaacaaatcatggcacattcaaaccaaggaattttgtagccatttgaagcttgtagtgagcagtaaaattgccaacatacggtgagtgaaatgaagtcacagaacagtattactagtgtctatcagttatgtaaagctaaccaaaaaccgtgcatttacatgtgtgtgtttgctaatgcattttgatcaggatctggagcactgtatcaaagcatcataagtagactcccttttcactttttgttctccaatggctcagaattgtgaactctttacgggcatgtattttacagttttaaaacaattgttttttgttttttttttttggtggggtttggggagcagggtctcactctgttgcccaggctggagtgcagtggcataatttctgctcactgcaacctccgcctcccaggttcaagtgattctcctgcctcagcctcccgagtagctgggattacaggtgtgtatcaccatgcccagctaatttttgtatttttgatagacatggggtttcaccatgttggccaggctggtctcaaactcttgacctcaagtgatccacctacctcgacctcccagtgttgagattacaggcatgagccaaaacaatttttaaatactggggcaagatcacaatagaaaggaagagtttgaagacgtgagtgacatgggataaaggaggaggaagttccctgaggattagatgatggtgacagcagtagcagcaggagcaggtaacattcatttagagttgagatgtgccacaccctgctctaaatgctttatggatatcaagtccccttattctcactagaagtctggtagacatgattagtcaaggacacggaggcacagagaggtggagcaactccacagctagcaaagctgggattcaaagccaggcagtctggatgcagggccagtgctccagccactgccccctactgctggctgttggtgggatccagagcataggtgatggactggcctgagaggaggagggaaagctcattaaacctctggatcagtttgttgctgcattaacactttctcacaaatgtaaaagctcaaaaccaccaccactgattacctcacagtggtgtaggtcagaagcctgagcaggctcaactgggttctcgaccttgcatctcacaaaccccaaccgaagatgtcagcagaggtgggcttccatctggaggctctgggtaagaatatgcatccagaaccattgagggtggcagaatgcggatcttttcagctgtaggactgagagctccatttccttgctggctgttagtcaggaacctttgatgagagtttgctgcatccctcaccatgtggccccttcaactctaaaaccagtaatgatgcgtggaatctttcacaggcttggactctctgacctcctctttggttaacagccagggacaaatcgagttccagagggttctcatgatttggttaggaacacccaggtggtctccctttccttgtactggtaacacaatctagtcacaggagtaaagtgcatcctattaacagtctgaagattagtgggagaaatcatgatgccattttagcctgggtaatttataaagaaaagacacctgcctggctcaaggttctgcagacagtacgagaagtgtggtgctggaatatctttccggtgaggcctcaagaagtttacagtcacggtggaaggcaatgaggagccagcatatcacatggtgacagcaacagccagagcaaaagagggagggagaggtgccactcacacttaaacaaccagatctggtgtgaactgactcatcaccaaggggatggcactaacccattcatgagggatctgcccccatcatccagacacctcccaccaggcctcatctccaacactggggattacatttcatcatgagatttggagcggacaaacatccaaaccatatcagtaggatgtctgacattcatcatacgatgtctgagtgaagggaggtttaagggcttattttgtctccctggatagtaatggaaaatgtatatctgaaagagatgtctgaaaaagaaagtttaagtgggtggctagcacacttctggtttgctagtgggctttttgagctcagttctcatttgagtttggagatggatttgtaggggctctgggatttttcccctgtagtctgtctataggagcaaagcggaagattttgattgatgcttctttggggaaagctggacaaaaggatcacagatcaggggagatgacaggccaaagtgatgttccttggaatctaggctagaaacagaggagaaaaaaacagagtgagggaaaagggacgattcactttgcaagggctacaggggtggacggctggattccagttaaagcaggaagtggaagaaggcttcagtaagagggtagagatctagagcccaggttctccaagtggggtccccaaatcaacagtgtcagcatcatttgttagcaaggcagattcccaggttcacctcagacctagggaatggaaaattctggaagttggtgagtcgagcacaggaatctgcatcttaagcatgctagttgatttggatgtcttggaggtttgagaatcattgatgcagcatcttttgtgttgtataagaatgcttttatcatgaatgggattgcagagggacagtagccaattcctggaagaagaggaccggctgtacctgggtaagaaatgctgagcatatggcagaggacagatggcctgtgttctgcatgacaaggataagtgtaaggcaaggctgaatccactggccttacagttttcagaaatagttaagtcctggccattccaatctcaaccgattgttttcctgaggtggtattccgaggccaagaacaggagcattgactgatgagacttgaagaagggtcagtctgggcctggcttggctgttccttaaaaaggagggaatccaaaccccaggaaaagtggcagaaaatgggagtgagtttctgggaccctgactgagtgcctaaagcagcaagagaccagtgctagccacagagggacacacttgcctatgagcaagatccgcttcactttggcgcagcaaaggatagacttcctctcctccagctgcagacacaccctggcctcctgagatgcctctactgtggcctagtttcagctacaagagcacaggtgggctgtggtcaggcaacaggaagaggaagaaagggagggatggattttgggatgtggatacctgacctagtacacaaatccccctatattcctaaaccttttctgagtcagtcactctgtgaaaatcatgggactctggcagtagaaagcaagtgaagtagaatgcagccacagaagattttttattgttgttttaagaactccctagcccccaaatcaacaaatcatgtcaggtaaatataaatattttagccaaccagtggctctcgcctgtaatcccaatgctttgggaggccaaggtggaaggatcacatgaggccaagtgttcaagtctacactgtggagggcacaagctgtgggagggcctggaagacacgcctcagagattctcccagtcctgccaccctgtgggagacacttctaaggaatcgtaaactcatgtgaccagcagggaggacaacgatgaagaaactttcctgcctaaaatcagctgctgtccagagctagcacctggaaggagacactccctctcctggggtcacatcttcactgcaaggcgggtgggagctcactgctgtgacccacatatactcctctctcggcgtctctatcctgctactttctctgactgcatcttcctctgttccttggtcagtgtttgagaagagaatgttgaacaagtcacatccttgtcactctgagtcagaaccctcatttgacttggaagatttgtgcttccgttttttcttctttttcttttctttcttccttttcttatgcttttctttcttcttctttttcttgtgtttctctttaccttcagaggaactggagctgctcctatcttcacctgaggtagaatcctccagtaactgttttaactgctgtatcctaaacattcaaaattgatcaaagaacagtcagttttagctttaacttacaacagttgcttagataaatatgtcattcaaaagcaatatggaaggatcatgaataaccacatcacaaagacagtacttatttttatttttacctgttttctccattcttcttcacctgaatgcctatgtttatgtgactgtaaccagtgtacaaaccatttttgtattcttttccttgtcctagtcatttctgtaggttcccacagtacttacaattataaattctaacagacgcatactttactaaaccattccccaactgctcaatttcctaatagataatctacaccctcaacaattataatttaatgtaaccagtttgaaaaaacaaactctcctgattattcactctctaatcttgtctaggtataatctttaacaaaagctgagatccttaagacgttagaggagataaactgaattaccttgcatggtaccaattgtaccatgcaagtaaatagcacaacatgggtggctaatatcaactgcagtggtcagagaactggaccaagcctacagctttaagctaacccaaggaggaggaggctggcctgctgattccccaacactggtcttgtcagccatgactcctacccaataaatatttcacaattgaagtgccatgtttactatatcactctcctagtgctagaaggtttttttccaactttatataagttaaaactttaaatagatactatcaccaggacaacctcaccttacattcttttcatgttgtttattgtctcgtatgatgtcatacatgaaatcctcatgtgccttaagggacagagaaggttaaggtttggttaggcttcatggaccgttagttaaataaaattaaacccctatgttacagaaaacagtttttttttcttttactgtttgatgtagccacacgctcaacatgttttaatccttttaagggtcatatcactgataactcattaaggctataaaaataatttcccaatgagaaaatacacgaaataatattcttcatgaggaaataactgcataaactggaagagtcgtactataaaacagtactcaagtttagaaataccgaggtaattctctttgttctattgggttagaccaaaagatagtattaagcaaaataaatgagttgcaaaatgatacataggaatgatcatttataagtactcaaaaatacgtgttacataccccaaggaagtctggaaatatacacatcaagctatttgctgcaaacccactctcaggagggaggcaagattggacttggtggtaaaagcctgactatgaggtcttcattttgcttaataaggcaaataaactgtattcttgtattctataactgaaagtgacttaaaattcacaattatgggccgggcacggtggctcacacctgtaatcccagcactttgggaggccgaggcaggtggatgacgaggtcagcagttcgagaccagcctgaccaacatggtgaaaccccgtctctactaaaaacacaaaaattagccaggtgtggtggtgggcacctataatccctgctacttgggaggctgaggcaggagaattgcttgaaaccaaaaggcggatgctgcagtgagccgagagcacaccactgcactctagcctgggcaacaagagagaaactctgtctcaaaataaaataaaataaaataaaaaatcataattatgaacattatgcttatagagttgtataaattgatgttctgttatatccttagggtaaatttttagaagttgaatttctaagtcaaaaagaagtacattaaatttttgagatttatcaacaagttttgttttatactatctgtaaaaactgacatttcacctaaaagtgcttgatctagaataattatttttcagattaagacaaaaacacaaaactttaaacgccttaaaatgttaaaagaatgtctgttgacttcagtttcatatatagctggcccttgtatcctgaagagttacatgtccacagattcaaccaaggattgaaaatatttgaaaaaaaaaaaaaaggatggttgtgtctgtattacacatgttcagactcttttttcttatcattattccctaaacaatacagtttaacaacaatttactttttattcagtattataggtaatctagagacgattaaaatatataggagtatgtccacagcttatatgctattctactttcttttatttgacaaaatctcactctgccacccaggctggagtgcagtggcatgatcttggctcactgcaacctccacctctcaggttcaagcgattctcatgcctcagcctctcaagtagctgggattacaggcatgtgctaccatgcctggctaatttttgtatttttatttttttgagacagagtcacactctgttgcctaggctgcagtgcagtggcatgatctcagctcactgcaacctccacctcctggattcaagtgattctcctgcctcagccatccaagtagctgggattacaggtgcccaccaccacgcctggctaatttttgtatttttagtagagacggggtttcaccatgttggctaggctggtcttgaactcctgacctcaggtgatctgcccacctcagactcccaaagtgctgagattacaggcgtgagccaccgtgcccagcctaatttttgtatatttagtagagctggggtttcaccatgttggccaggctagtctcaaactcctgacctcaggtgatccacctgcctaggcctcctaaactgctgggattacaggcgttgagccactgcacccagcctataccattttatatgagggactttgagcacctgtggattttggtatcccaggggatactgggatccaattccccatggataccaagggacaagtgtatgctgatcacttcagtagatccacaaggcagcatatttcacttggcagtagttactgaacagtgaattaacacctctgggaggtgactctatgttaaagcggggaatgatagatagatgatgctaatgatagatctgtctaactgtcatttaagaggaaatatacacaattctagcttataatagacagacatctactctttaaaggctggaaaactaggccaggcgcagtggctcacgcctgtaatcccagcactttgggaggccgaggcgggtggatcacgaggtcaggagatcgagaccatggtgaaatcccatctctactaaaaatacaaaaaattagctgggcatggtggcgggtgcctgtagtctcagctacttgggaggctgaggcaggagaatggcgtgaacctggaaggtggagtttgcagtgagcaaagatggcaccactgcactccagcctgggtgacagagcgagactctgtctcaaaaaaaaaaaaaaaaaaaaaaaaaaagactgggaaactaaaactctgattttagttatgagacatgactttttatataataaattttaaaaaggggagttgaatagggaacaatgtcttcttcagaaaaagaatcactgtcccaatgtataagcaaagaacacgtttataaatgttagtttttttcttaaagagctaaatttgtcttacaaatgcaatttaacagaggtatagttaacagcagacgctttggccaaaaggcttctgggaatgtaatttatgtgaacattcagttcgctggtgactatcggattaattaatattcaccatctctgattaaggtaaaatgacattgtatggttttacttactactctgaactgttgtaacttttggttgtctttgataaagaaagggcattctttgtagcctgttcggtgaccataccatttgcaatgccaacctaaaagcaaagaaaaggggaaatatttctgtaagataagagtgtttcaccttagtgagataaagaatcagtagattatattaaagtttttattcattaaactccaattctaaaagaaaatgcaatcatggatgaaccgtgtaaggtcccagaaaagacaggtaaactaattgcttacccaagcatcctttaatcttgtgctttaggaattaattttccaacaccaagaaattatgaagcaatccaatgaaaagtactgcaaaaggtcaatttttttagtgtgtctcgctgtatttttcaaagtaaatatcttctattaatcaagtggctctgaatctcatttataaatttagtcactagaacaaataccttctttctcaggttgagtcgacatctgttcacatccctcacttttaagtaaacaaaatcacaagttcttttaaaatattaatgccatcagaaccctactgcaactttactttcagaagagggaaactgtgctatttaaagaggttaactattagaagcaacagaaggtcctgatgaggaactgggaggagaataacaagagaatgtatatacatgctccaaggcaacaaattccagtctttatggaatttcagtgagtggacctggcatcaggcattgacctctgagaaaaaggaagtggtgagtgaagcaagaatggatgagatccttgttacttctctcgcctgttcatatcctctcagcaccatctggatgtggtgtaaatcaggaaactgtatgggaatggtgaatgagaccctgtgtttgagtattaagcaattctaagcaactaggtcgggaagtatgaagagggatttaggtaagttcagccaagtttgctctatgctggcaactacagaaaatacgtagtgacagggcaagaaagtttttctctttttatttttatttgaggattgaatgcaggaaaccactgaaaaaaattaagtttgtgggttttttttttttttttgagacgagtctcgctctgttgcccaggctggagtgtagtggcgcgatctcggctcactgcaacctccgcctcctgggttcaagcaattcttctgcctcagcctcccaagtggctgggattacagatgcatgccaccaaacccagctaattttttatatttttggtagagacggtttcgtcatgttggccaggctggttttgaactcctgacctcgtgatcagcccacctcagccttccaaagtgttgggattacaggtgtgagccactgtgcctggcctaagtttgtggatttctattgattgcctgtgagctatccctatccttatctccctcaccatttaaagtttgggggagaaggactacactctttcaaactaatatgtgcctttatggcaaagctgaagggatgtgaaatgccatggaacaagcattgatgtatagatatccagaagataccatttccgctcaaaatcctcttattatggaaaggtgatcccagatattcaaagtgtggtccatggaccagcaaattcaacaatatgagcaaggttgttagaaaagcaaggtataggacccaacccagaaatattgaatatctagtattcagtattttggatattcaaatactggatattcagtatttctgggttgggcctgatatggacatataacctgaattttaaaagatttactggttatttgtagaaatatcaaagtgggagaaccacttttctaattaatactaaaattggtaaaatcaaaaccatgtgcataggtttgtaattaccttaacagtaattatattacatgcaaatggattaaacacttcaatcaaaaggcagagatttatagaatggataaaaatgttatccgccaggtgcagtggctcatgcctgtaatcctaacactttgggaggccaaggcaggaggactgcttgagcccaggagtttgagaatagcctaggcaacaaggtgagatcccgtctgtacaaaaaatttttaaaaattagccaggcatggtggcaagcacctgtggttccagctactcagaaggctgaggtgggaggattgcttgagcctgggaggtctaggctgcagtgtgctgtgattgtgccactgcactccaccctgggcagcagagaggccctgtctcaaaaaaaaaaaaaaaaaaaaaaaaaggaaaaatgctatccaagcactagatataagtgacacactgtagatttaaagacccaattaggttggcagtaaaaggatggaaaggaatatatgatgcaaacagtaacccaaagggaactaaagctgctccgataatttcagacaaaatacaccctaagacaaaaactgttaccagagacaaagaaggatattttgtattgataaaaaggtcaatccatcaagaagatacaacatttataaatatgtatgtaacctagcaaaagagtgccagatagttgagacacaaactgatagaattgaaggggaaaatagaacggtgtaacaataatagagatttcaatactcctcattcaataatggataaaacaactagagagaagatcagcaatgaattacaagacttaaacaacaatataaatcaattgaacctaacagttacttataaaacactctaccacccaacaataaacactttttgaagtcaatatggaacattatccagagaccctatattaggccataaaacaagaattaatataattaaaaggatttaaaccatacaaagtatattctctaactaggatggactcaaattacaaagcaacaatataaggaaatttgaagaatccagtatgtagaaactgaataacacatgcgtaaccaatccatgagtcaaaggggatgtcagaaaattaaaacacagcaggccatcgcggtggcttacacctgtaatcccagcactttgggaggccgaggcgggcggatcacctgaggctggaagttcgagaccagactgaccaacatgaagaaaccccgcctctactaaaaatacaaaattagccaggcatagtggcgcatgcctgtaatcccagctacttgggaagactgaggcaggagaatcgcttgaacctgggaggcggaggtcgcggtgagccaagatcatgccattgtactccagcctgggcaacaagagcgaaactccatctcaaaaaaaaaaaaaaaagaaagaaaattaaaacacaacatatcaaaatttacacaatgccgataaaatagtggttaaaagaaaatttatagcttccaattcttataatagaagaaaggtcttaatcaataatctaggtttttatcataaaaatcaggaaaaagaagagtaacccagaccaaagataagcagaagaaggaaataataaatgatgccattgcaggacctcaaaaacatgctaaacgaaaagagtcagatcacttatatatgtccagaaaagccaaattcactaagagagtagactaatcgttgcctagggcatcaatggggatgaactggaaatgggttgagagatcttaaggaggggatgaaaatgttctaacacttatttatgatgatggttgcacacacttggtagttactaaaaatcactgcattatacatttatttgagggtgattttgagtgatccaaaataaaccacaaaaatccttttttaaaaagccataaacacagaaggactgggaaaccataaaagagtcacatatgaaaaaacgtgggatgttataatgcagatagatgaatactaaaagaatagcagatcctagaaaactgaagtctaaggcagcagagggtagaatctgagaaccgactcagtttctacttgcagaacctccaaagctcagcaattggcagcaccagatacttctggaggtgaaggggcagttaaaatcaggaggattggttaaatgtccataggcaattctccttagtctgggcagaagtttgtttagcatgtggaaaaggtataacagaggttctctggccacggagacatcaggtgggtcttaaggaagttgccgcaacagacatagaggatcatacgaatgaatggaaaaccaatgacagatttcccagactccctccactcagctcccagaacactcacagcatggctttcccttccacgtgggagccttctctgggaaaatacaagccacccaaagaagaaaaatcaatagataactgaactcagatgttccccaaccaactacctagaaaatcaccctgcagtgggggatcaacaagccctactcaggcactcagggctaccaatcaacttttcatctttcactaaaaaacaagaatactgtggcagccactctctaaaatgaccctaattaataatcgctgatccctaaaaagaacacttttgtgtagtccctgctaccctgaatagggctaaactggtgtaagctaggatagtgcctatctgaagaatagaactgcagacacagaggtgagaaaagaatttttaaaattcttaaaattgagagacctgcattccagattgaaagggctcaccaccgtgaaattttagaacaccaggaatgagaagatgctataaacttccacagaagaaaaataaaaaacaaagcaatgataaaaggccttatgaaaagatcaaaaattggaattactttggacttcccaatagctattctagaaaatcaagaaaatgaagcaatgccttcaaaatctaaaggaaacttttaacttagaatgtgatatcctagcaaattaaaaaacataaaatgaaaattctaggggccgggcatggtgactcatgcctgtaatcccagcactttgggaggctgaggtgggtggattgcttgagcccaggagtttgagaccagcctgggcaacatggcaaaaccctctttctacaaaaaatacaaaaattagctgggtgcggtggtgcacaccggtagcccagctactcaggaggctgagacaggagaattgcttgaacccaggaggcagaggttgcagtgagctgagatcgcgccattgcactccagcctaggcaacaacactgaaattctgtctcaaaaaaagaaaaaaaaatcagccaggcgtggtggcgcatgcctgtagtcccagctacgtgggaggctgagaaatgggatgatcacttgagcctaggaggtcgaggctgcagtgaaccaagatggtaccactgcactccaggctgggcaacagagcaagaccctgtctcaaaaaaaaaaaaaattctacctcctataaacccatttggaaggaaattgccctaggattcattacaccataagaacagaatatagtaacaaagaacactccagatataggaaaatgggtgatccaacacaggagagaggctaaaggaacctgcagaatgatggtgtcttagtcaacttgggctaacgtaacaatgctgtgtgccaggtggcctaaacaacagaaattgattttctcagctctggagggttggaatctgagctcagggtcccagcaaggtaggtctgtggtgagagctttcttcttaacttgagatggcagccctcttactttgtcttcacatggcacaagggggtagggataggacaggagagagcaagagtgagagcgagaatgtatgtatgagcctgggcctacacaagagagagtgatctctagaatttcttctttgaaagggcaccaatcatatcatgagggccctaacctcatgatctcatttaaccttaattaattcacaaggccccatctccaaatgtcatcacattagagatgagggcttcatcattcgaattatggggagacccaaacattcagtccatcatatattggtaaagggagatgcctggatgatacgcatgggagtagccaccttcagtaagatgaaatggacagaacatctcaagtatatacattgaaggtcttaagtttgaagcttggaaaaatgttgaggttgaattacagatcagtacatggaaagcaaaaacaataataataataacaaaaactcaaaaacaataaaaacaggacacattttgagcggacacattttgcaagatacagctcacctctggtcataatcatagtaaataccaaagacttatttaactaagtttatgatataataattactgggaaaatgagatataaaagggtacacatgtgtggtgagagcaggagagagaactacatactcatcttccactgtacagaggcatcagaaaatgaccaaacttgaaaaatcatggagcaacaatgcaactatggggttaagatgtggagataaacatcaaaacaaccaactaaaaaagcttgactctttggaagattgatttttttttttttttttttttttgagacagagtcttactctgtcgccaggctggagtgcagtggcgtgatctcagctcactgcaacctccgactccctggttcaagcgattctcctgcctcagcctcccgagtacctgggattacaggcatgcgccaccacacccagctaatttttgtatttttagtagagacgaggtttcaccatgttggccaggatggtctcgatctcctcacctcatgatccaccgcctcggcctcccaatggaagagtaatttcgtacgctctcgaatgtgttaactgcaacggaggggcagggcatgcgcacagagagttccacctgtgtagacccatcctcccatggtagcttctctccgttacatggacaaagcaccactgatagagagtgcccaacagaggcaagacccaaaaagacccgttctctaatgcatccctcactcccatggcatttcctttctattactttctttacttcctattactttccagaaagtcctttctattacaggagtaacaccgaagagtgtactcccaaggcagtgacagtcctgagcaaagaatgctggacttggaatcaggaaccctagagtcaaagctttgctctacgtcttccctgggaccacttactgacatacacacatctgtttcctcatctagaagacagagaacatgccttggctctaagagggctgtggtgagaacaagttaaataaaagaagtaaacgcgctttgtaagttgcggcatgtaagttgcatggattaggggaactctcccacattcacactgcataactctgacttctttccccagtggcaaccaaagtcctttagttggtgcatgagccagaaattctctggcgtattcattgcctggtatatctggtatgctatcttctggcttagcctcatcttcctaaacaaagggaacaaggtgcaaatagcatggcaagatagcgctgggattctctcctgcttccctaggagtcaccctcacctggctttttcctggtctgtgggtgccaaggtcatcttaattacccctcaaaactagaaagaaagacagttacacttgatcgaaaaaaaaggaaacaaatgtaccagaagaactataccaaaaacaatgtagctgttcttagagaaaagttactggtgaagcagaaaaatctgtccttatatagcaatgactggtgagctccaaattttgatgtaaattagattctaaggttttttaaaaaaaggtttcactacctcaaaatgtagaatgaagcaagatgtatgaattaaagtaaaccaggcttcctggaataatagaaatggcatattatgctacaatagcttattataccctgaaggcccctatcatgttttacagtcgcatgcatgctgtaattttttcaagtttccatgaatattaaatttcaatagaaagatggtttttaagaatctttttttttttttctttgagacagtcttgctctgtcatccaggctggagtgcagtggtgcaatgtcagcccattgcaacctccacctcccaggttcaagagattctcctgccttggcttcctgagtagctgggattacagatgtgcaccaccacgtccagctaatttttttgtatgtgtgtatttttaatagagacagtgttttgccatgttgcccaggctgatttcgaactcctgacctcaggtggtccacctgcctcagcctcccaaagtgctgggattttaggcatgtgccactgcgcttggcgaagaatctttctccattgacagttacgaaacagcaagttttcttggccgtggcctgccactctaagtctccctcgtgcgcacacaccctggtgccgtagccaggagctgcaggaaggatgcctccaccggggagctggactggatgagctgtcgggtctcctcggagttgactgctctctgagctgctgatactcaagaaaccaacacaggatggactgagggactgagccaagtaaggctgacaagaaaaggaggcagctgagcttaaagatgccgttccccagtcagagagaagggggccacggccaaggaacccatgtgggcctgcactggttcctcagggaagggaaacatggctgatgaaatttccacaaaggcagaggcttgtgacaacactaaaaattatgacccctcagtcatctgcaggaaagaaacaggcttttcataaaagggcatttaaatgtcatgcaaccatttttcataatgcattactgagtctgtaagtatgtctagtgggataaccaagagtacaaacttcacactaaccttgataagcccaggaggaggtttttcataactggaaaacaaaaaacaaaaccatcaaccattttaatgggaacgtaacatacttttatgaacaaaagacagcagccaggtcagaataaaaaggagattcttagagaaaattcaaaactacattttagtatattatatctaaaacagttaataaaatatgctcagcattccagatcacatataaactgatgagataacacatcctgcagagatccagaaattatgttcattgaaataactaatgtctctcagcacaatgatcttatttggaggagaaaggaaagcaagaggttgcagggagagcatgaggtgagaagacagtgggtcctctggttccaaaacatcactgtgtttttctcaggttactgacctagcataacatccatgtactcaacactgaacaggctcctgggggaaaagagtgcaatctgttccaacacagtgtgggggcacagcggaggatgcacagagctgcgtggacaggcccgtcccagaggcaccctcacccatgggcctgcaacgccagctccaattccacccgcccgcccgcctgcctgccaggtttacagatgttgaggccaggacacagcaccccaaaaatgactgcacagcaccagaatatgccaccctaaaatatgcttcattggcatattaattatttcaagctgattactttgagaaactgcagacaaggagtagccctgaagagctgccattttgtaagagaaatttacatcgattatataaagcaaatttacattagtaataaaggagtttgtatcaggaaaggagctgctcccagacaaattttattacatgaaagacttttatctacataaaaaggcaaactttattcaccatatgtttcctcccccatcctcccataatttatttctacccctcccccaagaagccccaatcccctgttcctttctgcagctgaggatgctatataaggttcctctggtgcttctttgagtctcatacttttgtgggactcccatacatagagatataattaagatttttttcctcctgttaatccatcttatgttcatttaattcatagcctacccaaagaatttagaagggtgtagggaagccatttttccttcccccgcacagacaggtattacctgggaagagcagaacgcttctcctccctgtgctaggtggcacctgccaccaaagatgggccaggacttccttatttccatccagggactgaacccgagggagacccagaatgctgagcacgcaaagtctgtatctgggacaggcggcgagatgcgaaggaaattctgcaggtgaggtgttcgtgcactcaaagagcaactcgggctcttagagggattcacacctcccccaaaaaagtaagacaaatatttgtagctcagatctgtgccttaaccctctaaacctacaaggaagtactcattttaatacttcagaatggctgcaaagtataggaatgcttaatgatttaatgttctcttcatcctgaaccattccttatgaactgattttagagacccttttggaacacagtaaatactggaggagggagggattaaggggaacagactaaggagaaagtgaaatgctttcccttccattcgcctccaaggtgtcagagaaaaggactttgccagagtacagatgagaaatggcacaggtcgctacagcaagaaagatttccctttggcttcatctgtggacactgtcaaaggactcctctcaccctcactatcactgatccatggaataggagaacctactccacaaagattacatagtaaacaactgggtagtagcggagttagctttttaggtatgatacagtgcttttccaaagtaaatacttaaaatatcttctaatggaaagctgtggtgtgtcataagcaagaataatggtaagatgatacagacctcctgcagccatcctttagaggtgttaatactatgccttggccgctcacgcctgtcatcccaacactttgagaagctgaggcaagaggatcacttgaggctaggagtttgccatcagcctcggcaacatagcaagacctcatctctacaaaataaaaaattaaaaaaggctgggtgcggtggtttatgtctgtaatcccagcactttgggaggccgagacgggcggatcacgaggtcaggagatcgagaccatcctggctaacacggtgaaaacacgtctctactaaaaatccaaaaaaattagccggacacagtggcagacgcctgtagttccagctactcaggaggctgaagcaggagaatggtgtgaacccgggaggcagagcttgcagtgagccaagattgcaccactgcactccagcctgggcaacagagcgagactctgtctcaaaaaataacaaataaacaattaaataaaaattaaaaaatattatgccttatgcacagaggcctaagagagtttggaagggaggtggtaaagtctatgaaaatatccaataatccaacaaataattatttttgccacaggagctgaacaaacaacatatggccaaactaagttccaaattcctgaaaaatatgtaactatattgcctagatggaaaaggaatgtgatagaactgcacattctgaattctattattatttgcaatggcatttcctaaatagtccattttacaagagttcccaccagtttaagggggggggggcgctgatgcttttttccctggggctaaacaattcattagtttatgtagcatgttaagatatttccaaagtttaaaataatattcagccaggcatggtggctcacacctgtaatcccagcactttgggaggctgaggtgggtggatgacttgaggtcaggagttcaagatcagcctggccaacatggggaaaccccatctctactaaaaatacaaaaattagctgggtatggtggtgcacacctgtagtcccagctactcgggaggctgaggcaggagaatcgcttgaagccaggagatggaggttgcagtgagctgaggtcacaccactgcattccagcctgggcgacagagcgagaccatctcaaaaaaaaaaaaaaaaaaaaaaaaaaaaaagcaaatgaataaaactcaggctcttattaactactttaaaaatacaaaataaatcataggtcactatttgatgcaaaagtgaatgatattgcaaagtaatacttatgttaatattaactactaatttagcaaaaattattataatatgactacataggaaggaaggagacaagggtagtaaaacaactaaaatcttacctactctgtcctcagttgaatagctgtaggagaccagaatatgctacctcaaagcacacctttttggctaaggatcattttgagaaacagcagacacaggggaagctctgaaaagagagccgaagtcacccttttgtaagacaaatgttcatctataaagggaatctccatttcaggtgagacccttttttttttttttttgagatgcggtctttctctgtcacccaggctggagtgcagtggcttgatctctgctcactgcaacctctgcctcccggttcaagcgattctcctgcctcagcctcttgagtagctgggattacaggtgcgcactatcacgcccggataattttttttgtttttagtagagacggggtttcaacatgttgctcaggctggtctcgaactactgacctcgtgatctgtccaccgcggcctctcaaagtgctgggattacaggcgtgagccaccgctcctggccacaggtgagaccctttctatataagaaagagaaaaatgtctctcaatcacaagagaatgctaacaacggggaaagcacagacacaaacctgcataacaaaccttacctttatttatcatacttttcttggtcactatcccatagctcagttcccccatatctttctttctttgatttagctgaacatggtatttaagcctgaatccaaaaccacttcttcaagatttttcattccactgggtatctcccatgtatatagaacatatacatggtaataaacttctgcttgtttttttctgtttgtttgttggagagagagtttcgccctcatttccaggctggagtgcaattcaccgcaacctccacctcccgggttcaagcgattctcctgccacagcctcccgagtagctggaactacaggcgcacgccaccacgcctggttaatttttgtatttttggtagagacgcggtttcaccatgttggccaggatggtctcgatctcttgacctagtgatctgcccacctcggcctcccaaactgctgggattacaggcgtgagccactgcgctcagcctttttttttttttttaagatagagtttcactcttgttgtccaggctagggtacaacggcacaatcttagctcaacgcaacctccgcctcccgagttcaagcgattctcctgcctcagcctcctgagtagctgggattataggcatgtgccaccaggcccggctaattttgtatttttagtagagacagggtttctccatgttggtcaggctggtctcaaacttctgacctcaggtgatccgcccgcctcagcctcccaaagtgctgggagtacaggcgtgagccactgtgcctggcaatgcttgttttttttttattattaatcttctgttacaggggccctggaccttagaagagtggaaggaaaaaaactttccccttaaatagataatgtccattacggaatcaaaaaaggcaatataaggctgggcatgggggctcatgcctataatcctagcacttgggaggccagggtgggaggaatccttaagtccaaaaccagcctgggcaacacagctagaccctctttctaaaaaacgaggaaggaagggaggaagggagggaggaagggagggagggagggagacagtgagggaaagaaaggcaagaaacatgattttaaaataaacagttacagccttgcgcagtggctcacacctgtaatcccagcactttgggaggccaaggcgggtggatcacaaggtcaggagatcaagaccatcctggctaacacggtgaaaccccatctctactaaaaatacaaaaaattagctgggcatggtgatgggtgcctgtagtcccagctgctcgggaggctgaggcaggagaatggcatgaacctgggaggcggagattgcagtgagccgaaatggcgccactgcactgcagcctgggcgacagagctagactccgtctcaaaaaaaaaaaaaatagtaataataataaaataaaataagcagttatgtcccagatgaaaaaactaagtttcctcacagaagtcttgataggggagaggggtgcagagaatatatagggtaactggagtctcaaaccactatttttttaaattagccttttcttatgagttcacttgagtcaagaaaaaaaaagcctttggtactatttgattaaacagtttaaattacatgaagtattactctggaatgaataacatttgatttaaaagcaaacaagtctctgaactagccaaaggaaacatattgacagtccagtcagttgcaaatctctgaaactagaaaaccccagtgctctgagaatcttagcccatattatgctgatataacggaatacctgagactgggcaatttacaaggaatggagatgtatttcttatagttctggaggctagaaagtccaaggtcaaggggctagcatctggcaggggatttctttgcttcatcatcccatagcagaaggcagaagagcaagagagagcatgggtggtgatggacagcaaattcatgtttttatcagaaacccactccagcaataactaatccactcctaacagcgcctatccacttataagggcagagccggctgggtgcgggggctcacacctgtaatcccacgactttgggaggccgaggcgggtggctcatgaggtcaagagatggagaccatcctggccaacatggtgaaaccctgtctctactaaaaatacaaaaattagctgggcgtggtggtgtgcgcctgtagtcccagccacttgggaggctgaggcaggagaattgcttgaacctgggaggcggaagttgcagtgagccgaggtcacaccactgcactccagtctggcgacagagtgagactccgtctcaaaaaacaaacaaaaagggcagagccctcctgacataatcacatcttaaaagtcctctctctcaacactgttacattgggtattaagtttcaataaatgaactttttgagacaagagtttcactgtgttgcccactctgaagtgcaggcctgatcacagttcattgcagcctcaacctctcaggcttaagtgatccttctacctcagcctacagagtagctgggactacaggtgcacattaccatacccagctaatctttatttttattgtagagatgggttctcaatatgttggccaggctggctggtctcaaactcctgggctcaagcaatccacccacccagtcctctcaaagtgctgggattacaggcatgagccactatgcccagctctccaatacatcaacttcgaggacacattcaaaccatggcagaagtaaacatctggttttgctagtttataggtctatattacttagctggtgaggttccattttatcatttgcaaaagcaggttataatctctctgctgtctaggagctacaaaataaacacatggtattaaccactgtgtggcatcctacagctaaatatactgagtgttgggcagggccaggccctgcctgcagttatgctagagaaagatctttaaacatctgtcttccatgggagaacaagagcaccacccggttacttgaaaaggccgaaatgcccagtaatgtggatgcccacaatgcagggtctccaacctgcaaccactgccctgttaaggtgaaaagtcattcagctcttgggccaccaaaaagtaggccagactccaccaaaaaactgcattttgtatgcaatctcccagaagtctgattatgaaggattttaactccttgaggacctttccttacatgacccacatagcataggtaacaaaaagtgcctgtgacagaaacaaactgttgactgagtgaacatcacactatgtcaaccccccaaaaagaaaaacgaaggcaaaattaatgtcagtagagttcatttgagccaaatttgaggactgcaagctgggagtatctatttaagttgcccggaatatacactcctgggttgcagtcctcaaacttggcccaaaataaactctatacttatattaatttagcttcagttttttcctttgggtcaacatatctggcatagttggcagaataggtccctccctccaccactgcccagtgtttctctctgaaagcggcacttggtaccaacatgaactcctatctctgactttcctaaggtcaggggatcaggatttttatctgccaacacatgggtcttaagtcgccaatttactttggtttggggccaaggtcttgttgcattgtgacctttcattatggaaactgtgcttgtttcaccctggaccaacctctcttggagtcccttttcctaatttatgagaatgaatacttccctccgaagattaaaggcactcactccctctggcccattagggaactctaaataatcagagacttggcgaggtgccaggactttgtccataacattcagtggccttacagggtttcctctgtgagaacatctgtaccctctcaccctgccagtgagtgtgcataaaggctggtcatcttgcatttgtgagtcctctgtgaccttcaggggattcagcgtttctgagacacataagagaggagacctgacttactggtgacacaccgaagtgatacactcacaagcggcacatttaggcccaaaacactgctcagagtcatgaatgattcaggtctctaaattatgggtaacaaatcatccgggtctgaggactccccaaggaggcaccctccctcggagacaccagctggttttatgtgcaatacctgctgagtttcatcttataagtatttgcacacattggcccacatgactcgagaggaccccaaattatgatggccaatataggggtcctttgaaaggcctaaagtaattcaattttctgcacaattgggaaaagctgggtttagaaccagacaaattaaatgggaaatctcctttctgtttgccctggctgaaatctgctcatgagagatataaaaaaatttttttaaagagctgtgtggtcggccgggcgcagtggctcacgcctgtaatcccagcactttcggaggctgagttgggtggatcatgaggtcagaagttcgagactagcctgaccaacatggtgaaaccccatctctaccaaagatacaaaaattagtcagctgtggtggcgcacgcctgtaatcccagctactctggaggctgaggcaggagaatcacttgaacctgggaggtggaggttgcagtgagccaaaatcatgccactgcactccagcctgggtgacagagtgagactccatctcaaaaaaaaaaaaaaaaaaaaaaaaaaagctctgtggtcagagtcagctgcttaattaaaggctgacattcaggctataattttttttttttttttttttgagaactaaaaaaggcccttctgctttttctcttttcgatcttattcctgataatatttttcagtcgactgaaaccccttttaaaaaaatgttggaggccactgtttgcttcctaccttgttggcattattttggttgagaaaaatgtaaaacttcattggccttttagaaagcttaaaatctcccaaactggcccctctaatacttaactcttccatttccttccacttctgctccttctcccttttgccatcttgaacacataggagacttctggcactcctgagaccccttgagtacacggaaaaaggggccatgcccacccttttttggggtcttcagtctttctcatggaatctaagagtcatgagtaggcttctctcaggtctgtggctctgctctattttgcacggagtttctggatctctggcttttggagtatgaggtattactttgtattgtggtggagaacttgacattttcatgtgtgatggctggcaagtcactggcaaaagctgcagttttggaagtggctgacagctgttgcagtgaatggtcactactgaaggaggcaacttgtttctttgcctgtttagatttaaaaggtgtgctttgaacacttgaagactcctgtgggagagaggctgactgcagagtggactgatggagtcaggtcgcccaccagcctctgtgaaatgtccttgtattgaggaaaactgtggaaagaattcacactggttcagtcgtatttccctcttcttggggacctgggattcaatgtaaaagtagaatccttaaattttaaagatctgaatgttctgcctttcagctgtgcctgcttttcacatatttaaatattaggccctgaaaactgcaacttctttcactgtcctattcattaagaggctccatcctgaagtcagaaatctcattaagaaacaatcgatctggctcacgcctgtaatcccagcactttggaaggccgagacaggcagatcacttgagtatgggagttcgagaccagcctgaacaacatggcgaaaccctctctctactaaaaatacaaaaattagctgggtgtggtagcaggtgcctgtaatctcagctactccagctactcaagaggctgaggcacgagaatctcttttttttttttttttttttttttttttttttttttgagacggagtctcgctttgtcacccaggctggagtgcagtggcaccatctcggctcactgcaagctccgcctcccgggttcatgccattctcctgcctcagcctcccgagcagctgggactacaggtgtccgccaccacgcccggctaattttttgtatttttagtagagacgagatttcaccacgttagccaggatggtctcaatctcctgacctcgtgatccgccggcctcggcctcccaaagtgctgggtttacaggcgtgagccaccgcgcccggcagagaacctcttgaacccgggaagcagaagttgcagtgagctgagatagcgccactgcactccagcctgggcaaaagagggagactctgcctcaaaaaaaaagaagaacaagaagaagaagaagaaacaatctatcaaactaaatcagttgacaaaatgcaacttcctgacatttagctggctactttgaaactctgtttaaaaaaaaaaaaaatagtcttgctctgtcgcccaggctggagtgcagtggcaggatctcgactcaacacaacctccgcctccaggttcaagcgattctcgtgcctcagcctattcagtagctgggattacaggcgtgcgccaccaagcctgtctaatttttatatttttagtagagacagggttttgtcatgttggccaggctggtctccagctcccgatctcaagtgatctgcccacctcagcctcccaaagtgctgggattaagggcgtgagccaaaggcgcccagcctgaaactctttataaaagaaatctaccgccgggcactgtggctcaagcctgtaatcccagcactttgggaggccaaggcgggtggatcacctgaggtcacgagttcgaggtcagcctggccaacacggtgaaaccccatctctactaaaaatacaaaaaaaaaaaaaattagctgggtgtggtggcacacacctgtaaccccagctacttgggaggctgaggcaggagaatcatttgcacctgggaggtggaggttgcagtgagtcgagatcgtgtcaatacactccagcctgggtgaccgagggaaactccgtctcagaaaagaaaaaaataaaaaaaagaaagaaagaaaaaaaaaaaaagaaaaaaaacctccttttgtaagggcatctccctcggtggacctaaaccactagaaaatttcaggatggggaagacattggtttaaagtttacataacaaacggtacggtacctctgtttaaaatacttttcctggtaattttaaccagtttgtaacctatgcctttctttgtctcagcaaataattctgtttaggtacaagttctgtgtcttttagatgtaaattttttactttgtttcatctaatagtcttttgaaagtgcaagcttagggttgcctagctactaattacttagggtagtggaaaagataatcaagagactgatcctctaaagtggacgatcactaagtggaggatcactaagtagacgatctaactggatgatcacttcagacgatcatctgaagtgggcatagactattagaaaactggctaatgaagaatcttataaaagatctgcttctgtttgtctgtatgcctatgtttatatgtgttacaggcatgtgacatttcattaccaaaatacatgaaaaagctcaaattaattggcatcaaaatatgccaccctgacatactgatgactctgagctaaaagaaacagaaccagccaacacaggaaaacttcacctcgccggcaactgctccccttttgtaaagagaaatttacatctttaaaggaaatttccatgagtaaacgtatctgtatcagaaagagagctgcctggagacagcttttatcacctgggagcctaacaaagcaacctttattcatcatacattttgacccttccataatttgtctccaccacgccccaaaaggcccatgctcctattccctggcccttctttcagtctcccacttttgtggccctccagtgcatgggtatgtaaaaatagtttttctcttgttaatctgtcttatgacaatttaatctgtggcccagctaaagaacctagaagcgtagggggaagccatatctccctcccccacctttgaatcttctttacaccacactctcccgggtcatctggaccctccttgaactggagccacgggagcgcaaggcctcccaagtcagggcccgaattccgcgtggtgccaaacggcagctggctccctgaatgcccaccctgaaccctggtaaaaaataaaaaaaacaacaacaaaattccctccaacccggagaaaacaagtccgcctctgttctacctagcagcgccgtggccagtccccgccgcccattctctcttcttccgggcctcgccacaccaacactgcaggacccgtgtcctcgtcccttctccgtagcagaggatgaaaagaacggggtttctccatgtcgcagtggcccagggaactcagaggtggagcgcgggggcagcgtgctcggttgaacttgcctgttcggtccacaaatgccgagcaagcgccaataactcttggcttccccaaaagaggcgacgcccacaccaaagcgggggcgaggagcgcaagccgctgccgcctccccgggccgaggcccccgcccacccgcgccgcggcctccagggcccctccgtggccgggcgggcctcgctccccacccagtgaggactagaagtcccgtcgcaggcactaggttcctcacaggcccgcacccctgcctgggtcctgggggcttggaggacccagcccagcgcccaacacggcgccgggcgcccctgttcccagaaaacgggcggcgcgcggactgcggcccagacggctgctcgagactcacaaggactccaggcgcttgagctgctgcagctgctgggcgtcgtgccgccgccgcttctgctcccgggcccgctgcagttcctgatccagcggctcccgcggccaccacgcgcccccagccctcgcatcctcgcgccccggccaggacgacatcgcggcacctgcggcgcggctctggctgcggccaagagggcacttcctccgtgcggcgccccttcccgccgccgccccgcgactcgcccgggaggggccccgaagtcccggcctcggccgccagatgcccgcctgcccgcggccggccccaagtcagtgcgcagagccccagagcccagccgccggtgggcggggagcgcccgctggcggcggctggagccgaggcggggcggggccctggttgggagcctggggaagcttccaggagcttcagggttcccgccaggccacactcatctccctgcccctttgaggttcccgaccgaggcaaggggtcttgtgcaagtcaggtttgtagatccctagtgaccagacccacgggagctgctcattacatagcaataggattcagccatttttggaagaaagcaatactctgcatataaattctccaattttcagatcatatgatccatgcttaaaacatagtcaatgtatattgtatttagcaaggtataggttctggagatgaaaataaaagctaccatacacagcacttgttatgtaccaatcagctaaacccttaataagaatgtctttaatcttaaacttgtgttattaccacccttatagtgatctacacattcagtgcaatccctggcaaaatcccactgacttttttttttacagaaataggaaaaccaatcctaaaattcatatggaatctaaacggacaccttaccctgggcctcttacttgttttgcagcaagtaggtgcaagtaggttaatgtggcatattacatttattgatttgtgtgtgttgaaccatccttgtattccaggaatcaattccatttggtcatagtgcattaccctgttaataaggtattcaacctgttttcctaccattttgttgagaatttttgcattaatgttgataagtgatttgggggtgtagttttcttataatgtctttgtctggctttgtatcagggtaatgctagcctcaatatgagataggaagttttcctttctctttaatttttttggaaatgattgaaaagaattggtgttagttcttttttttttttttttttttaagacagagtcttgctctgttgcccaggctggagtgcagtggcgtgatctcggctcactgcaagctctgccccccggggttcacgccattctcttgcctcagcctcccaagtagctgagaccacaggcgcccgccactgcacccagccaattttttgtatttttagtagagacgggattcaccatggtctcgatctcctgaccttgtgatccgcctgcctcagcctcccaaagtgctgggattacaggcatgagccactgcactcggccaaactggtgttagttctttaaatgtttggtagaattcaccagtgaagcaattaggtccagagcttttctttggtggtaaattttattttttatttatttttagagacttgctaaagtggctcatgcctgtaatcccagcactttgggaggctgaggcgggcagatcacctgaggtcaggagttcgagaccagcctgaccaacatggagaaaccccatctccactaaaaatgcaaaaaattagccgggcgtagtggcacatgcctgtaattcccagccactcgggaggctgaggtaggagaatcgcttgaactcgggaggcggaggttgcagtgagccaagattgcgtcattgcactccagcctgagcaacaagagtgaaactccatctaaaaaacaaaagaaagaaagaaaaaaaaggcaataactacagttacaaaccattgttacaatactaggttttataattacccgactatttatctttattgagatccttatttcttcatatagcttctgcttactgtctagtgttcttttatttcttctttttttaaatttatttttgtctcatttttccaagaaaatctcactctgtcacccaggttggaatgcagtggctcaatcttggctcactgcaacctccgcccccagggttcaagcgattcttgtgcctcagcctcccaaatagctggaattacaggcatatgccaccacgcccagctaatttttgtgtttttagtagagacggggtttcaccatgttggccaggctgttctcaaactcctgacctcaagtgatccacctgcctcggccttccaaagtgctgggaatacaagcatgagccacggtgcctagcctagtgttcttttatttcagcctgtggaactcccttgaacatttctttcagggcttgtctaatggtaataaacttctttggcttttgtttatcttgaaatgtctcaatttgtccctaatttttgaaggacagtcttgctcgatataggacatatgattgatggtttttccttttagcaatttgaatatattagccatgtgccttctggcctctaaagtctctgatgagaaatctgcacataatctaattatggatcccttgtcagatgagttgcttctcttgctgctttaaagatactctctttgtctttgtctttcaaaagtttgactataatgtgtcttgttgtgaatctctttgagttcatcttaattggaatttgttgaacttcttggatttttatattcacggatttcatcaaatttgagaagttttggccattatttatttaaatagtctctgtgcccctttctatttctttcctgtttcctggactcccacaatgcataaattggttcacttgataatgtcccattggtcccttaagctctgttcacttttccttcccttttaacttaatttttgttgttgttgttgttgttagaaatgaagtctcactatgttgcccaggccgatcctcagcaatcctcctgcctcctgagtaactggaattacagtgtattacagggatagatcatggccaattgcatggagattgtccataagagctggccaattttatgattattggaagacttgcatcaggataaatagctgctttttttcccttttagaacatgattcttcttggataatacgttcacattaattttctatgaagtgccactctttctgaaattcttttgtgattctatatacaccaacagcattctctgttttcgcatcttctgtgccatgtttctatgttgtttgaggtatacagaaatccgttccacatgcactcatatacagaccacaaatttagtggagacagtatcactgaacagcaacaccattgcataagtgtcttcgttgttgttgttgtagacaggggatctcactatgttgcccagactggtctcaaactcttgacctcaggtgatcctcctaccttggtctcccaaagcaatggaattacatgagccaccatgcctggtcacataagtgtctttttatccttccatacacataattatttttgaaccagtgagaaacttatctggcttcttcaggcaaatgaagctttaattaagaaaaaaaaaaaaaacaactcctggaatgtcatcagccagaaggaataccaatgcaggaaaatgatgtggttttgttgttgttgtttggttttttgttgttattgtttgtttttttcttgagatggagtctcactctgttgcccaggctggagtgcagtgacatgatcttgactcactgcaatctccgcctcccagtttcaagcgattctcctgcctcagctgggattatagacatgtaccaccacaactggctaatttttgtgtttttagtagagacagggtttcaccatgttgaccaggctgatcttgaactcctgatgtcaggttatctgcccacctcggcctcccacagtgctggcatcacagatgtaagccaccatgcctggcctttttttttttttttttttttgagacagagtctcactctgttgcccaggttggagtgcagtagcacaatctcagctcactgcaacctctgcctcctggcttcaagtgattctcatgcctcagcctcctgagtagctggtactacaggcacacaccaccactcctggctaatttttgtatttttaatagagatgaggttttgccatgttggctaggctggtctccaactcctgacctcaattgatctgcctacctcggcctcccaaagtgctgggattacaggtgtgagccacagcacctggccctctttttatatttttatattttctatattttttatatttttatatttcttaaaaaggtgttcagttagacaataattttagctatgccaaggctggagtgcagaggcacgatcacagctcgttccagctttgaattcctgggctcaagcaatcctcctgcctcagccaccccaagtgctgggattataagcatgaacccttttatttaattcctttagggtaaaagaaaagaaagaaattgtccagccataatcagtgaccttagagtcagcaagcaagtagtctaaaaatgttaagatataattttgtgctgaaaccaattgagtcaggtttctctcacttgcaattgaaagagttttgactgattcaaatatttgccttgttagatatacaacaacagtgatttattttctcaccaagaagacccagggatcaatatttccacttaagcaactatgcatcaaggctcttttgaaaatagcaatggaccaaaatccaaatcacgctgttttaaggaaaaaaaaaaggaatttattggctcacatatgtgaaatgtccacgggtgaagcttcaggaatgactgtatctaggtgctgaaattatacagtcagcactttctccctctctcagcctcaccttcctttgtattgatttattctcatgtaggttctctcattgtggtggcaaagatggacactagaaggcatagatggccaccaatttagcagcctccactgaaagaaatcttatttccaaaaaacttaaactatgctcattgactcagcaaacatcacgtagctctgaaggaaaaaaatcactgtggtcagagagatgcggtgctcttcatagcagcagtaggcagacaaatgcctaggcagataggggcaggtccctggagaaaccccacctacaagctgaagacagtgtaaaacctgaaagccaagctataagtcaaatctacggatgagattgagaatctgtcttcccatttgacatgctttcctctgattgattctccacccttcacctattttacatatacctaccctttcctaattggttttctacactgccatacccacctttgaggggtgcttttgctttagcctttctttgcgtactcacaaaccaatcagcatgcacttccctattctgagctcataaaagccccagactcagccacactgagagagaaaccaaccgacgggggaggggggtgagcaggaggccacctctgcatcccctctccgctgagagctattccattgctcaataaagttcttctccaccctcctcacccttcaattgtcagtgtatccttattcttcttggacatgggacaggaacttaggaaccactgaatgtgtgtacatgctgtaacacaggagagctgaggcacacctggcccagccacggactgagccaatgcacaagccagacttggctcaggcagactgagtaggcagggcacctcctgcagcaggtagcatgcctgagcaaggcccaggtggcagtggtaccagctggaggtccctagctggcaaaatgactgagaaaaatcctgcgtcactctggccaagcctaggttacatgcctgccataattaccaggggtggaatcagctttacccctgtcatgtagactgacagtggggaaggggtagttctggaaaccaaaatcaatgtgctatgacttaaacagagagagacagagacagagacagagagatagagagagaaagacgggggatgctgggatgctgggtaggaaatgtgcagttcaataatctgacaggatctgcattctagtcatctcttcttgataattatgttcacctaaaagaaagaagctgaggcaaaattaatataagttagagagtttatttgggccaggcttgaggattgcaacctgggggcatagattcaagttgtcctgaatatgcactccaattagcagcagttaaaagtggattttttttttttgagacaacatctcgctctgttgtccaggctggtgtgcaatggtgtgatcatggctcactttagtctcaaacctcctgggctcaagcaattctcctgcctcagtctcccatgtagctgggaccacaggtgtgtgccaccatgcctggataattttttaatattttgtagaaatggagtccccctattttgctggcctcaaactcctgacctcaaagaatcctcctgccttagcctcccaaagtactgggattacaggcggaagcccccaaaaccagccaaaagtggatttttgaaagtaaaaaggtgggggcaggtagtaggctgatacaaagttgtttgtcaagaattctcactggcttacaaaattaacattgattagtgattagctatacattatttaactatagggtgtgggttatagtgtcctgtgtgacattattaggttaatttattgctacttgttgcaagagcaagtagtttcttttctttctttttttttttttttgagatggcgtcttgctctgtcacccaggctggagtgcagtggcgcgatctcggctcactgcaagctccgcctcccgggttcatgccattctcctgcctcggcctcctgagtagctgggactacaggcacctgccaccatgccggctaatttctttttgtattttttagtagagacagggtttcactgtgttagctgggatggtctcaatctcctaacctcgtgatctgcccacctcggcctcccaaagtgttgggattacaggcgtgagccaccacccccagccaatagcaagtagtttcaagagatgaatacatagttcaaggggaaagtagaatgtgatttgtgttttacttcatgtctgtcttagcctgataatttaaaagaattggcattcccgatataagagtttttttcttttcccaatttgtgtcttagagctgataaagcagtgaaaattctttttgcctttatttccacctgtttatgtgaatctaggttcattacatattttgacaccagactgagaagtttttttgatggtgggatgtgatggctcatgcctgtgatctcagcaactttgggaggctgaggtgggaggactgcttgagcccatgaggtcaagggtgcagttggccatgatcaccatccagcctggtggcagagtgaaactgtttgaaaaaacaaaacaaaacaaaaaacaaaaaaagaaaaagaaatgtattactcacattttgaagcttttggggagagcaggtcaggtgcctcagccagtccaaaaatggcttcgacaaagcaaaagcaagtggccctgggattactgcagttaggggtggaacctgggtgagcattcctgcacaagggcccaggttttgtgtggcttgaacttccgcctacagtgccaagggaaggagtgcatggggtttctattggcttattcacatgtggggcagagggaaccgtggaagtggagcttgaaagttttcagtggtagaacaccaaaaatgcagtcaggttcttcattatatggggtcacctctcaaatccagcccagttttctgataccaagagattcgatgcaataatatcccgtccattaaccaatggatggttatggaattctttccctggtgattacaactttaaagcatttttttaacccatcatcatttagtttatgcctgtttcatctggaaggttgtgcaggcacagtccatttccagagagagagtaaagtgattgttagccaaccataaacacatatggaggcacccttcacattgtactgtggcacctagcctacgcaagtgaggaacacttctgtttgtactctctcgctgtcgtattctcctgtccatgagcccctcggtttgttttttagtttgttcttctgcccgtcctaagataccagattcattcttgaggccagccaggcggccttggtgttgacccaatagtggtggggcagctgcacgtgatccttagcctgtgttactggacaggtgtcaaacctttaaagtaaaaacaaaatcctaaaccctggctgggcctggtgcctcatgcctataatgctagcaatttgagaggttgaagtggaaggatctcttgagcccaggagttggagaccagcctaggcaacatagtgagatcttatctctactaaaaattttttttaaaaaattagctgggtattaactttgaaatttactgcttttggtcaaaatacactcttcagctaatgctttcttccagctggttgtcttgttgcctgccctgtgctgtaaaatgagggtcccttactgcattatcaaggggaaggcaagactgggacatctagtccaccggaagacctgcaccactgtcgccttcacacaggtgaactcagaagacaaaggcactttggctaagctggcggcagctatcaggaccaattacaatgacagacatgatgagatccgctatcactggggctgcaatgtcctgccagatgttcaagttaagagatgtcaagggcgttgttttttgatatgtggcagaagacaatctgcatcttagaacaaagcccatatacaaacatgcagaaacaagaaatggagacagagcatgtcagcaaacagccatattggttctagtgattcctgaactcctcctaggaggggaaacctggccacttctttgaattggatacaacccctcaattgagtgaaaacctctggtattcctcaaatgattttttttaattccctatgtgaaatttggagttctgttacttggtatcaaaaaacttggccgggcgcagtggctcacgcctgtaatcccagcactttgggaggccgaggcgagtggatcacgaggtcaggagatcgagaccatcctggctaacacggtgaaaccccgtctctactaaacacacaaaaaaattagccgggcgtggtggcgggctcctgtagtcccagctactcgggaggctgtggcaggagaatggcgtaaacctgggaggtggagctcacagtgagccgagatcacgccactgcactccagccagggtgacagagcgagactccgtctcaaaataaaaaaacaaacaaaaaacaaactaaaccaaaacaacaacaaaacaaaacaaaatcatgcatctctttaaatgctgtaacaatgtacttcattgtcttaattttcttttctttttttgaggaaaattgagaccttttattttctgagaaacaatctatagattggggaggtgcagcctttggtacaagtgaaagtacactctctattttcttttcttttttatttttgagacagagtcttgctctgtcacccaggcttgagtgcagtggtgtgatctggactcactgtcacctccacctcccaggttcaagtgattctcctgcctcagcctccccagcagctggaaatacaggcgtgtgctaccacacctagctaatttttgtatttttagtagagacagggtttcaccatgttggccaggctggtctcgaactactgacctccggtgatccacctgcctcggcctttcaaagttctgggattacaggtgtgagccaccgcacccagcatattttattttcttgattactagtgagggtgaatatatttatttgtatttcctcttttctgaagtcttcacctgtgtattccgacttcagttttgttgtactgctgcataatataccaccccagagtttaaaaacaacaatctaatatgcttacaaattctgtgggtcaggaattttggcaggatatagcagtcatggctttgtctgctacattatttttactgctcaaatggctgggctgacttgaacatatggcagatggctaatccaggggctgctttactcacatttttgctgcctatgctgggatggctgaggtatgggctcaggtgtgaatgtcaatcacagagtctgcctgtgacctccccagcatggaggactctaggtagtgggacttcttacagggatcaggacttaaggggcaagtgttccagtgaaccaggtggaaacaacatggccttttataatctagcccagaagtcacggcccaccagttagactgtattctattggtcagcacagctgcgggcctatccagattcaacaggataatcataaactccacttctaaatgggaggagcctcaaagaatttcaggccaacacagatggggtgttcacttatgcttacacatttgttttgtcatatagttgtaagggtttttttgtttgtttgttttgagacagagtctcactctgttgcccaggctggagtgcagtggtgtgatctgggctcactgcaacctccgtccctggggttcaagtgattctcctgcctcagcctcccgagtagctgggattacagatgcctgccaccacgcccagctaatttttgtatttttagtagagacggggtttcaccatcttggccaggctggtcttgaactcctgacctcatgatccacccgcctcagcctctcaaagtgctgggattacaggcgtgagccaccatgcctggccgtaagttgttttttttttttttttttttttttttttgagatggagtcttgctctgtcgccaggctggagtgcagtggtgcgatctcaactcactgcaagctccccttcccgggttcacgccattctcctgcctcagcctcctgagtagctgggactacaggcgcccgctaccacgcccggctaatttttgtatttttagtagagatggggtttcaccgtgttagccaggatggtctcgatctcctgtcctcgcgatccgcccgcctcggcctcccaaagtgttgggattacaggcgtgagccacagcgcctggccaagtatttttttaatttatcatttgtctttaaaaaatttgtgacattttttaatagcaagattttttttttcttttttgagacagagtcgtggtatgttgcccaggctggacttgaacttctgggctcaagagatcctcccacctcaggctctcaagtagttaggactacaggctcctagatcctgccaccacgagcagacattcatttttattttattttatatatatttttagacaggctctcactctgtcacctaggctggagtgcagtggtgtgatcacaattcattgcagcctccatcttctaggttgaagatgatcttccacctcagcctccgaagtagctgaacggggactacaggtgcaggccgccctgctctaccttttttttttttttttttttttttttttgagacaaagtctctctctgtcacccaggccaattgtgcagtggtgaaatcatggctcactgcagcctcaacatccagggctcaagcgatcctccaacatcagcttcccaaatagctgggactacaggcacacaccaccacatctggctaatttttgtttggtttttgtttttctttttgagacagggtatcactcagttgcccaggctggagtttattttttctgtaaagtagtgattacacctatgaccttatacagagttgtcatgaagattggacttcttggcatctagttcaaaagatcaagtttcaaatcccaagtctttaccaattaatatgtattgtatgtttagcgtctgagcctagaaactaattcagcaccaagatatttccccaaattgccgtaagaggtcagtaggcaagataagtatcatctgttttacagtcaagggtggaagtaagaagttacctgacttgcctgaagccacggagacataagtgaagcaaagactggaccaaagtatatgtgtagtgaatgaactgaatgtctgaattcatgccaataaaatgtataacaatttttattatcaatgattatatacttcaaaatcaaggtattgtttgacaacacaaagatgacatgcaaaagtactttttggtggtcagtgccattaatagacttaatagactacaatcagaaagttttttcttttttttttttttttttttttgagatagagttttgctctgtcacccaggctggagtgcaattgtgcgatcttggctcagtgcaacctctgcctctggggttcaagcgattctcctgcctcagccaccggagtagctgggattataggcatgcaacaccacacctagctaatttttgtacttttagtagagacggggtttcaccaggttgcccaggctggtctcaaactcctgagatcaagcaatctgccccccttggcctcccaaagtgctgggattacaggggtgagtaatttttgtattttttcgtagaggtggggttttgccatgttgcccaggctggtctcaaactcctgggctcaagtgatactcctgcctcggccttctaaagtgccaggattacagaagtgagccaccaggccctctgtttgttttcaaaatcagaggtagatgttgaattttatctcatgccgttttgagtctatggccacatgatcttagagctttttttcccttcttctgtcctataattttattaataggtgttctatttctagaataagctctaagatgaacaatgaacatttttcttgttattcatgtagtttctcattcgatccctgaaacctaagattatagtaatcttataatgattgttttatcttcatcttacagagaacactgacattttgttaatttacagaagctcacctaggtagcccatgtaatggtatatttttcctttaacataccgttttttaaattttttatttattttttttttgaggcagagtctcactctgtcgcctgggctggagtgcagtggtgcaatttagtggcacaatctcggctcattgcaaccttcgactcccaggttccagcaatttttctgcctcagcctcccaagtagctgggactacaggccgtgccaccacaccctgctaatttttgtatttttagtagagccagggtttcaccatgttggacaggctggtcttgaactcctgacttcaggtgatccaaccacctcggcctcccaaagtgctagggttacaggtgtgagccactgcgcctggcctaatatgcggttgaatccgattttattacgttttattcagtatttttgcatttatatttataaattagatcgtgccctgttttttcagttttatttttcttttttgttgctctctttgccaggttttggtatcagaattgtgtttgcttccaaaacgagttgagaaagagttggtgatttgctttcattattccaaaattttaataaattataacacccaattccaattccaagtgcatctgattactctaatggattcctgtggcttctgggtctctatgatgaagtcctccctggcataggctcgtatatgggagcttgtaggatgtctgcaagtatcagctcacagtgcggccgctgatggcttggaggaccctcacggtgccttaaaacttttgcctagacaagtgtcacgggagcctctcgcaatacatgcctcccttttctttttttggagacagtgtctcgtactgtcgccagggctggtgtgcagtggcgcgatctcggctcgctgcaacctccgcctcccgggttccagcgattctcctacctcagcctcccgagtagctgggactacaggcacgcgccaccaagcctggctaatttttttgtatttttagtagagacggggtttcatcatgttggccaggatggtctccatctcctgacctcgtgatccgcctgccttggcctcccaaagcgttgggattacaggcgtgagccacggcgcccggccttccttttcctttaagcagtattaaaaaaaaaaaaaaaaagtcctgaaggatggtttcggtctctttcaaggtagaccatacccttgtaactaagcttaaaaaattaaaatctaattttccctccctctccaaagcagcaagggaaaattggatccacggccacgtaggagcccctcacggcaccaaacccggtgtctccagggacgggcggagaccagcgggtgggcttgggcagtacgcgcttttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccaggtaccgcgcccttggcgcccggcgcggcctcagcggatgcgcgtccctctctccggacaggcctttccctcctgccggacctcccctagctccgccccgtgcagccgcgctcctcccttcttccgctgcccagatcctcccggaccccagaccctccgccgcgggtgagcctcccggccctcacgtgccctaggctgccagccggggactggacccttggaggaccttgagcagcggggttggggcagaccacgtcctccctttcctcccagcgcatggacacacgcaaaatcagtgtaaaataatcagtgtaagtggaggccacgttgcacaactggacccccaagagtggatgttcgtgcctgcctctcttcgccctttcctgttccttccctccgctcccttgggaatctagtcagatggtgcttctcacacagaacaatgatgaagaggctagcagccccaaacatacaatgagctgttaacaatgtgtaggtgtagttctaagtactttccatattgtagtgaactcatttaattgtacagcagtcttgtgaggtaggtactatcactaccctcattttatcagtaaggtaacaagcaactgcggctaagaaacgtgtttaaacaatggagtcagattgtttaatccaactccagagtctgtgtgcgcaactaccactgcccttcctttcctgccatacaaaaacctctcttggggctgggcgtggtggctcacgcctgtagtcccagcactttgagagaacgaggcgggaggatcgcttgagcccaggagtttggggctgctgtgagctatgatcgtgccattgcactgcagcctgggagacagagagagatcccatcacaaaacaaaacacaacacgacacctctcgtgggcaggaggtagtccaggaccgtcactctgctttataccaggccctatatcaagcccagaactccttctctcagctctgcctcaggatcacagcactgctctcccgtttccctccagtttaggttcggggttaacaggcctctcttcgtccagcaccaggctactcctcgccaaggcttttgttacaaaccctggtctgtgccagcacttcccttcgcgaacactagatcaggcagagagagctatttgttgagcccctgctatgtgccccaaggcctagggtcattacgaatattttgtagactcttgacttttttgaagttccagacaatgaatatacaaaagctgttcagcatagtatgtggcactagcaagcgcttagaaatggtcattcttactaccattttagttactttaaaaaaaaaaaacaacaggccgggcgcggtggctcacgcctgtaatcccagcactttgggaggccgaggcgggcggatcacgaggtcaggagatcgagaccatcctggctaacacggtgaaacccggtctctactaaaaatacaaaaaattagccgggcgaggtggcgggcgcctgtaatcccaactacgcgggaggttgagacaggagaatggcgtgaacctgggaggcggagcctgcagtgagccgagacgtgccactgcactccaacctgggtgacagggagactccgtctcaaaaaacaaaacaaaacaaaaaacaaaaaacgaaacaaaaaaaacagctttattgagatataatgccatacaatttgcccatttggtgtgtacaattcagtgttttttagtatattcacagagtagtgcaaacatcacaactagctatttccagaacattttcatcacccccaaaaaagaaacgctggacccattatcagtcactccccaaccccagttagactgccctccagtccctttcagccacgaatccactttatgtctctatggatttgcctcttctggacattttgtataaatggaatcatataatttgaggtgctttgttatttatttataattggcttctttcatggttcatttacggtgtaaggtatatcagtacttcattcctttttgtggctgtatatgtaatattccattgtgtccattcatcagttgatggacatttggattgcttatactttttggctatcatgaatgatgttatgaacattcatgtgcaaggttttgtgtggatgtaccttttcctttttttggatatatacctaggagttggaattgctgcgtcctatggcacctatgttataaacgttttgaagaatagccaacctgtttccccacaatggctgcaccattttacattcccaccagcagtgtatgaaggttcatagttctccacggtctcaacaacacttgtacttgtctttttttttttttttttttttgagatggaattttgctcttgtcacccaggctggagtgcaatggtgcgatcacagctcactgcaacctccctgcctcccgggttcaagcaattctcttacctcagcctcctgagtagctgggattacaggtgcctgccaccacgcctggctaatttttgtatttttagtagagacgaggtttcaccatgttggccaggctggtcttgaactcctgacctcaggtgatctgcccacctcggcctcccaaagtgctgggattacaggcgggagccaccacgcctggcctgtgtctttgattataaccatttagtgggtgtgaaatgatatctcattgtggtttcgatctgcatttctctaatggctaacgatgttgagcatcatatgcgtattgaccatttgtgtatcttctttcatgtgcttctttcatagggaagaatttcttgcttgagttgatggtaattaattccagtagaacaagttgtcctactatctagaacatctctagggctggcagccactgtgaggtagtgtagggcagttgaaagagcatggaggatctaccatccattcatcaaacgtttttcagcgtctatccctcaagagagagactagtcctagtctagtatgcttcttccccatccctaccacttacagcctaggctattacaacatggtgtgataagtacagtaagacagtagcacacactctgtctctcatagagttcacacatagttcttaccatgtgccttcacatatgttaactcatttaatcttagaataatttgtttaacttctcaagacagtgaggtaggtacctcattacaaatgaataaactgaggctcagaaagttcaaatgatttgcccaaggaacataagtactaagtggttgagtggagatttgaacccaggtagttcatggccataatctatggtctgtagtccacccatgtatatgacagaagaaaggtaagtagctatgaaagcacagagaaggtttaactatatatttttgtgtctgtgtgtgggggaggttaggatggaatcctggtatggcagggataagacccaaggatgatgaaaattcacctgggaggagctcaggggtgtgtctgcagaccccaaggtccaggcttgtcttttgataaatattattatgtgcctaccacatacctttttgggtatacagagttctagatgctctagcacagtagtgtttaaactacatatacttctgaatcacgtagagagcttgttatacagtttccgattcagtagctctgggatagggcctaggaatttgcttttctgacaagttcccagctgatgctactggtctgaggaccacactttgagaaccactgctctaaaacaggggtactgaaatgggatatcaatttacaaaaataaataaatagtaaataaataaatagaacaggggtccctaacccctgagccatggacctgttgtggtctgtggcctgttaggaaccgggctgcacagccggaggtgagcagcaggtgagcaagcaaagcttcatctgtatttacagtgtctccgcattgctcacatcactgcttgagctcggcctcctgtcagatcaggaggggcattagattctcacaggcacatgaaccctattgtgtactgcacatgggagggatctaggttatgtgctccttatgagaatctaatgcgtgatgatctgtcactgtctcccatcacccctagatgggaccatctagttgcaggaaaacaagctcagggctcccactgattctacattatggtgagttgtataattatttcattatatattacggtgtaataataatggaaataaagtgcacaataaatttgatgtatctgaataatcccaaaaccatccccccaccccggtcatggaaaaagtgaattcctttcatgaaactggtccttggggccaaaaaggttggggaccactgctctaaaagaatcacagactcagccaggcacggtggctcatgcctgtaatcccagcactttgggaggccaaggcgggcagatcacctgagggagttggagaccagcctgaccaacatggagaaaccccgtctctactaaaaatacaaaaaattagctgggtgtggtggcgcatgcctgcaatcccagctactcgggaggctgaggcaggagaatcgcttgaacctgggaggtggaggttgcggtgagtcgagattgcaccactgcactacagcctgggcaacgagagctaaactccttctcaaaaactaactaactaaataaaagaatcatgaactcaataacaggggtcaacttcattttgtatattcattcatttattcattcttttcttttttttgagacagcgtctcactttgttgcccaggctggtgtgcagtgatgcagtctcacatcactgcagcctctgcttcctgggttcaagcaattcttgtgcctcagccccctgagtagctgggattacaggtgtgcaacaccacacctggctaatttttgtatgtttagtagagatggggtttcgccaccttggccaggctggaattcatttattcatccaacagatatttactgagtaccaactcttgcaggtgccaaggatgtaacagtgaataaaacagaaatctctgccctcatggagcttacatactagtgagaggacaggcatactcttaagttatatggtaaagtagaagttggtgaggactatggagaaaaagcagtaggagtgaggggtgggagggtggggcgacaggctcagaaaggtgagaggacagtggccacccagctaatataactgaccttcagattctggactggggagctctcatgcctcacacaaagcagccagcatgcagtgagtgccttgtgagtattatgcatagatacctctacccgttccagggaaggaaggatttcttcttgctgaagccatatgaaaggctttgaggaggagctgatgcttgagttgggccttgagcatggatgggatttcattccttgaagcggggagtgtgtttaagagagtggatggggtggaccagagtctgggcctgagtagtgcatgctcaaggaacagtgagaggctccaatatttgggtcaggaggcaggggacctggcactggaagggtgtgggagaacccagtccttgggaggcctgggtggctgagctaggtgttgtggactttggtatttttttttttcatcccatggattcaagttgccctgaatatatgcttctgttcagaatcttgtgaagggaaggtttttgttcagaggagtaaggggattgaggtgctcagtggatggactgatagtgtaagtagaaattctagagatcagcctcattggggcttcattttacacagggattcatccagcttctaacattccaggtactgggatacagcggaggataaagctgacaaaagtccctgccctcaagtcagggttggggtgaacacaagcccgtcctgcagacttaagcagaaaggagtgggaatttattggaaggatctccaattccttgtgagggtccagaatcatggactgaggtgactttctgcctctctccaaggggttgcaaacggggcttcattctctcccactagaaaaagagtgctccaataagctccccatgctgcacacatgacctctgggatccagcaccagcgccgacaaactggactttctcacttctaggtttccaggaaataatctgatgggtcctgcttggggcaggtgtctaccctattgggtgttaagtcacatggtcctaagtgggggcccaggctcaccctttcagcaggactggtccacagggaagagccagtaggctggacagcagccaggatgcagtcaggggggcctgacagggtcagtggtgtcagaacaactggccaggtcaggacatgctaacttaggagttgtttagagtgtgactgcacattgcagctctttttatggagaaggagagtgctgaaacggaggctgctaccgtgcattagccctgtgcgtttctgctaactaggggaagatcctagctacttctcactgtggtctcctgaggccattggcagctggccaagcacccctggtgaagacttattagcgtggctttgaattttcatttgtgggtcattgcgagcaattacacatttatattaacaatttaatttggctgtatggtattttactgggctaagccctgtgaaaaatgggaatcatctatagggatctgacattttaatttgtgcagttgcttaaaaacaaaaatccataacagcaatggattttgctttgctttgcaaagtttttcatttaatgatgttttaatgggtcaaagcccatccaagccaacagctcatgtttcagggtctgattctctgaggagctatgaatggaggcgttctctttcatttcttctctgttcccgcttgctccctctctcctccctcacctcctctaaccttcctcctctgcagcgttctcacactttcccgtctgggtagtttgccagttcattaactgcttttcttttctccctggcatgtctcattagctactggtagagatggctgtttgagggaaatagtcttaggcaaagggtccagaaagcccagagtcccctttgggagtgaatgtgtggagagggaggtgttaggcagaaaagccaaactctgcctccctgctttcaagtctgcagtaagatcagtctcagtggtgaaactcagccagcagagggggtgagtctcagctgggagctaggcggccagtggggaggtgagtttcagtcccattcgtgaagggtggtggcaggaccacagtccaaacgtcaagcaggtcccctgtgagtcagccatctgagttggcccaagtgagacaggaccaactttgaggcccccaaagggtagttcccgtgcccagtggacttgttcttccttactttgcctcccttctgttatgggttctcaaaatatggcagtcttttttttaatttctttctttttgagacagggtctcactctgtttcccaggctggagtgcagtggtgctcacagcaacctctgcctcctgggttcaagcaattctcatgcctcagccacccgagtagctaggatcacaggtgtatgctaccacacctggctaatttttgtatttttggtagagacaaggttttgccatgttgcccaggctggtctcgaactcctgagctcaagtgatccacccgcctgggcctcccaacgtgctgggattaccgcttgagccaccatgcccagcctgtcatttgtccttttaaaagctcgttcttattgcagatttaaacctacatttagaagccccattctgccttaagaatatagccgtgggggccaggcacggtggctcatgcctgtgatcctggcactttgggaggccgaggcaggtggatcatgaggtcaggagttcaagtcagcctgaccaacatggtgaaaccccatctctactaaaattacaaaaattagctgggcgtggtggcgtgcacctgtaatcccagctactcaggaggctgagacaggagaattgcttgaacccgggaggtggaggttgcagtgaaccaagattgcaccactgcactccagcctgggcaacagagcgagactccatgtcaaaaaaaaaaaaaaaatatatatatatatatatatatatatatatatgtgtgtacagatatatatatatacatacatatatatatatagagagagagagagagagccatggggggctgggcgcggtggctcatgcttctaatccgagcactttgggaggccaaggcaggtggatcacctgaggtcaggagttcaagaccagcctggccaacatggtgaaaccaaatctttactaaaaatacaaaaattagctgggcgtggtagcgtgtgcctgtaatcccagcttctagggaggctgaggcaggagaattgcttgaacatgagaagcagaggttgcagtgagccaagatcgtgccactgcactccagccttggtgacagtgagacgccatctcaaaaaaaaaaaaaaagaatatagccatgaggatagttatttatctcaagtaatgtgttgccaatataatgtgagcttttgtgtaggcagtttagtgtgttgactatgatgtctcttgtcttagtggtccttgggttaataattttaaagagcatcatcagagggtgctacagacaactttcccatcacccccctggggcagtgatggaaggggataaaaacaagctgatggagagaaaaggagggtgttggatgtgctaggtggtttccatttgcctttctaggtccacccttcacctgttccatttgctttttgctctgggaggctgacatgtatggactacatgtgcatagtatgggttgcattaatgactctttgtcttctggctttggttgggttcagccattgggacattgtgataagccattcctgcatcactggaaagaaatacccaaggctgggtaatttataagaaaagaggtttaattggctcacagttctgcaggctgtacaggaagcattgcatgctgtcgtcagcttctggtgaggacctcaggagatttatagtcatggtggaagggaaaaggggagcagacatctcacatggcaagagcaggagcaagagagagggtgggaggtgccacacacttttaaacaagcagatctgtgaactcattcatcaccgaggggatggcgctaagccctcccaccaggccccacctccaacactggggattacatttcaacatgagatttggcatggacacagatccaaaccctatcaggcatcagatgttcaaagcgagggaagagagtgaggtgaaggtatgtattcctctggcttcctgtctgtagggtcaccatggattgtggccctaaactaaagggcccggttcctgtcaggtaacccctagctgccctctctgtctctgtcattcaagctcaggtgtgatagcagcattccccacccagccacagaggtactatcccttgtgttttgctgtgttctgtacacacctttgcacacacccactttgttattactttaaaaaaaccatcaaatttaccattgtaactgttttgaactgtataatagtgttagctatattcacactgttgtgcaatatatctctagaatttttccatcttgcaaaattgaaactttgtgcccactgaacaacttctctgcatttttccttcttccttgtccgctgataacaacattccactttctgtttctatgagtttaactactttagatacctcatataattcgtggaatcatgcagtatttgtctttctgtgactggcttatttcattttacgtaatctcctcaaggttcatccatattgtagcatgtgataggatttccttcctttttaaggcggaataatatttcattgtgtgtgtataccacatattttttatccatttatttgtctatggacatttagattgcttctagcttttggctattgtaaatcgtgctgagttgaacatgtgtgtgcaaatatctgagttgttgttttgtttttgttttagtttagacagagtggtttttttgttttgttttgttttttgagacagagtttcgctcttattgcctgggctggagtacagtagtgcgatctcagctcatcgcaacctccgcctcccaggttcaagtgattctcctgcctcagcctcctgagtagctgggattacaggcacccagcactatgcccagctgatttttgtatttttagtagagacagggtttctccgtgttggtcaggctggtttctaactcccgacctcaggtgatccacccacctcagcctcccaaagtgttgggattacaggcgtgagccaccgcgcccagcttagacagagtcttttgttctgttgcccagggtcgagtgcagtggcatgatcacagcttactgcagccttgacctcctgagctcaagtgatcctctcacttcaacctcccgagtacctgggactacagtacctttgcaccaccacacatggctaatttttgtgtttttgtaaagatggtgtttcaccaggttgcctaggctggtcttgaactcttgggctcaagcttcaaccttggattacaggcatgagccactgcgtccggcctgattctgttttcagttcttttgggtatacaccaagagataggattgctagatcatacagtacttctatttttaattttttgaggagcctacagaccattttctagagcaagtacattttgcattcccatcaaagtgcacaaagattccaatttctccatatcctctccatcactttttattttccagttttttgatagtggccattctaacaagtgtgtgtgaggtaatattgcattgtggttttctttttctttcttttttttttttttgagacagagtttcacttttgtcgcccaggcaggagtgcaatggtgtgatcttagctcactgcaacctctgcctcctaggttcaagcaattcttctgcctcagtcccctgagtagctgggactacaggcatatgccaccatgcctggctaatttttgtatttttagtagagacggggttttgcctcagccccccgagtagctgggattacaggcatatgccaccatgcctggctaatttttgtatttttagtagagacggggttttgccatgttggccaggctggtcttgaactcctgacctcagttgatccgcccacctcagcctcccaaagtgctgggattacaggcatgagccaccatgcctggcctgcattgtggtttttgatttgcatttctctgctgtttagtgatgtggagcatcttttcattcgcttgttggccatttgtatatcttttttggagaaatattcattcaatccctttgctcattttaaaattggattattttgtggtcgttgagttttaggagttctttatatattctagatattaatcccttatcatatatgaggtttgcaaacattttctcccattttttaggttgcctttttactctgttgattgttttctttgctgttcagagttttaaagtttgacaaagtcctctttgtctgtttttgtttttgttacctgtgcttttggtgtcatatccaatccaatgtcatgatgcttttcccttgtgtttttttcctagttttatagttttggatcttatatttatgcatttaatccattttgaattgattgtttcctatggtataaagtaagaatctccaactttattcttttgcatgtggagatccaattttcccagcaccgtttattgaagagaccatccttacccactgtgtagccttagcccttgtcaaagatcatttgaccatataggcaaaagtttatttctgggctattttgatctattggtctatgtgtctgtatttgggtcagtaccatgctgccttgattatgatagcttcataatatgtttcaaaatcaggaagtgtgaagcctccagttttgttcttctttctcaggattgttttggctctttagagtccttcaagattccaaggccaggcaccgtggctcacacctgtaatcccagcactttgggaggccgaggcagtctgatcacctgaggtcaggagttcaagaccagcctggccaacatggtgaagccctgtctctactaaaaatacaaaaattagccaggcatggtggcgggcccctgtaatcccagctactcaggaggccgaggcagaattgcttgaacccgggaggcagaagttgcagtgagccgagattgcaccactgcactctagcctgggcgacagagtgagactctatctcaaaaaaagaaaaaaattccgtatgaattttagtttagtttttttttttctatttctgcaaaaaatgccatcaggattttggtaggaattgcattgaatcaatagattgctttggttagtgtggacatcttagccatattaagtcttcccatccatgaacgagaaatgtctttccatttattcgtgtcctctttaatttctttctttctttttttagagacagagtctcgctctgtcgcccagactggagtgaagtggtgcaatttcggctcaccacaatctccacctcccaagttcaagcgattctcctgtctcagcctcccgagtagctggtattacaggcatatgccaccacgcctgtctaatttttgtatttttagtagagacaggtttcaccatgttggccaggctggtctcaaactcctgacttcaggtgatccgcccgccttggcctcccaaagtgcagggattacatgcatgagccactgcacctggccctctttaatttctttcagcaatgtttttctagtttccattgtagtcttttgcctccttggttaggtttaatcctaagtatttcattcttcttgatgctattgtaaatagaattattttgttcatttccttttttaagattgttcattattagtgtatagaaatgcatctgattttggggtgttgattttgtatcctgcaactttgccaaatttgtttattagttgtttttttttcccccacagaaccatcaagtccaatgtttattagttttaacagctttttttatggactcttatagggttttctatatataaagttattttgtcagttaaaagagatatttttacttcttcctttccaatttctgtgccatgtatttctttttcttgcttaattgctctagctaggagttccaggaccatgctgaatagaagtgttgaaaccaagcatcttttccttgttcccaatcacaggggaacacctttcagtttttcaccattgattatgatctcagctgtgcacaaccccattattaaactttcctggaacagcttcgtttgggtgtgtcatctgtttcctgcaggcccctgaatgagatgcctgtaaaaggtgtaaataagccagatcccaggacaggttgtataaatgcttactccagagtgtgcagaagtaattttcatgaccagttctgggcttgatgctgcccatgagtttgtgccatttgtgctgatcagaataaatttgttcagaacaactttatttttccagatggtcagaattttaagcagtagataagactggtcttgcattgttagcctcttatataaatgtatacattttctttcagaaagattttttggtttttagcactttggtgcttaattgttcacagtgcttaggcgacatcaaatgaagaagttaatactgtgaggcaacaactctttctttcttcctttcttcctttctttcttcctttcttcctttctttctttcctttctttctttccaggatctcactctgtcacccaggatggagtgccagggtatgatcttggctcactgcagcctctgcctcccaggttcaagcgattctcccacctcagtctcccaagtagctgggaccacatgcacataccgccatgctcagctaattttttgtatttttagtagagatgggatttcacaatgttgcccaagctgggcaacaactgtttctatacacctctagggatgccctgaccctggagtgtgagattgagatggtcctagattcttgcttttttccctcctcatgtttaatttcatgagcttgggaaattttgtaatctccaaagagcctgagtatcatagcacccaccttgaagtattgtatgaggattaaatggtgtagtatatattgaagagcttagtttgctactgtgcccaataaataatagatactctgtaaacagtagttagtattaaaaagttttgttaaatttaggaagtatattctggttctgtgaatgaaaaaaatatttttaaagtagtttcttgccggtgcattgttgctgcttgcctgtgttctgtgcttgggagtctttgaagtcttgctttctggcccattattataataaatctgccagtttgatgatagcttagtggcagggcgagtccccagccaagtgtaattcaagagcaggcattccagggggtggggattggggccccggaggtagagggtggaggtgtaaagctgacttgggcacacaactggccatgtgcttttgtcctctggcttgttggcctgtacttgaaatcttgctttctgttcactgaccttgaagaaaggaaacttattaaaataggctgtaaaactaggaggagagggagaagagggccaggtctcaggaagctgccctgaggggagtggtgaggtggactctgttgctcgcccaaactgttcattagggaaaaagaggaaaaagtgaaaatatgttgcaaaatgaagggtgacgcattctcatgaagtaaatcccagcagctcttaacattttattacataattaattacattatcattttgaaaagtaagataattaaagagaaaacaaattcagtcacctgaagtcctctacctgtagatgatagataatatttcatgtattgccttgtggattttttcatatgcatctatatatgtaagttgaaaacggagtgattttatactgtgttaacctgttccccccccaccctttttgagacaaagtttcactctgtcacccaggctggatgacagtgcagtggcaccatctcagctcactgcaaccttcacctcccaggttcaagcaatgcttgtacctcaggctcccaagtagctgggactacaggtgcacaccaccacgcctggctaattttgtatttttagtagagatggggtttcaccatgttggccaggctggtctcgaactcctaatctcaagtgatccaccgtccttggcctcccaaagtgctgagattacaggcatgagccaccacgcctggcattgtaacctgccctttactcttattgtatatatccctccgcgtcagtgagtaaaaatctgttataaaatgccatagagcattttattttatgtcttctgaaaccctgtgggtctctatcagtatataaggtacttgtaggcaaagtccatgccttgtactttatatcccccaaagcacctggcacagtcccctaataggcaaacccctgttgattgctaaatttgacattgaagaagataaaggtgtgagtcacagccatgatttccttatttatcttttgatctaaggctgttgcctatcagcctttaaaacacgtatattagtgatcctaagactacatcatactttctattacctgtgataattatagcaatattggcataacacttaggttttcagagcatttttcacgttgttacacagatcctggggaggctgttattatttcttgcattttgcagtggaggaaactgaggttaagagagtttaagtatgttttatgctgttatcatgctgcctctgtgtttaacttagctggatgactttaaaaaaaatcaagtgtgtgtgtgtgtgtgtgtgtgtgttaactttggccattagtacctatgatgttgcttttaggtaccaatcatatagaaaatgaaatgaagttttttgttgttttttttttttttttttttttttttgacacagagtcttgctctgtcacctaggctggagtgcagtggcgctatcttggctcactgcaacctccgcctcccgagttcaagtgattctcctgtctcagcctcccgagtagctgggattacaggcgcctgccaccacgcctggctaattttttgtatttttagtagagatggggtttcaccgtgttggccaggctggtttcaaactgctgacctcaggtgatccactctcctcggcctcccaaagtgttgggattacaggcgtgagccactgcacctggctgtaaagtctttttttaaaattttattttattttattttttgagactctgtcgcccaggctggagtgcagtggtgcaatcatagctcactgcagcctcaaactcttgggctcaagcgatcctcctacctcagcttccaaagtagctgggactataggcatgcaccaccacacctggctaattatatgtatttatttatttagtagaggcgggggggcctcactttgttgccccggctggtctcgaactcctaacttcaacttaactcctcttgccttggccttccaaagccctggcctgaccacagccaactctttcttttttgtgtgtgtgaaagaataggtaactattttgcaaaatcagtttaacacattttttttttttttggagagagttatgctgattcttattgaactagatttgctggcaatattcaaggtagtctaaaatttccaaccctacaagtactgtccagtggagatgttcctgtatcagtaactcctaggcagggtttttgctttgctatggccccattacatctgtgggcacatttttacaggttggtttttactgaggaagggactatttatacttttctttctctttccctaccctttgggccttcagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttgtaagcttttcttcctcgtttataaacacgtcagcagaaacaatgagaacacttttaggatgttaagtcaaacagactggagaatcttggaagctttagattgggggaaaatgaaaagcagtgaactcatacacagctaaaatttccatcttaggtttatttcttctagatgtgaaagaaagtgtcattaacacagatgtactgaatgataccctcaatgagaagaagactgttttttctcttttctttcaatttcatttggaggaaagagggaggaagaatgggtcattttgggattgtatagcggtgactgcttgaacccttttggcccacattcaccttgggagcatcctaggtgtttatttatctggcctgaaaggcagcaactgtgaactcagtgtgtaatctttaatttctagctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgaggtaagtcctgtcgttcatggcagtatcagtgaaatgtcccatgcatagttctttccttctgtcttacttgctttttatgctgatggggataccagaataaggactcttctcaactgtaatcagtactgaactcatctacttaagacttttggtcagtgttgcatcttctctggtgccagagtcaaaattttaatacatcttagaaacattgaagagcagtgtttatctaacttaacagtattttgagatctcatcattaagtgaaaggttctatttctttcttttttttttttgagatggattctcgccctgtcacccaggctggagtacagtggcacgatcttggctcactgcaacctctgcctcctgggttcaagcggttctcctgtctcagcctcccaagtagctgggactacaggcgcatgccaccacaccaagctaattttttgtatttttaatagagacggggtttcagcatattagccagggtgttctcgatctcctgacctcatgatctgcctgccttggcctcccaaagtgctgggattacaggcgtgagccactgcacccggccgtgtaagtctctatttctaaggaggcttatgcacgttttggttcctttttatagttttcccatggaagcaagagggaaaagatgaatgtatgtgaagctatggagaggcatggggctacacgggagatcagggaacccttcgcaatttcttctcattagagcgtgtttgattagtggaatagctggcctgtttttgtctatcactagtataaatgcatgctttttatttctttctaaacttgaggacatctgccctgtgtttgggggaaaagatccataaatgtctatctctaggatgggtatgggatcatcgtttagctgatatttgggtaagaaaaaccgtacggagagatgagttggaaatatcctcatggtgtggaactttttccctttctcattacctttcagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatggtaagtccgtctccttcttggagccactctttcctacccttatttttattgcagtggttaattcagttgtcaccacatgaaacccactagacctttcggtctagacctacactggccaatatggtaaccactagctacatgtggctattaattagctaaaatttaaaattcagttccttggtcacactgctacattttaggtacccaatagcctcacgttgctgaggaccaccatagtggacagtgcagatacagacccagatcatttccatcactcagaaagttctatttgacagtgctagtctggattgtctgctgtctgatgattgagttgcagaaatttccacttacttatagtcattggcattcataagtaaccccctctgcccctgttgtacctgccatggccttggccaccaacctctctggctttaacatttgtgaaatgagacttgaattagacactataaaagttgcagatatccaggtagaaatttagccatacaatgtcagaattgccagatttccccgtttgcacctctatgatgagttttacctatggcattaactccatatggacaaaagcaaagtgtaatgttagaaaacacattaattacaactagtgtcctgtttgtagttttactgtgaaggaaaacacataatattgactgataaatggaatgtctcaggtactcatgtttgaatttcaggtgcgtttagtcatattgacatgctggcacaacatagagaccggtagacatttaaacagcagatggatacaatgatgtgttgattcataatggggatatgttctgagaaaggcatcattaggcaattgcattgttgtgcaaatgccatagagtgcacttacacaatcctaggtgctacatcctgctgcacacttaggctgtgtggtgtaacctgtttcctctaggctgcaaacctgcacagcatctgtactgaatcctgtgagctactgtaacacaatggtaagaatttgtgtatctaaacatagaaaaggtacagtaaagacatgatatgataatctcatgggaccactctcatatatgtggtctgttgttgaccaaaacttcattgtgcagcacatgattttgtagttaaggatataaatgagaacatgatgcttcttaagaagtttactgatagtgatagccagcttacaatagccaatatgttttcaacgttttttcctggctctgtggagcggagcaggagcagaagggagcctgaggtgatggggctcagccttctctcctttctatctccatatatatatatatacttatatatatatatgtatatatacacgcccatatatatatatacactcatatatatatatacatgcccatatatatatatgtatatatacactcatatatatatactcatatatatatacactttttttttttttttgagacagagtctcactctgttgcccaggctggagtgcagtggtgcgatctcggctcactgcaacctctatctcctggattcaagagattctcctgcctcagcctcctgggtagcttggactacaggcgtatgcaaccatgcctggcagatttttgtatttttagtagagacagcatttcgccatgttggccagacttgtctcaaactgctgaggtcaagccatccatccacctcggcctcccaaagtgctgggattacaggtgtgaaccactgtgcctggcccacttttatatattttacatgctggggatctgcagatggtttcttaaacagagcattaggggtggaattccctactaaaagaaaaataaagtttaaagcagtgccataaatatgtcttaattctcccccccactgagatataagatactgttattattatttttagagacagggtctcactctgtcacccagactggagtgacaccatcatagctcactgtaacctcaaactcctgggtgatcctcctgcctcagccttccgaatagttaggagtacagacgtgtgccaccatgcttggctagttaaaaaagtttttttagagacagtgtctcgctacgttacccaggcttacctggaaatcctggactcaagcgatcctcccacctcagcctcccaaagcgctgggattacgggtgggagccactgtgcctggcagttactgttttcttattgatgttcaaatggtcttgtccttggccccaagaagttcattcacgttggctcccagatccttttgtcatcagccacataacaaaaccagatgtgagcctaatatgagaaatattatttctttactttaaataaataatagcttatttagagtagttatttttgaatactttatacttgaatactgtgctcggctatccaagtataactttaaatgggtgaactgtatggtatgtgaattatatctctgcaaagttgctatagaaaacattattcatttagtacacattaatgctagaaaaattgaaaccccaggccgggcgcagtggctgccgcctgtaatcccagcactttgggaggctgatttgggtggatcgcctgaggtcgggagttcaagaccagcctggccagcatggggaaaccccgtctctactaaaaatacaaaatttagccaggcgtggtggcaggtgcctgtaatcccagctactcgggaagctgaggcaggagaatcgcttgaacccaggaggcgaaggttgcagtgagccaagattgagctattacactccagcctgggcaacagagcgagactccgtctcaagaaaaaaaaaaagaaaagaaaaatttaaaccccatggttacttttaaggctttcatttttctcttaaatgaaaagatacagtaaggcacaaaagattaatattctatctcccacgcatgcgatttagggattgaccacaccttgcattccaggggctgactcagcagccggctttcagcagatttcatcattccttggatgggaaggagatgcagggtgggctttgccaaaggccagtggaaggagctcaggcttggcggcatctggtttgcttgtctgggcctactcctttgcatgatataacaaatggcaggtaaaactgagggattggtttgttggttaactttctactatcccaaattactggattttgagttatttattggttgatgttgatctttgcaggaagaactagtgtcctgtaatctcttcatgtggatttcattttgcagatattcaaaatattcccactggcaggaacatccaagagaagcagtactacccagaagtgagatagaagtgatttgaggactatttatttatattttggattgtgggtgccatttttttctctgttattctgctttcatcttatttatatcttgctttggatatacttaaagcattgagttttactttttgcctctaaaaaattggccgttcgtttcaaagaacaagtctgtgtacagttctccagaaccagaccagagatttggaattttctcctttaaatgtctgtggtttgcatttattcacaaacagaaacccacagaggtatgtatttgggtttgcctgtgggtgcctgcccacctacataaagccttgattttccagcatgagtccagaaaatatggtcatggtagtctcttatgtcattaataccaattttctccttttgctgagtcaggttttagattataccatcagcccatggttggacaccatgggggcccattcaagacctggaagaacatttgtttccttggcttcaaaacctcaagaaatgaataacaccaaccccaagcctgttgagttgtaaagtacttcctaaatcctgtgtcccgtttaatcatcttctcccattccattctagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccaggtaaggaaatgattaaagtcttcaattgccagaacattgtattaaataaagtctgccattggctggaccatgatttaaatactctgtccatgctgatttgtagttggcattttcatctctaatacaagtttctgttttctgatacttagttctttcctcccttccttccttcctttctttctttctttttttttgagacggggtctcgttctgtcatccagtgtggagtgcagtgcagctgcatgatcgtggctttctgcagccttgaactcctgggctcaagcaattctctcatctcagcctccttagtagctaggacgataggcgtgtgccaccatgcttggctaatgttttattttttgtagagatgggcttaagtttcttcataggctcttgtaaccatttctttcttgggggctgttttagatggttctgcaggaagacaggagagactcaccctcgactcccaccatccccctatactgtgcttagttatccagttataaacctcattatggggcccaagatgaggagtggccagaagtgatgtcaaggaggtacagtgggcagagaatgggcttaatgccaagagagctgggctctagcccctgtctgtggtgcactagctgtatgactttggatagtgtttgactgccttggacttcatttttccctattccagcaactttgtcaagtaggtggttagattaaagagataaggtatgtgtcacagtgctttacaaatttcagaggctgatcagctggacggcactggttggatgcattcagctcccttctggatgctgggtgccatagaggctaattactggcctcttttgttgttcaaagttttgttttgtttatcagccatggcctgcaattgtagagatggcttgtgtttggcctgttttgctcattctagtggcatgtgttgtttgaaactactcctttagcttccagtagagcaaacaagtagtgacagcaacctccctgtctctgaggtgatagacttctagttaatgtagtcatccaaaaccattacagaagaatttgtatatggcattatttcatttgaataattcattcttgttcctaggatctcttttaaatttgtcatttaaattttttggaaaagagtaatagttacatagctcaaaaccaaaacaaagtatgcattaagatatgttgtaaattagccaggcgtgcactggcgggtgcctgtaatcccagctactcaggaggctgagtcaggagaatgacttgaacccaggaggcggaggttgcagtgagctgagatcacaccactgcactccagcctgggcaacagagcgagactctgtctcaaaaaaaaaaaaaaaagaaaagatatgttgtatacctgttcctgtctgcctaacctccctgtctcccctaccccttagagttaaccatctttattggtttctatttttaatttttccaatgtctggatttttttttttttttgaggcagagtctcactctgtcacccaggctgcagtgcagtggcacaatcttggctcactgcaacctccacctcccaggttcaagtgattcccctgcctcagcctcccaagtagctggggttacaggcacacaccaccacgcctggctaatttttgtatttttagtagaaacggggtttcaccatattggccaggctggtctcgaactcctgacctcaggtgatccacccaacgcagcctcccaaagtgctgggattatagtcatgagccactgggcccagcctaatgtgtggattttttaaaatgcaagtataagcaaacacaaatgttattttcttctccttaaattatacggatttcagaatatagtattactagggaacaaggtggtgttctccttgatttttgttactctgggatttttccatactaatacatagagagaaatcctttattttttacatctacatggcgtcccattgggtgagtatattgtatttagataaccattcccctattgatgaatatttgagttgtttttatctttttctgttaccaaaaaaaaatcatttagtgcatatgtgtattattctttgttacattccagtgtggttctgttctttattccctggaattatatttccaattgaaagaccacttttctgtgtacaccagatttctgttcatataatggaaccacagttttcttaggtttcaagagctttccattttagtacagtgggatctagcccattctaacagctgcatatatttcattgtatagatttgcctatatttaggtaatcaatccttgttgtttgtcctgtatgtttcctgtattttgacacttaaggctgcagtaattatttttgtagggaaatcttaaaatatatgattaattgtttccctgggatacatcgctagaagaatctctgggtcaaaggttatgtgtgtgtgtgtgtgtgtgtgtgtgtgtgtgtgtgtgtctatgtgtgtgtgttttgagacggagtttcgctcttcttgcccaggctggagtgcaatggcgtgatctcagcacactgcaacctccgtctcgtgggttcaagcgattctcgtgtctcagcctccttagtagctaggattacaggcatgagccaccactcccagctaattttgtatttttagtagagataggggtttcatcatattggccaggctggtcttgaactcctgacctcaggtgatctgcctgcttcggcctcccaaagtgttgagattataggtgtgagccactgcgccctgcctttttttttgagacagtatcttgctttgtcacccaggctggaatgcagtggtgtgacctcggctcactgcaacctccacctgctgggttcaagtgattctcctgcctcagcctcccgagtagctaggattacaggcgcctgtcaccacaccaggctaatttttgtatttttgatagagacagggttttgccatgttggccaggctggtgtcaaactcctgacctcaagtcatctgcccgcctcggcctcccaaagtgctgggattacaggtatgagccactgcgcccagtggttatgtgtatttttataccttttgatacatactaccaagttgccctcaaggaaggttttactcagcatcacagtttaagagtatcccattccctacaaattcagtaacattgggtatcatttaaaaattatcttggctaatttataggagaaaacaatgatacctgtggttttaatctgaattttctattgctattgggattgaaattcctttgggtgtttatttgagtactttcttttgtgaactacctgttcaggtcctttgcctatttttctatttagggcattggcatttgtctgtttcttgttgatttgaagagctctacacattaaaaatattaattattttatggctgcatattattaaaaacattttcctcaatttatttgtttgttaattttggttatgttgatttttggcccatttaactgtaaacctgttatgttgttaaatacattagacttcctcattatggttcctgtctttggtgacttgttacaaagtctgtcctcttcctagagtatataaatgtttgcctgtatttccctcaagccttttaatggtttttttttctattctttaagatattctttattagaatttttattttcaaaagtaatatgttcttttttttttgagacagagtctcactctgctgcccaggctggagtgcagtgatgtgattgcagcccactgcaacctccacctcccaggttcaagcaattcttctgcctcagcttccagagtagctgggactacaggtgtgcaccatcacctgtagtgatgcaaaaaaatttgcccgactcatttttttgtatttttagtagagatgaggtttcaccatttcggcctggttggtatcaaactcccggcctcaagttatccactcgcctgggcctctcaaagtgctgggattacaggcatgagccaccgcaccaggccagaggtaatatgtcctaattgcataatggaaacaatgcaaaaatgtatagcagaaaatgtaaatttcctgtcagccccttccattctcactaccatgagatcgccagtgttaacaacgttctgcagtttctctctatgctcataaatgctttcatatttaagtctttaatccatctggaatttattgtggtatcactgtgacaggaaggatttaactttatttttttccagatggttagctagtttttccaacatccgtcatgaatgactctgtcatttcctcactgctctaaaaggtgatttttgttatgaactaaattcttatatgtacttttgagtctttgtgtagaatttttatcctttaccttctatctattcctagggcagcatcacaactttaactatgattaactagtgttagctttttaatttgtatagtagagggcattctttttcttttttaaaaaatagcttttttttctactaagtgatgcattgacatgatttaaaaccctggaagtatgaaaaggtatacaatgacaaatttccctcctatccttgtcccacctcccctcttcatagggaaccagtgttactaatttctttttctttctttctttctttttttttttttttgagacggagcctcgcttctttgcccaggctggagtgcaatggtacgatctcggctcactgcaacctctgccctccaggttcaagcgattctcctgccctcagcctcccgagtagctgggattacaggcacatgccaccaggcccggctaatttttttagtatttttagtagagatggggtttcaacatgttgggccgggctggtcacgaactcctgacctcaagtgatcacccacctcggcctcccaaagtgctgggattacaggtgtaacccactgcccctggcccagtgttattaatttcataggtgttccatacatatataatgaagtacatatatgtatatatttcctgcttaattttttacaagaatgatagcttgctgtatactgcaccttaaaaacagcattcttaattatttcttttttcaggtgaattttagcattactttactgagcaattttgattggaattgctttaaaatttgtaagttagtttgggccagctgtggtggcttaggccaggcacgatggcttacacctgtaatcccagcactttgggaggccgaggcaggtggatcacttgaagacaggagttcaagaccagcctggccaacatggtgaaaccccgtctctaccaaaaatacaaaaattagctgagtgtggtggtgcatgcctgtaatcccaactacttgggaggctgaggcaggagaatcgcttgaacccaggagacagaggttgcagtgagccgagatcttaccattgcactccagcctcagcaacagagtgagactgtgtctcaaaaaaaagaaaagataaaagaacttataagttagtttaggggaggactgacgacttcacttttccattggggaacaggatggttttgcatttacttgtctttaacttttattcagcatttactacaattcaagcccaccccgccactccgtctctccttctgaggctcttatatcctgcctcttggcttggcccttgctgccagaccattgctcttcccttaggcagatcccacagccttcggtgtctgctatctcccctctgccatggaatctttgcaactattccagtgggcagcaatccccgctgtgggtacctgccatctctctcactacttggtgtccctttgtcgggagcccaccacataggtatccttctcttccctgaatgtctggcagtggctgcacattgctggtgatccccagggtcctgcaggtgggaacctcgggagggtgagccctgctctggctgaaggatgctgggagccgacacggtcctcctcttccctgctgtgttcccctccaggccttcctggccagtgcaccaggaggaggattggagctgctcagcgtggggtgctgttctcagtgggtgggaagggggactcacagcctcgtctgggagtttatgtggacaatctcctgcttcctgggtgaggagagacatctgttgtgattctttcttcgtgccccatgactttgtggtctttgaggggtattgagaagggagaacccccacagctctgcctgtgtatcggcctggccctgctcggcagtccttcttctccggggcatcatgccctggctttgaggtgagggaatggcaggaccgactggctctttcaggacaggctttctgcctcatcggcaccaggtggtgtggggaaggggtgcaggtcacgtggtccagtttgatagtggacttgtggcatatgaagttttattattttattctggaatcattatgctgtggggaattgattcctctttttaccaaactcatggtaatagaatcactcagtagtttacacacaggctggatctctccactgagtggacttggggctcctgccaggagcacttggaaaacccaagtattcaccagggtggcggggtgagcaggggtgatagtgggggccttttgtcgggctgtggtggagagtgcggaattcattactctcagtgtgtatgctgctttcctggcgatcggaatcttcatgtcaggctgggtgctgtggctcaagcctgtaattccacactttcggaggccagggcaggcagatcgcttgagcccaggagttcgagaccaacctgggcaacgtggtgaaaccccatctttactaaaaatacaaaaatgagccaggcatggtattgcatgctgtagccccagccacttgaggggctgaggtggaaggatcacttgagcccaggaggttgaggctgcagtgagctgagaccagaccacttcactccagcctgggagacagagcaagaccctgtctccaaaaaaaaaaaaaattaaaaagtaattagaaaataaaaacagaatattcatgtcccacatatgcagatattttctctttagatattggagacattatccttgtgacacattcgtagtttctgataagggctacgttcgattctgtcttttgttttcaagacagggtctcattctgtcacccaggctggagtgcagtgttgtgatcttggctcactgcaacctcaacctctccggcacaagcagtcctctgacttcagcctcctgagtagctgggactataggtgtgtgccaccacatccagctaagttttgtaattttgtggtgacagagttttgccatgttgcccaggctggttgagagcttgattgttttcattaacttgacatggttatagagtgtacaggctgggcacggtggctcatacctgtcaacccagcactttgggaggccaagtcaggaggatcacttgatccaggagctcaagaccaggctgagcaacatagtgggaccccatctctacaaaaaaaaaaaagtattagctaggtgtggtagcatgtgcttgtagtctcagctacttgggaggctgaggtgggaggattgcttgagcctgggaggttgaggctgcagtgagctgtctatgatggtgccactgcacaccagcctgggtgacagagtgagaccttgcctcagaaaaagaaagtatagtgttcaatttacattagctccatttctgtgtggtgcttctcataacccacactgcattcataacctgatgaaactggagggccacatggcgtgtccctacaggtggctgttcacatgctgtgtgggggttcttatttacccttccaggggagcatgtttcctggctgtgtcgtcagatactgtggtttacgctgttccggagtctggaggcctctgtgtgcctttgcatctctttcccaactaatttgcacagctgctgtggaggccctcatgaatgacctctttctttcctttcttcttttctagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggtgagcatcagcatcacctgccttcctcactagctgtggctgcttccacattgcttgaaacagggcttctttttctttttcttctttctttttgagatagggtctccctctgttgaacaggctggaaagtgtagtgtgtgatcatcgtgtactatggcctggaactcttggcctcaagtgatcctcttgcctcagccttcagagtagctggcactacaggcacgcaccaccacaccctgcacagaacttcttgagagccaaaatattgaagctaaagtccagcttaagactggaattcccaaatagatttagtttctagagttgtcctgttatttctccttgtttctctgcccattttcctttaccttttgaaaatgttaaatcctacaccaaagtcaaaagcacgttatggtgaattccactttgttttgccagttgttaacattttgctatatttgatctctttttatatttatttatttattttgggctgaaccattgaaagtaagtgcaaaagcccctctttggtttttgttttatatattataaaattcacccatttaagtatacaatttagtgacttttagaacatttagtgggttatgtcaccatcactataatcctgttttagaacatttttgtcaccctcataccacacttccttttaaaagttacacaaatcatacatgttgactttagaaaaagaaaatacagttaagcaaagaaatcctgccacccagaaataaagattttttttcctttttttcttttttctttttttgagatagagtctcattctgtcacccaggctggagtacagtggcacgatcttggctcactgcaacctctgcctcctgggttcaggtgagtctcgtgccttagcctcccaagtagctgggactacaggcatgtgccaccacgcctggctaatttttttttttaattttcagtagagatggagtttcactatgttggccaggctagtctcaaactcctggcccaagtgatctgcccaccttggcttcccaaagtgctgggattatagatgtgagcgccatgccatgccagaaacaaatattgttaatcttaatctggtaggcagaatattcagcccctccaagtatctatgttctaatccccagaacctgtgagtatgttaccttactttattttgttttgagacaaagtcttgttctgttgcccaggctggagtgcagtggtaagataagctcctaactcactgcagcctccagcttctgtgttaaagtgatcctcctgcatcagcctcctgagtagctaggactacatgtgtgtgctaccatgcacggctaattcaaaagcaatttttttttttttgtaaagacagacatggtcttgctatgtttcccaggcttgtctggaactcctgagctcaagcaatcctcccaccttggccttctgaagtgctgggatgacaggtgtgagccaccatgcctagcctcctgttaccttattaaaagggactttacagatttgattaaggatcttgagataggaatagtattctagattatccaggtggcctcaaaatacttgcaacagtctttgtaaaagggaggcagggggtcagaccggggaaaaagtgctaaactgctgacttagaagatacagaaggaggaccctgtcagggaatgaaggtggccccgagaggctggaaaagatggaaacacattctccccggcagcctccaaaaggaacatatccctaacaataccttgaatttatgcttctgccttccagaattaggggaatccgtttgcgttgttttaagccaacaagtttgtggtattttgctgcagcaacagtaggaaacaaatgcagccatgaagtgaatgtccttctgtacctttgagtttatgtataggtttaaaaaaaaatgcccacctacactaatcaatacggacaaacatgggattgtctatgcgtattactttgtgatttctctcttcacctaatttgtggtgaacaacagatatgttgtgaacaactttctatgctatgtattttaatggctgctccctcgcttagcaatagttgatgcagtatttattttgtttttgtattcttttgctgatggaggctggccttgctggctgtacatttattttgttagttctgttctgtttttttgttgatacatcatatgtatcttgagagttttcccagtagtgttcatcccagaggatccaagaaacgtcaagttggttggaaggtaggttgtacaatggagaaatatttttttctccctgacttaaatttctgattgattaaaccacaacagatcacagcttaagatccattcgacagggctttcttcacacatcctgcttgtctagtgtcttgattctctattgctttttatcgtgtggatttctacttctagtcaaatataaacagaaacagataaatactttctgaatgttcttgtttctttatggcctgaggactaatctttcctttctttgaaaagaatgcattgatggaaaacatttgcttaaattactttttttcctcttggctttctatcaagtatgagacagagctctgcaaagaattatataagcctctgggaagcagccgaaggctcgtaaattttctgggcaatgagactccttcatcctgaatcacgttgctgtgggaggagggcaccctgagtgaccctgaggtataaaccccaagtgctcttgagtggagtctgcctctgtcctctcctgatcagcacccttggcctctttgtgggggttacataggagctcgtgctgatccctgaggggctgacccgagaggggtcaggatgctgaaactgtcttcttagtggcttcttcactgcataccacagggccaggcacattgtgaatgtttggcaaatatttgtggaaggaatgaattgtgggctgaccgtgtgctctcagcctctatcagcatttcattctgtcacagccattttcccctgcaagattggtggaggggaaagggtaggcctcctgggagaggttctggatctttctgccatctgctttgttccatgggtcagccctgaaattagggcatttggatgggtttgcagcctcaaagtggagaatggattctgcctgcgaggatgtgtaagcatcacttcatcgatggtttgctgttactcaacttccagattaccttttgagcacccttttaggaaagagaggaaagttaataaattacattttacccactgtgtgtctgggacttcttgcacatgaactcattcaaacctggaaacagtcttctgaggcatcattaccctcattgtttagaaatataatgaggcccagagagttccacccatgtgtccaaggccacaatagctaatccatgatggagctggaattggacccagggctctctgacccatatgtgtcctagacagacagaaagaatgagtccccattaggtagtgacttgttgatacccatatgtggagaaccgagacctcaaaccagaagtcctagagctctcagaggaaacacacccgctcagaggaaacccaccttcctcagaggaaacccactcccctcagaagaaacccacccccgcagaggaaacccaccccctcagaggaaacccacccccctcagaggaaactgactctctgcagaggaaacccaccccccgcagaggaaacccacccaccgcagaggaaacccaccaccagcagaggaaatccacccccagcaggagctgcagagtttcttgggtgggctattggccgcttttaagtttttctcatctgtatctcttctgagggaggcatcctcatggtgagaacagaatgatgacttctgcattggttaagggtttatacagagaggaggttggtgttggagccacgttggactatttctgcccgtttgctggtcagcactcatttctatacttaatctacaaatagctttgtggaagtcagagcaagatagagggatagaggttcgaagccttggtgctgcctggggtaggtggggtctatggttcaaggctctgatcttcatttttgcaggcggagaaactccatctatccatccatcaaagatttattgagtttcttcatgaccaggccctgctcacggtgttagggattcagcagaaagaaacacaaacaaaacttcctacgcacacagagagtgtttccttgttgacgccctcaataatgtgtgtgcctcagaggttatcaggcacctgggagactgactcacgttaacttcctagaagctgacatactcacctgatgctacatggttccttgactgggtgtgaatcgacctctacactggttggaattcttgtgcctggaatcctcggggcctgagaggctgagttcatttgactgctgacatcagatcccagggatgtgggtggttccagatgcattcccttttgccctggagaaggccctgcacctgaatgcatcttggaggggagattatatttgaattgataaaatttggtgactgcttagctcagtgttagaagtttttaaaatttgtggtaaaatatacttaacatctttaccttgttaaccattttaagtgtacagtttagtggcatcaaatatattcacaatgttgtataaccattactatcatctacactcagaactctttcatcatccccaacataaacccattacacaataactcccgattcctccctcctatcaacctctgacaaccacctttctttctgtctctaccaatttgcctattctaagtgcctcacttgagtggaatcatacaatatttctctttctgtgtctgtcttattttacttagcataatgttttcaaggtctatttgtattttagcatttatcaaaatttcaagctgggcgcggtggctcacgcctgtaatcccagcactttgggaggctgaagcaggcggataacctgaggtcaggagttcaagatcagcctggccaacatggtgaaaccctgtctctactaaaaacacaaaaattagccaggtgtggtggtacgcgtctgtaatctcagctgaggcagggaaatcgcttgaacccgggggacggaggttgcggtgagctgagaacatgccaatgcactccagcctggatgacagagcaagactccatctcaaaaaaaaaaaattaattcctcatttctggctaataaatttcattcctttttattgctgaatgaatattccattggatgtatatactacattttgttgatcagttcgtctggtgatgaacacttaggctgtttctactttttgtctgttgtgaataatgcttaatgcttctgtgaatatgagtgtacaaatatctgttcgcatctccagcttcaattcttttgtatatatacccaagaaagatatttttatttaatgttttcttgaaatataattcacatactataaaaataatcatgttaaagtttacaatttagttgtttttagtatattaaccaggtaacataaccattacctctacctaattccagcacagtttcatcactccaaaaagtaacccataaccattagcggtcactctccgtaccctgtcctcatccatccacttcccccacgctggcaacaggtagtctatttcttgtctgtatggatttgcttatgctggatgtttccatatccctggaatcctacagtatgtggccttttgtgtctggcttctttcacttagcataatgttttcgggttcattcccaggtgatttttaacaggttaccaaggttgaggaaccatagatctgcctctgcagacacccaccctgtccatgtgtgttagcttcccacacagagccatccgtggcctggctttgagcagccttctggccaatggcaggctgtacttcctggttcctgtgggaaggagcctgcaccccactccacccacaccagcagcccctgttttgagtgagtagcaggcacctgtgttctgctattaaagcacacgcttctcaaattattacctttaactttggccagccccaaaatttgtacctccattttctcaggattttaatgagaattaaacaatacatgtttaatttagaagaatgcctggtactcaataaacgcctattaaatatgagcgtgagtgtgtttctattagagataggagagagaccaatcaagaagcagacacagaaaagtacgtgttgggacaggaggtaaggagggactgttggagtttgtgtatctctatctgaattttgtcattagctgtgttattctcttgaataagtaatatcatgtctgaatttttcatttctttctttctttcttttttgaggacggagtctcactctgttgcccaggctagagtacagtggtgcaatcctaactcactgtagccttgacctcctggcctcaagcaatcctcctgcctcaacctcccgagtatctgggactacaagtgctcaccaccacgcccagctaatttttttgtagagacatttggctgtgttgcctaggctggtctcaaacccctggcctcaagtgatcctcccacctcagcctcccagagttgagattataggcatgagccaccaccatacctaacctgagttggtttttttatatgtaaaatgctgatgataataaaatatgtccttgactctaggtaacatgattttaaaatattttacatttaaacttctctgaaatgatttgggctgggggatgtattacaactgatgcatatgtttaagtgtcccccacgcccctgggaagctgtcgttaaattcctggggttatggccatgcctaccccataaggttgctgcagggatttaaagggaaaatgtaggtgaaaaatactttggcaaactgtaaaacattattcagatgtgagctactgtcttcaaaattggaaattatggaaaagttaataaataatttagtatagaacaaataggatgtattctaaaagcaccttgtgactgttaggtgtatgatcataaggggccaattttgggggagaggtgtttttttctttatgaagtttatgttatgtttttcttgagcagtggtaggacattggagtgatttcactctacggctgattttctcaccccacctcttacttccagtgggcaaggggcaagtattaatttggctgggtttgagtttcctcatctgtgatcaacttagccactcatctttcaggctcaacgattccatggggcaatagtccatagtcttgaattttagtccaaactgtgctcattacaggctgtgagacccacggcaaatctgtgcctccgtttatccacctgtaaaatgaggatgaggttacatctaacagccctttcagcgtcagtcttggagtcctcctagggttctgtatctgggtgcccgttttcctcacttggagggccttgaggacatacctggtgacactggggaggcccatgtgctgcagcctgcaggggtcattcattaattccccgtgtctgtcctttagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtaagggcaaccagaatggtgtgggagtgagcctggagggtgacagttgcatgctcccaccatcctcctctcttgggtagatgctggttgagagcttttatctccatgctgccccactgcatagctcgtggctgcatcactgctcaggtgcattgtgttaagagtttcctattaatggtcttgccctgctgcaggtcatttttcaccccatgaaattgtctttctgaaaagcagatctcatcgtataactgctatctttccttccttccttccttccttccttccttccttccttccttccttccttccttgctccctccctccctcccttcctcttctttcctttctttctctttctctctttctctctttttttccttccttccttcctttctttcttttttttttttttttgataaagtctcactctttttttttttttttttttttttttttgagacggagtctcgctctgtcgcccaggccggactgcggactgcagtggcgcaatcttggctcactgcaagctccgcttcccgggttcacgccattctcctgcctcagcctccctagtagctgggactacaggcacccgccaccgcgcctggctaattttttgtatttttagtagagacggggtttcaccttgttagccaggatggtctcgatctcctgacctcatgatccacccgcctcggcctcccaaagtgctgggattacaggcgtgagcctccgcgcccggccaagtctcactctttcacccaggctggagtgcagtggtgctatctcggctcactgcaacctctgccttccaggttcaagtgatcctcccgcctcagcctcccaagtagctgggattgcaggcacgcaccactatacttggctaattttgtttactttttagcagagagaaggttttgccatgttgccctggctggtctcaaactcctgggttcaggtgatcctcctgcctcagtttcccaaagtggtaggattacaggtgtgagtcactgcacctgacccaggctaatttttaaaatttttttagagatggggggggtctcactatgttgcccaggctggtctcgaactcctgacctcaaatgatcctcccctcttggcctcccaaagtgctggagttacagatttgagccgtcatgcccagccgaactgctttctttaaaaattgatgcacagaggctgggtgcggtggctcatgcctgtaatcctagcactttggcaggccaaggtgggcagatcacgaggtcaagagatcaagaccatcctggccaacttggtgaaaccccatctctactaaaaatacaaaaattagccgggcgtagtggcgggcaaatgtaatcccagctactcatgaggctgaggcaggagaatctcttgaatctgggaggtagaggttgtagtgagccgagatagcactgctgcactgcagcctgagcaacagagtgagactctgtctccaaaaagaaagaaaaagaaaagaccctatggatatactcttcagagctctccctctcggtatgggatcctgtatgctaatgcatttaatgtatttcaacaactctaaagagcgtgatggaaacatttcatgtatctctgaccaagtaaaaacgctaactgatgacatactgtcagtcataaaatgtatcctaattatagaaaggttaaactgtgaaaaaatatgcattttagaatcagtgaaatatgtgctaggcttccagggcccagatgtacagggacctggcttacaacagaccttgcaaagaaatcccaaccactgactattagaagctagcgggaggcagggcagcagggaaggggcatggcttgtagtgcttttgtggatcaagtgagctcctaagagtgaaaatggtccatgaggttagaagggtctgtaaggtccgtggctgctgtcactgctcctgctgatgttcatattcctgtccgctgatcctgaggctgaggaaaggggaagtgggtgtggggaatgaacaaaggaattccttctcggaggctccaggatctgcttctcacgtggggcggggagagtcagtctccctgcctcctgcttgtgtttgaaggactcataacatcctggcagagcactcaggagccacatgagccagagctccttatcaggaagtgcattttgtactctgagagcctctgtattacatgtaaatctgcagcagaagagtagcggctggcgtccctgctggtgtcttcctggtgtgagcttcagaatactgggctaatggaaagcttggccagcacctgcctatctggtcccagctagagccccgtgtgggctgggccccattcatcaggactaaggcagcagctgctgcctagaagggaggagaggagtgggagtgagccggggagggtgaagcaggcaggaagctgcaggccggcggtggatggggccaggaagcatgcagggggagtgaggaccgtgtttgagagaaacactgcccaagagagaaagaaagaaaatcacaggacccgaggaaaaagaatgagtggtgtgttcagagatgacacatgacaacaaattgtttgcttggagaattttcttacgcttgcgtgtttaaactggcctcaaggaggaagaagaaacatgcgttcctggatgactgagttctggaatattctgtcataagactttgcaactggagtagccccagagaaaggcaggcagtgagagttggctccctccccaaagccatccctgagttggctttgtttggggttcctcccaggtgggaaaacacaaaccctgtcttggtttgctggtaatcagctggaggagggaaagaagtggctgccctgggtccaggggaggtcgggaagcctgagaagaggatatgacccaaaggggcacccgtccatgttgtccccagtgctcatgggcatcaaggggggtcagggggcttttctccttggagtaaagaacatcaacactgtttgcctttaggaagtgataggaatggcatagattttggcgtagatttatttttagtagtgaccgaagtgatagagcaaacttttttttaactggcttcctgaggcccatggccatcaaggataattaaactcttggtggtcttttttttttttttttagtcttagactgctacagacataaacactttacacctcaaggccaaacatttattgagccctttgtacttcccctccactgtgccaagcataacatgttatttgcgatttaaaacgtccctgtgagatagctatatttgttgtctccgtttcatagataaagtaacagagattacatttctcagggttaaattaagtggcagaaccaggaatccatctcaggtcttgctgaatccaaaagccagggttttttgtcttgtttttgtttttgagacagagtctcactctgtctcacaggctggagtgcaggggcacgatcctggctcactgcagcctccacctcctgggctcaagcaaaaaggaccccattccactatgcttctccactctggaacttccacagtcttgcctggattttcatggccttgacagttttgaagatgacagccagacatttttcagcatgtgccccaatttgtttttgtctgatgtttcctcatgattagatagggatttgcatttctttggtagaaatatcctagaagtgatgtgttcttctcatgggaacactctcagtgccaatgggttggtgacctaacatgaggctcttctgtttcattttaggtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtgggtgagtaagcaacgctattcaagggtgttgggggcccgcttactatctgaattttgtgctttttggggtgccatagttagaatcacagcatgcttcttacatgtaatacccaaagagtgtgtggtttctatttttaaaaaattatttagtatttttgtttggagacccctgtgaattcagtgagccacgtcaatgctccattaccctcttgagaaagaaccagtttgagtgaaataaatcttggatcttcagacccatgtgtgggaggtgtccccaggggagctgtccgggaggtttctctggggtcagactgagcacgtccttctggaactgtttcctgggacaggtggaatgctgtaggccgttgcttttcacttctgagcctgtaggctgtccaagacagtttcctttgggagagattagttgcaagttcttgaaatactggctttacctcatcctcacagtggttatgttttactccatcatttcagccacaatgtgtcctccacgtggggattcaataactttttttttttcagcgacagggtctcactctgtcacccaggctggagtgcagtggcaccatcatggctaactgcagccttgaactcctgggctcaagcaatctgcccacctcagtctcccgagtagctgggactacaggcatgcaccacctcgcctggctaattttttattttttagagacagagtctcgctatctttcccatgctggtcttaactcctgggctcaagcgatgctcctgcttaggcctcccaaagcactgggattatcagtgtgagccactgtgcctggccccaggaaccccttcttttcagtgttttcacactgctgatatctggacatggaggagataggaagagctaactggtaacaatgataggcactgtggattgatattttttccccgtaaaagaattgtaaagtacattgttcttcctaccaatcccagaagaaacgctttaaaaattgttgtatattctggccgggtgcggtggctcatgcctgtaatcccagcactttgggatgccgaggtgggcagatcacgaggtcaggagatggagaccatcctggttaacagggtgaaaccccgtctctacaaaaaattagctgggcatggtggcgggcacctataatcccagctacttgggaggctgaggcaggagaatcgtgtgaacccaggaggtggagcttgcagtgagccgagatcgtgccactgtactgcagcctggcgacagggcaagactccatctcagaaaaaaaaaaattgttgtatattctttaagactttttctgtgatatattattaataattataatacatagcatattatatataacatataatctagataaaatataataatttggaataatacacattacctttatatattccatacttagataacttctttggacctatactgtatacactattcttgaatttgtgcttacagtcaaatcttggatcatcatcttcaggcatattgttcagattctaaaagttctgctgttagatttacttaaaagttttaccattgtattgtagtctctacaagcagctttcaaacttttttccacaagacacacagtaagaaatacattttatttcccaatctgtattccacataaacatacaagttacacatatacacatttatttatttctttttaatcaacacatcacaaatttgcttgtcctgtttgcacggaggtcatgctattcttctcagtatggttccaattttagtatgtgttgctaaagtgagcattacttttagttttatatataaaatttaaactcaagtttcatgacacaatacctatcttttctagaggtacaaagtattctgttccttttttttttttgagatggagtctcactcggtcacccaggctgaagtgcaatggcgcgatctcggctcactgcaatgtttgcctccctggttcaagcaattctcatgcctcagcttcccgagtagctgggactacaggtgcccaccaccacaccagctaatttttgtattttttgtagagatggagtttcaccatgttggccaggctggtcttgaactcctaatctcaagtgatccgcccgagtcggcctcccaaagtgctggaattataggcgtgagccaccatgcctggcctctattctattccttaatttaaaaaataactaaacgctggtcaccaccctctaaactgatttcgtgagtcattaacgggccactgcctacagtgagaaagtgactagcctctgctccgctttcttgctttggtcagaagtcccactctgagtgaggctgctggaggttggggtgggtgctggttgttgggcttgactgctgcctgccggctgacaccgcctcccgctcctgtcacctggacagatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagaggtaactaactggcctctgtaggaaggtgggaccgaagagctcagggagcctggtaaggccgtggggccggttctgaaggtaaggacttctaagggtgaggccagctggctggagggcttgtgagatgaccagcacacttgtgtgccaagcgcttttacacacaccctctcgatggaagctcaccattcctctctgaagaaaccgattccctaagaggtgtagggcatgattccagggcatacagtctgcatttagttctcgttactgggtgctcaatgcctgcctgtatgtgctgagtgtattctctgatttggccctcacagcagctgttttttagaagaaactgcacagagaaggtaaatgacttgtccaaggtcacacatctactcagttgtttgagccaggaccacactcctctttgtgaagctgggcaatagaaccatctgttctgtcccacccctggggaattccagctccctgcctcttccacatctgctattgaagcacatcctccagccttttcctctctctctccacatcatcagcccttctggatctttctcatttgcatacaaatgtgctattattttcccttccctggatgtgtctgtttctttcattgctttccttcctttacagcaaaaacttcaaaagaattgtgtgtcctttctgcctccaattcctctcctcccattctctcctaaacccactcctttctggcatttgtccctctatgcctctgagcctgaccttgccagggtggccaatgtcttccgtatcgcggaatccagtggtcagctcttacgctcctcttaacttcaacacagctgattcccctacaggacgcatctttctctggcttccaggacaccacacttcatggtgttccttctacctccctggtacgtccctctcaggcctcttgtccctgatcgcttcatgttggagtaccccgggctaagtcttgacctttgttcttttctctgtctttaagtcactcgctcagtggtcttatcgggtccatatcctgatggcgtctggatttgtagctccagtccagtcttctctctccacttcacactcatgtgttcagctgcctgcttgatgtcctcatttatggaacccctgctatccacccgcacaccccgcttggggcctgctttacccaaagcctttcccgtcgcagtcagtggcatcactggcctccagtggctcaggcgagagcactcggtgatctctgactcctctctttctctcgtaggccgtaatggtcctcaggaaatcattccagctctaccttgagagcacacacagaacctgacgcttcttaccacccccaccctgtagcatcttagcccggggcctgtcatctctttcccgggtcacacacagcagtggtgttcatgaagctcctcctgccctcacagtggctgttctcacacagaagctgggtcagacccgcagaggcccctgtctacagggcctcacagtggcctgtgaagaccctgcactttctgctcgctgtaacctctttgccggctgtctccctctgcccactttacccggccacacctgcccccagtgctgtctgtgaccacccaggcatgcgtccaccttgagccctggcaccggctgccctctctgctcaggagacatctaccccagataacttgttcggtcctttccttctcatctttcaagactttgcacaaatcttcccttctccttaaagttttatcctgaccactgaattcaacacttcatccctttctcccttccttactgagctccgctttttgatttttttctggagcatttcactttgtaacttaatgtgtaatttacctatttttatgttcatgtctaattgtctgtttccactagaatgcaagcatcacaggggcagggtgtttgtgtattgatgtatttcaagatctagaacagtgtgctcagcacatagtagaccatatgttttgatcatatgaatgaatgcctgcatccaagaatgttcttacagtcttgggtggtcttgggggtcagcctttggtggggaaccaacttgggagaaggaatagctctgacggctgctgggtattggctacctgaataataagggctcttggagtcatttagcacaagggtttttcacctgcatttagagaaaaaaaacaaaacacagatcataggtcatatagctgccaaaaagatcttgtctgtgttggtagcccagactcaagttccagccctgtcacccccagactgctctgtttctggccccaggcctggcgttcatggcggctgaactcatggtctttcctgtccccttcttttccagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatattatctggttttctgatattttattggaaggctgaagacctatgagaatgcaccatgcagtcagaatccccttgatgaaaacagcaggacttcactgcatttactgagggagcgcactctacttatagggagtgtcagtcagggtcctggccctcctctgggactcctgaagagaagctaaggaaaggactgtttagaggggtgtgggcgaggctgggggaactgaggctgttgagtgccagtgacagcagtgttggccaccgcaggaggctgctaccaccagggcctgagagctcaagaggaggcagtgggagcagcacaggaagggctacctggaggcgtaacagagggatgcagccagctgcatctgacagtgcggctgacactgcagcagagcgagggacaaacgccccatcccctctgtgcccccattctctgatgcctgccactggctcccattagtggaaccatgttggaagccagagggtaagaggagctcagagactggagttctcagaagtcagcctcttgagtgcagagaaaggtggagaatgaatctgaggtagggatggggtgggtgggagcaaatggagaattactggcacatgtatagagaaactgtgtgtgtgtgtggtgcaattatatatttaaaagcaattattttaatatatattaataaacataaaatatatgtattatatatacataaagttgctgttaaaaagcaaatgttggccatgtgcagtggctcatgtctgtaatcccagcagtttgggaggctgagatgggtggatcatttgaggttcaggagttcaagaccagcctggccaacatggtgaaaactcttctatactaaaaatacaaaaaaaaaattagccgggcatggtgatgggcgcctgtaatcccagctgctcaggaggctgaggcaggaaaattgcttgaacccaggaggcggaggctgcagtaagctgagatggcaccactgcactccagcctgggagacagagcaagactatgtctcaaaaaaaaaaattttttttttttttgcttcttgctaagttgaattgggctttggaatgcatttgacttcattagccttacccgccttatgaaaagaaaaaccttgtgcttatcctctaccgcagatttttatttgcctatttgaatttcttcactggctgttttctgtgatggtggagacagacgggctgaatcagaaataagtttcttggccaggggcagtggttcatgcctgtgatcccagcattctgggaggccaggaatttgagatcagcctgggtaatatagcaagaccccatctctaaaaaaattttaaaaattagctgggcatggtggcatgtgcctgtagtcgcagctacttgggaggctgaggaggcaggattgcttgagcccgggaaattaaggctgcagtgatttgtgattgcaccgctgccctccagcctgcacaacagagcgaaaccctgactctaaagaaaaaaaggacatggaccttagaacttcaggaatggagagaagctttggcctgctgaattctgcctaggcacttccattcttcccgttgccgaggagggcattcagtgatcaggcgcgtttatctgtctgcaaggggaagctgcttagctggccccactttatgctatggctgcaacacttgcttctatttacattatggttatgggctatagttctgccaacaaggctgtaaatactaaataaggggccaagtacagggtagagatgccacacagcaatttttgtttttgttttctaaatcagttctcacctgagacagcactttttttttctttttttgagacaaggtttgtcacccaggccggagtacaattgtgcgatcacagctcactgcagccttgacctcctgggcttaagcaatcctcccatctcagcctcctgagtagctgggaccacaggcaggtgccaccaagcccagatatttttaatgttttttgccgagatgggatctcactatgttgcccagggtagtctcttgaactcttggcctcaagtgatcctcccacctctgtctcccaaagttttgggattacaggtgagtcactgtgcctggccagcctctggaccttctgacaggaacatttattgataggtactatattgtgactacctaactcaggatctatacagattttgaccctacatatgaactgggtcattgatacctactgtgggatgagagtctaatagaacatgaacatgacatctgagtatgtttgacacaactaggccgcctgcacatgtaagcagtatgcaccattttgttaaaaccagtgagttttgatctctgattatttatgactttataattttgtccaaatacttaaaagataggaaaaaaattcattctggcagggaaataggtttaactgcaagactatacataaacagtggaccctgcccccatctgttactttactatctcaggtttccagggacaaagttgctttttttgaagactttttcccttcactctctcagggatctggagtttttacttaataagaatgctgggctgggtgtagtagctcatgcctgtaatcccagcactttgggaggccaaggtgggaggatcgcttgagcccaggagtttgagacaatcctgggcaacacagcttatctctacaaaaagtttcaaaaagtagccaggcgtggtggtgcacacctgtggtctgctcgggaggctgaggtgggtcacttgagcctgggaggttgaggctgcagtaagccccaatagtgctgctgcactctagcctgggcagagggagaccccgcatctcaaaaacaaaataatattcctgattatttgttgctagatgcaaatataaaatatttatgcttattaatagtttgtgtgtggtttccatgcttaatgttggaaattctgattggtcaggcaatttcttccagcttacactggccatatttaaatctcatttaaatgcagacaacacccacatttatagttcctgctcagatttctcctttgagctctagtctgtctatttggtatcttctcttgtacgtctcacaggcatgtcaaactttgtatgtccaaaacagcatgtctgttcccactcccttgccaacaccaccaagcctattcctctccatcttccctggcacccatgtgtccaaagcagacatcagcgaccccctgctctctcatctcatctttacatatttaagccaacagcaagttttgtcaattctgtctctaagctactcctggaaatgacccacttctctccagttccacagccccagccccaaaaaccaaccattatttctagctggaactgctgtaatagcccccaaactggtgtgcttgggtttatctgccctcgctagtccctgccccacgtggcagcagtgatcctgcccctcctttgcaaggagagaaaaaccaaagttcttatgatttataaagccctccatgatctggcacccacctacttcccgttcaacgcctgatgccattcttccctttgttcataatactgttaaaccagttctcagttcttcaaatggcctaaaactttctcacttgggaccttccacaccctgttccctctcctaggaatgtttctacctcaactcctcacatggctaggtccttatccttcagactttggcttaaatatcacctgagaagagcttcctctgactaccatatctaaaatagatctctgttggctgggtgtggtggctcacgcctgtaatcccagcactttgggaggccgaggtgggcagatcacgaggtcagaagatcgagaccatcctggctaacaccccgtctctactaaaaatacaaaaaattagccgggcgtggtggcgggcgcctgtagtcccagctactcgggaggctgaggcaggagaatggcgtgaacccaggaggcggagcttgcagtgagccaagatcacgccattgcactccagcctgggcaacagagtgagactccatctcaaaaaaataaaaaataaataaataaataaagtaggtcatttgtgttttcttcagagcatttaccatattcataattgctactctttcctcctgtttgacccactaggaatggaagctacacgagggcaggaagcatgactgattttttttttttttttttttttttttggggcagaggggacagtttcactcttgttgcccaggctggagtgcaatggcacaatctcagctcactgcaacctccacctcccaggtgcaagcgattctcctgcctcagtctcccaagtagctgggattacaggcgcacaccaccatgcccagctaatttttgtatttttagtagagatggggtttctccatgttggtcaggctggtctcgaacccccgacctcacgtgatctgcccgcctcggcctcccaaagtgctgggattttacaggcatgagccaccgcatccagccctgatttaactactgtttccctagaactcagcacaacatagagacttgttgagtaagtgacttttcatttaatcctcatctctagttaatactcccctttacagataaaaaactaaggcttggagaagttagaaacttattgcagatgacagaatcacagattcagatccaggtctgactatttcaaagctgtgtcccttgcaccttgatcactttttatgtgttaaactggtactgaaacaccagactaagtacaaaaagcagcatgactgttgactctctgggtaactctggagaagtttcaggataagttattcaagattacattgatcttttccttgctgattctccctagggtatatcaaagagaaaactgaacctgaaggccggttaaacagaccttcggtcatctaccaaaatttgggtgactattaaatagaccatggaaggtagacttctcgtgaaatcactccagaatgagctagtattactgatggttgttttcatttttttccagttttgtcaaaattgttagctctagccctcaaaattactttatttcataaagtaaaatttaaagttgaataaaaccactggctaacgctaggctctttggagaatatggtagttaccatacactaccagtatttgctggggctgcaaaagatcattccatttcattgattcaacaaaacactgtactgggggatataacagcttatacatttgtggacggattctacctaacattgaatacttggactgttttaaatgcatacataaatttcaaatgcatacataaaagatgagcatatctacttatgaatctagaagctatatcaccatcttcacttaatagatgagcaaactgggacacaggctcaataatttgtcctggtcacactcttaatggctatactaaactggtctgaaaactgaactcaaataccaatattttaaatttcagtagcatcaggtggcagtgagatgtgataggttgataaacatatcatggaagaagcatgagactcaatttatggaattggttagaagaggccttagagagtgcatgttcttatggcattcattatatagggaggtgactgaacctgtactcttagtaaggggctgagccatgaccagaatgtagatcatgacttcagtgttctttagatttacagcatgcaatatacttactcatggaagcatattataaacacctttgggaaacagccaatataagctctgattgcaatacaggggtaaagagctatcattgaatcagattcccaactgttttttctatgtgcaaaagtcctgcaggtaattctgatactcccatgccatgctatctgctttaatgcaagaagttattttcagtttgattttagaaacacttaggcagggtctagtctgccttttgccattgcatttttgtttcattgtttatttattgagatgaggtcttgctctgtcacccaggctggagtacaggggcatgatctcagctcactgcaagcattggccccccgggctctagcaatcctcctaccttagcctcctgagtacctggaaccacaggtgcgcaccatcatgcctggctaattttttgtatttttagtagagactgagtcctgccatgttgcccaggctggtcttgaactccgccttggcctcccagaatgctgggattacagatgtgagccactgcacctggcctcattatttttatgcttttttgagataagttcttgctctgttgaccagcctggagtgcagtggtgcaatcacagctcactgcagcctcaacctccccaggctcaggtgattctcccacctcagcctcctgtgtagctgggactacaggtgcatcaccatgcctggctaattttttgtagagactggggtctccctatgttgcccaggctgatctcaaacatctaggctcaagcgatccactcgccttggcctcccaaagtgctgggattacaggtgtgagcctccgtgcctggcctgcttcattgcttatgatgatgaaaaggagtggtgggggaggataaggatgggcattcccaggacaaaaaggtttcctaacatgtgaccttgccttccagccacatctgactgaactagagactgctgctcacactggatggccagaatgaatcagatcatgctttgtgtgtatcatagctcaggtgcttatataagcaaaccaattaggtgttcataggatctggaattaagggtaagaatcacggtcaaattgatcacaatggcaggtctaaatcctgaagatgaatgatgaggcagagccagagatgtggagtgggtagctggactgtacagagagatgctggctcctaatgtcgcagtgctgctcagattcagtcaccacgagacccagctccactgcttcctgtctcggcttctgaaacttgcagacttgtaccttttactgatgttttaaatgggagaaaataattttcagaggtctcagtattttctgaagggcagacaaaattttccctgaaatatctttagacttaaataatttctgaaaatattcaatctaaatagccactatgacaaggactttagaatttatatatcacaaaagacaggcagacggagagaaagaaacaagaagaaaacaaaaaaccatggtaggtgctcaataaatatttgttgactcagtaaagatagttttgaccatagaattaaaaaggttttgcatttcatatttattatcagtgcttcaatatagaatgttttgtaatgattagcaacattgtaaacaccaccaggtttttccaacactaactgctagtcttttccagtaaatattttttccccagacaaaataaccaaacctaacacaatttcaagagatggtgataccatcagcataataacccaaattacaaaaatggcaatacttaaaatcatgcatattatttcaccatttcataaaacttattttaaaatttctacaaactttcccagtgtaaaagactcctcaaaagctgcatgataacattaaactacaaaattcactttggaaaagtagggagttatttttctaattttagcttttttttttttttaaatgggttaaaagatacggtgaggagtgtgttgagagaggtggagaaaaggagcttccagtcaatgcattcaccatatctgaaaatacttcagttatacaaagggaacacttcgagagtaaggatatattataaataagtctctcagcaagatgaacggatgaacagttcaattgcacccacaggagagaggtcttcttggagaatgcttgtttatagaatcttctgtaaaatagagttggctacttctaatgattcatcttgtactaaaacaatatcataagagtccatgtacttttctaaaagctcatccacctaatcaagagatgaacaaaagaaaattaacatgcagggcaaagaaacaaataatttcagtatgaatctcgttgttagatctcttgggcaaaatgcaataaattaaattcactttcaaaaaatctttgaaatgaagaaatattttcaaatccttaagacccactgacagacatttttccacatggtagcttttctccccaaaatgctctctctccagtccagtggctttcaaatggggtgatttttgtccacggaacatttagtaacgtctagggacatttttgagtctcatggcaggagactgctatccagcatctagtgggcagaagacacagaggcctcctacagaatacacatcctcccttttcccagtacctatagcatgcatctcagctcctttttaaacatcaccagtataaagaacaatcaaaatgcatgatcacaatatgttttggctgggcatagtggctcacgcctgttatcccaagcactttgagaggcctggagaatcacttgagcccaggagtttgagaccagcttgggcaacacagggagaattcatctctaaaaaaaatttaaaaatcagccaggtgtagtggtgtgcgcctgtagttccagctacctgaggggctgaggtgggagcattgcttgagccgggaaggtcgaggctgcagtgagatgtgattgcatcactacactctagcctcggtaacagaggcttgtctcaaaaaaaaaagtctctaaaataactactttctcaggtgactatggcaacaattgcctatcaagtttcatcctaatattttcttcgaaaaaaattacagatttgtatacttactctatcatttagatatccaattttcagaatgtgctcaacattggccactccatctgccattcttaagtctccttgggagtctcccagaagaattatgttactattgtcttttagttgattgaaatattctgtattcctcaaggcaccatcatgtttgttaaatacatgaattagttctcctttaaatcctttgagcaccccctatgaaaaatataaatcttttgaacaggctttaaaaattctatttgttggattttcatattttggagctcttaattgatgtcactattatttcatcatatttgtaaatacatctttgatactagagatctcaaagcacttaagtccatcacattcaccatagctaagaagggctcggagaagtaaatgattttttagatactattttaaatggtaaaacaaaggccgggcgcaggggctcacacctgtaatcccagcactttgggaggccaaggaggacagatcactcaaggtcaggagttcgagaccagactggccaatatggtgcaaccccgcctcactaaaatataaaaattagccaggtttggtggcacgcacctgtagtcccagatactcgggaggctgaggaaggagaatcgcctgaacccaggaggtggaggttgcagtgagccaagatggcaccactgcactccagcctgggtgacagagtgagactctgtctcaaaaaaaaaaaaagaaggccgggcacagtggttcacgcctgtaattccagcactttgggaggccaagatgggcagatcatgaggtcaagagatcagaccatcctgaccaacatggtgaaaccctgtctctattaagaaaacaaaaattagctgggcttggtggcacgcacctgtaatcccagctactcgggaggctgaggtagggagaattgcttgaacctgggaggtggaggttgctgtgagctaagatcaccccactgaactctagcctgggctacagagcaagactccctctcaaaaaaaaaaaaaaaaaaggtaaaacaaaatgagttcaaaattcaattttcagtttttattttgtttctaaccaaaatatcctattttatgttattttatgtatttcataatatactgccttgattagaaaacgttattcaaataatgtcagttctaactcacttctttttccaactatgaatgttaaggcttcaaagttgctgcattaaaatattttaaagtaagttttaggctatgtgtggtggctcatgcctgtaatcccagcactttgggaggccaaggtgggaggataacttgtggtcaggagttcgagaccaacctggccaacatggtgaaaccctatctctaccaaaaatacaaaaattagccgggtgtggtggcagacgcttgtaatcccagctactcgagaggctgaggcagaagaattgcttgaacccaggagacagaggttacaatgtgctgagattgtgctactgcactccagcctgggcaacagagtgagactccatctcaaaaaaaaaaaaaaaaaagaagaagttttactacttttattattagtctatagcttggggaatgaaagtttaagaagggcacattgtttttaaaatatggatatattaacactgagaaggatggagtcccacagtgggcctatcggcttggcctaatttctggatataggatatatattaagtaacaataaataaatttacatgattaaaatattttcagattttaaaattatgaagaacgatttgatattcttacagtttcatcaaaatccataaaattggacacaactttgacattgggatgataaacaccagcttgacgaataacttcctctagtacatcgccgattccagccgaaaatatgaacacggggatgctatgttgttggagcttatcaaagaaattctcatatccttctctgtaagatggagataacaaactggttattaaagagcaagatatagttcctttttacttagaagctaaaaaagtgaaatattcctagtaattctatggctcactcatattctcatttcaatatactgcccaagagggctgttattgatatctacaatactacaagtttttcaaacaacagttaactctttactttccctttaatcaattctaatactacaaactagatgtctttaagctttcactgaatatgaatataaacctacagttcacaatttataccatttaaaaagaaataggcaggcatagcagtgcatgcctatagtcccagctatttgggaggctgaggcttgaggattgcttgagcccaggagttctagtccactctgggcaacatagcgagaccctgtctctaaaatgaaatttaaaaagagaaaacaatagttaagctacaccttgaaaaccccacttaggggttaaaacatggatatattaacactgagaaggatggagtcccatagtgggcctatcaacttggcctaacttaatggatatatattgaccaacaacaaatacatttacatgattaaaatattttcagattttaaaattatgaagaatgacttgatattcttacagtttcatcaaaatccataaaattgaaaagaaaagcagagtggcaggaacttagatgtattctcgacatctggcatgtgtctttactaagatcttaagccctcttcccttttttacccttcctgggccataggttaaagaatgctaatgttgcctactaaggaatgaaacacttactagctgtcctcacactttttctgacaatttattgctttcctttttagaagtaatcaccttaaaatataacatcatcataaaaaagtaacatcatcatatttgcctaatgagttgaaaattttacgaggtaataaacagtattaaacaggctcttgggccgggcgcagtggctcacgcctgtaaccccagcactttgggaggcggagatgcgcagatcacaaggtcaggagatcgagaccatcctggctaactcggtgaaaccccgtctctactaaaaatacaaaaaattagccgggcgtggtggcgggcgcctgaagtcctggctagtcaggagactgaggcaggagaatggcgtgaacctgggaggcggagcttacaccactgcactccagcctgggtgacagagcgagactccatctcaaaaaaaaaagaaaaaaaaaagcttcttgtatcttataactcatgcatacatatataattatgtactaaaacatactaatctttcctaggaatagttttcaaagaagttcgagaatttaaaaagtaggcttatgtaaatttagacatagtatactgccaggcatggtggctcacacatataatcccagcactttgggatcgcttgagctcaagagttcaagaccagtctgggcaacatggtgaaatcccatctttacaaaaatatacaaaaattagccaggcatggtggtgcatgactgtagtcccagctacttgagaggctgaggcaaggggatcgcttgagcccaggaggcagaggttgaactgaggaagagattatgtcactacactctaacctgggcaacagagagagaccctgtctttaaaaaaaaaaaaaagtatacttaaatcccttttaacttgatttatacattcctttcatatgtctttcctaagtattttgctaaaaaatttttaaatggccttggttcaaaaattttaagtcttgacatttttaatctggagaaacaaaatacaaattagaatttaaatctcataaggctcttactacctacaccaagatctaatacgtcattctaaattccttatcttaccactatgtattttgtgataggtggcatattttggatatggttatataaggaatattcaatcttatttttaaaaagtacaactgactacataaatagcaataattcaagtctgtgaacaataacagcaaaaaacatccaagaaacttacttgagcataacgtcagattctgccacaatttctttaagtttagcttttggtaaagcttgctgaacaagcaaaccatgtgatttagtatacctggagtttatgaccaaaggaaaaaagactatcaattaagacaaactaaaattattatctttattacaaaacattcttccatgtgagaaaatctgttcctcatatttggatttaaattttagagattgaagttcatcactaatgaatgtatacctcatgtctcaaaatgtgatatgcatgttcttactgagtttcccagtcctcccaaacccagacttagcttaaatatgttagtaaggtaatgaaaggaaactagctataaacctttcctaattctacacataaaaactcaacccaacctatggaagcataatcctttctctgattgcagtaaaatgaattagagcaaccccatttttaaaatttgtttgtagtttgaattttctacatactgaagatgctacttagtgaacaagagagaaaatctttgttatggcaagtgtcatatacagattagcctgctttatgtagaaaacacctataatcatagcatctcagtataaagggcccttagactctctaacccattacaattatgcaaacagccactaaaaacagaaagaaagaaacgaaaagaaaaaaaagcctaactcttcatctgatacctaaaaatacccctataatattcctaagtcaccttcttccctgcctgggtcagcttctaacatgtcagtaagctcattctcccagggaagcttattccattgccagaaaactcttaattgctagacaggcttttcatttctcatgctgaaatcaatcttcttatatcttccaagtctagttccagttctgctgctaccagtttgtagagttaagtctaatatcttttcaacatttagtaccacaaatacagatgaagtatgcaactgttacgtaacgggacaataaagacaaatcattcctggtctcctaagattttaaaacaagttgttccttctcaaatcaaagcattttctattccttgaaatgttcgtcaagtgggaaggctcaaattcctctgatcattctggtggactactctgactccttttaagtttgtcatgatctattttttttttttttggtcactattgtcatggtttctcttaacagcattcttccagaatccgacacagtgctttcagtgtgatctgcctggaacactgcattttgattaatgcaaccaaaggtcgatttttgggtaaccatatcacctgctggctctgagttcagactcagtttaaatcctcataccttttctttacacattaagccacgttttgttcatatacttaaaaaaaaattcttgtttttaatttgagacttaaatgcaggacttttaatttattcctactggacttcaccttaaataaacaaaacaaaaggattcctaaactgttagagagattagataattagagctcattttgttattcaatgctctaacttgcataatttattaatctgtttgtttgcaatacaggtaaaaaataagccatcagttgtaactgcagtgttgttttattatttttttttaatcctcctactgcctaatatacacttaccattccaccatataagggtacttctcttctacagtaagaacaggatcaacttcaatagcgtaatatttttcctttagttgcaataactaggaagatatgaataacttaatcatgaagattacttgaaaataaatctgcttggttttatagaaagcaaaacaatgtaaacaagtattttcaacaaactgctttaaaagttgagctaatgcatcaattgaaaaaatatttgttgatcttagttgacatgtaatcaaatatacctgcaaaaagctacctttcttttgtaaagtactttcagatgagtaaaaaccaacaataaaattatcagtacaaaaaacactttagttttcatataaaggtattaaatttgattcacatttcaaattgcattttgttaagatatacacagacacatacatactcaagcgaagtactgaagcaacttcctcatcaacttaaaggagcaaaacctatagaaaactgaagtacttttgttttaaatctccagttaacgttacaacaccagaatactttggtaatcatttaagagttttaaatataagttttgttgtcaagttactgtgaatttttatctttaaaatatgttttgaatgtgtaattcatacagcaaacctactatttactgagtgcttactatgtgccaggtatggctgtaagcactttacatccattcttacttctgtgaatgcacctgaagaaattctcaggcaaaaagggtaatgaagtctttgagtgactatagattgttgttagtgtttaccttttttctacattcatctgtaaccagcttacagttgtcaatgatatctaaagatagaaagcaaaataagcattaaaagaaatactctgatttatgctaccactactatgaataatttgctataaagtaatggcaaaaaactcaattacttttgcaccaacccaatacttttaagtaatgccaagtcaactagcatggttattataacttttggtgtcagtggtataattcacatgacattgttaaagaagctaatggcttaaaatctgagattcagtgactgctcgcttacatcactgagatagacaattcaatatcttcaaatactatgaactgtgtattgatcacttccattttctactttgtaattaaatataagaaacacatatgggaaatacatttttttcgtaataaaaagataataaatgcttaacgtaaacatctggaaaatccagaccactgtaaagaagaaaacaaaaattgaatggtaaaaggttttagcattcaataataagtaatgaacaatattttagtatatttcctttcagtcttaagatttcatgtatatcaattagataagagatcataccaaatctgtaattttgaattttctttttcatttcacattgtagtctgcatttttccatgtaattaaaatttctggtatgtgagcagaaaataatttatatcatttctgcagcattaaactttttaggttgcttccaagcatctgctattagtaataattttatgttgagcttagtcaccattatttttgtgaataaagttttttaaaaactgcatttgagattattagaaattctccaaagaggacttaatagggcaaaggatatgaagatttttagtgttttttttttttttcgagacagggtcttgttttgtcatccaggctggagtgcagtggtgcgattatggctcactatagacttgccctcccaggctcaaggaccctctcagcctcccaaatgagtagctgggaccacaggcatgccacaatgcccagctaattttttattttttgtaagaaaaggtcttattatgttgctcaggctggtctcaaactcctgggctcaagtgattattccacctccacctcccgaagtgctgggattacaggcgtgagccactgtgcctggcgatttttagcatttttttaatacaagttatcaaaataatttttcttttccttttttacttttttttgagatgaagtttcactctgttgcccaggctggagcgcagttgtgcaatcttggctcactgcaaactccacgtcccgggttcaagtgattctcctgcctcagcctcctgagtagctgggattacaggtgcccgccaccatgcccagctaatttttgtatttttagtagagacagggtttcatcattttggtcaggctggtcttgaactcctgactgcaaatgatctgcccgcctcagcttcccaaaatgccgagattacaggcatgagtgaccgcacccagccccaaaataatttttcaatttacacatgtactaaaagcaaatgagagagttcatttcaccgtttccctgtcaggttgaagagtgttattttaaaaactcacagccaagttggaaaacaaaaaagacattaaaatttggtaaaattcctagaaaacaaagtatttgataaatggtgtttcttcaggttaacccaaagtttacaacctatttaaatatttcttgaataatgaatagaccatatttggcaagaaatatttcaggagtctctgattccctttgctaccaaaaccatacatgaaaataaccatttatataatatgggaaaaaaaacctcaaaaatataataagaaaaagcaggtctcctcactgtcaatgtccaagaagaattttaaaaacccagttatctcacaggtaatataaagaggatcttaaaataatgatgacatgcttttgtgaatttgtttacaaatatcacacttactatgacatgttgggcatcttttccctttatatgaaaatctactgagtgtcatatcaaagtccgttattatctgtaagaaaagagtgaaatgcattattgtaaacatagcccacatggccagaatttctctgtgctacccaaacacatacttcatgctttcctagatgcataggactgtgctcaagtctctggtccacactgttaacttattctctttacattgaattttctcatgcggttcctttataaagtcctgggaataatcttaactacaaggtgctaccttgagtgccctagtgttttcaccaaataaatctgattcgtaattcagccataaaaaacaaagagatgctgtcatctgcagcaacatgggcgagcctggaggtcattatcttaagtgaaataagacaggcacagaaagacaaatattatatgttcttactcatatgtgaaaacttaaaaagttgatctcatggaaacagagagtagaaagacggttaccagaggctgggaagggtgggagggttggtgagataaagaacagctggttaatggttatgaaaatactgttagaaggaataagttctagtgtttacacagtggaatgactatagtaaacagtattttattgtatatttcaaaacagctagaagaaaagatttagaatgttcccaaaacaaagaataaatattagaagtggcagatatcctaattaccctgatttgattattgcacattttatatacatttgaaaatatcacatgtaccgcatatatatatacagttattatgtatcgactttaaaaattgaaaaaatccagccaggcacggtggctcatgcctggaatcccagcactttgggaggccgaggtggggagatcactcgaggtcaggagtttgagatcagcctggccaagatggtaaaaccttgtctctactaaaaatacaaaaatagccaggtgtggtggcatgtgcctgtaatcccagctactcaggaagctgaggcaggagaatcacttgaacctgggaggcgcaggttgcagtgagctaagatcatgccactacactccaacctgggcgacagaataagactccatctcgaaaaaataaaacaaaattaaataaataaaaataaataaaaatttgaaaaaatctgattaattggtatgggaatttgcaattgcaggtgatatggctactcttctcactagagattttcgaccaacttggtcaatgcacaaaaatgcagtggaagcaattcaactatatgaagctcttagttactgataccattacatgctggatttaacttgcttatttaaactataccaatgaatgaatgcacattgaaatagctggccagctcttgaaacttaggagactgggttaaatattatttttcagaaatgttttaaaaaaggaataatttttttttttacagaatatccagattgttgatttaatttacatgtaacacattcctttaaaacagagacaactttttaaaaactcaattatccccttaataaggctgtatcttaatctgaactactatgattaaaacatgaaagagcagcataaaactaaacacttttaaatattatccttaaaatggtttaatgcttgtacacagcatgagttagcttcttacttaagactaataaaaacttaagagtatttcaggattattaacttttgtttttccaatagggtattctgtctgttttagaacaactcaagatatatattttctggattttatattcctaaaggataggcaaaaactgtctacctaaacttgctgtactcagattttatcaaacaggagatgaatgagtcggctttaacattaaaaataaaataaggctgggccatgatggctcacgcctgtaatcccagcactttgggaggccgaggtggatggatcacttgaggccaggagtttgagaccagcctggccaacatggcgaaaccctgtctctactaaaaatataaaaattagctgggtgtggtggcaggcacctgtaatcccagctgctctggaagctgaggagggaaaactgcttgaaccgggaagcagaggttgcagtgagctgagatcgtgccactgcactccagcctgagcaacagagtaatactcagtctcaaaaaacaaaaaaattagctggttgtggtggctggcacctgtaatcccagctgctcggggaggcggaggtacgaaaatcgcctgaacccaggaggagcaggttgcagtgagccaggattgcgccactgcactccaggctgggcaacagagcgagactccatctcaaaagaaaaaaaaaaaaaaaaaaaagaagcctttattattaagcttttatttttggagtgcagtggcatgatctcaactcattgcaaactccgcctcccggggttaagtgattagcctgcctcagcctcccaagtagctgggattacaggcatgcgccaccaggcccggctaatttttgtattttttagtagagacagagtttcaccatgttggccaggctggtctcgaactcctgacctcagccttgtccacccgcctcggcctcccaaagtgctaggattacaggtgtgagccactatgcccggccatttttttttttttttaaatagagatggggtctcactatgttgcccaggctggtctcgaactcctgggctcaagtgatcctcctgcttcagtctcccaaagtgctggaattacaggcatgagccaacacacacagccaaggcttcttgataattattcacctgaagtttggcagctcctcctttgataagaccacagataatttcttctactcttgtagggttcttgattcgaactgaacttttctggaattctggcatctaaaagtaaaagaaaattaattaattagttttcattcttctttccccaggttcctttgataccaagcagaaacctgtcttatttaaagacataaaaatattaaggcattatttttaaaaagcaagccaccacatcaaattaccgtttatttattttgttattacttttttagagatgaggtcttgttttgtcaccccggctggagtgcagtggcacaatcctagctcaccgtagcctcaaactcctgggctcaaatgatcctcccatctcagcctcctgagtaggtagaaggcatgcgccatcatacccagctaatttttaaaattttctgtagaagtgagtgaggtcttgctttgttgctcaggctgatcttgaactcctggcctcaagcaatcctcccatcttggccttccaaagtcctgggattaaaagtgtgggacaccaagcccagctcccacattaccatttatacacacaaaaatacttaaaacttatcagtattttccagctacagagtaagataaaactacatttgtgattcaattgctttatcagaaagtatatatctttttctaagtataaaagcaatgcacgcttaccacagaaataacagtaaaaatataaaaaagacaataaaaactgcctggagttcaactacgtgaagataaacaagtaacatttaaatttattttctattagtttcatttctgtgattttctattagtttcatttctgggttgtgatgcaatccagagagcccagaaatcatattttaaccatgaataccccagcagctacccctcgattgattaatttttctaaaaatcttaagatgactcccgttaagcctccattttatataatacagtaactaaacttccaccctaatactaatataataccttcagcatatccctctgaaacatgcatatatacgcatatagttttagctcatcctcattatatacttttgcatctggcttttatgaattaatacatacatttagcttgcctacatatttatattttaaaatgttcctgagcagaaaggaagcaattatcacaattattcccccaaaagtttgtctttgtataattaaaatacatttaaaatattttaaatttgaaaagctgcttcaagatctttgctctttttattgtactattttccaaataatatactgttcttggcacacattttacaatagatttatttcaaatggagataactgccaaaaagtattgtgccaggcacagtggcacatgcctgtaatcccagctacttggaagctgacgatcactggagcccaggagtttgagaccagcctgggcaacacagcaagacccatcttaaaaaatgggtgtaggctgctactacagagttatgaagactttagggttgctcaacaatttaatcttaagtattatttcttgttactagctattttatcacaaatagaatgaaactgattagaggaaaaatcagtacaagctctcatagcacatgtacaatacaactagaaggagaaaattatgcctcattttatagtcagttatacagcataggcaataatagtacctcaaatccaagttctatactggtttgtactggataatctttatttatatgtttttattctgggtatgttattagtaatattaacatagttcatgtgtgtcatggacatggttacaaaaattccctggaccttctatctttgctacaagagaatctcaccacgtaaatctatcagatgccgtgttgttcctacataatgggcaagagtagaaaaatcagaaaaaggatggactgtcttccaaagactggaagatgataacgaaagtgtagaggaaagaggccgggcacagtggctcacgcctgtaatcccagcacttcaggaggtcgaggtgggcagatcacgaggtcaggagatcgagaccatcctggctaacatggtgaaatactgtctctactgaaaacataaaaaattagctgggcgtggtggcgggtgcctgtagtcccagctagttgggaggctgaggcaggagaatggcgtaaacccgggaggcagagcttgaaaaaaaaaagaaagtgtagagaaaagacaaatgctaacattaaaattttctccatggatgaaagatctaccacctacaatatatttaattttaaaaagccatatttaagtaggatgacctgcaatgcaactaaccttgatgtagtaatccttttaactcaactggatgagtttcaatggcttaaaggttatctatgtattttatagtgatttttcaatagatggaaaggcagataggcactggttcctatttttttttttcatacattaacccattcactcgcctaaccaatatttaccatgtgtctactttgtgccacacactcttgctaaatgctagggatatgatgatgagtagtatttactctgcttttctgctgagttttagggaccactgctgttttggaatatcacttctgtaactcccttacaaatacctcagctagtaagtttatctcttgacaactaatttctgttcttacctcagccttaactggcagatgcacagcaatcagcatatgtttgattcaataaccaatccattatggtgaaagcaacacaggatatatatcatagactattttttcaccaaaaaaattaaatatttgatttcagtgtacccaagatgtcttacctcaggcaaatcacagcttcaagtttttgataacggataggagaatcacaccaagaccacttcgaagaaggctggtttctgctacactaacaaatgtaagattggtttattttatttttatagagataaggtcttgctgtgtttcccaggctggtctcaaactcctgggctcaagtgatctccccgcttcagcctcccaaagtgctgggattacaggtgtaagccaccatgcccagccaatactggtttactttaaatcacaatggatgaaagagaaccagtagctaaaggcattggtggctcctgtgcaacatacaaccattcattttcattgtgtattcataagtagtgaatacacaaatggcacgggagtaaaataatgatgaaataggtataagaaatataaaaatgaccattctatctgtcttgggttatatagtatactatactcctctcctgcaatacacaattaatgtcactgatctatatgagaaatacttcacaagaacttgagatatggggtattttactcaaatactttacaatatagcctaagaaagagaatcaaagactcctgtatggaatatgtcaaagagtatcataatataagcacactgtagaagtatgatgaaatacatcacatactttttgttgtggtggttgttgttgaacatgccccaactgttgcatgagatcacatacttttgttacctccacaaagtccttctgtctatatccctcttataaaaacacagacttggtttggtggcatataaataatgatacttcaaatttgaagggcaaggtattttgaattgtctgaaaaattttcaatttgattatgataaaattttatgaaaaataaataagaagctaaaaatttccatcatttgtgataaaaagagaacaaattcattttatggtaaagccgcagcgtaaaatgttggggagggagcaatgccttcctgaaaagaatcagggtatgttggttgattgatgccaatctgaatcaacaccaaaaatgattaagaaagacctaaaattcacttattttgaccaatacttaatatatttatagagatgaaatggatttcaaagttatgccattttatccacaactcaattgtttaatattagatttgatatgatcttgtggatacactgggataagataaaaatgtgaagctctggccaggcgtggtggctcaggcctgtaatcccagcactttgggaggctgaggcgggcggatcacgaggtcaggagatcgagaccatcctggctaacacggtgaaaccctgtctctactaaaaatacaaaaaattagccaggcgaggtggcgggcgcctgtaggcccagctactctggaggctgaggcaggagaatggcatgaaccccggggggcggagcctgcagtgagccgagatcgcgccactgcactccagcctgggcgacagcgagactctgcctcaaaaaaaaacaaaaaaaaaaaaaaagagagaagctccatagtacagttaccaaatttctgggtgtggcttggtatcatcaatccaatgataatattccagactagggataatcctaatttccaggatgagattatgacaacttcaaagtttaattctgtttgaactagatttcaaattatattaaattttgattaaaaaagaaaacacggccgggcatggtggctcatgcctgtaatcccagcactttaggaggccgaggcaggaggatcacttgggctcagcagctcgagaccaggctgggcaacgtggcaaaaccctgtctctacaaacaatacaaaaattagccgggcatggtggtgcacatctgtagtcccagatactcggaggctaaggtgggaggattgcctgagcctgggaggcagaggttgcagtgagctgacatcatgccactgcactccagcctgggtgacacagtgagaccctgtctcaaaaaaaaaataaataaataaaaagattttgtattaaaaaacacacataaatacattatatttaaaataatgaattattattcttaaactaaaaataaaaaacaaaataaactaagggttatacaatccacaatgtacagagaaaacaattcatattttaaccaagactaaaaaaattacttgtacttttaatttataaatatgtatgttcatctatatgagtttcatttatttattatttttaaaatttatttttggccgggcacggtggctgacgcctggaatcccagcacttagggaggccaaggccagtggatcacctaaggtcaggagttcaagaccagcctggccaacatagtgaaaccctgtctctattaaaaatacaaaaattagctgggcatggtagcacatgcctgtaatcccagctactctggagggtgagacaggagaatcgcttgaacccgggaggcagaggttgcagtgagccgagatggcaccactacactctagcccaagtgacagagcgagactctgtctcaaaaacaaacaaaaaaaggccaggcacagtggctcatgcctctaataccagcactttgggaggccaaggcaggcagatcaccagaggtcgggagttcgagatcagcctgggtaacatggtgaaaccccatctctactaaatatacaaaattagctgggcatggtggcatacacctgtaaccctgttacttgggaggctgaggcaagagaattgcttgaacccaggaggcggaggttgcagtgagccaggatttcgccactgcactccaagcctgggtgacagagtgagactcggtctccaaaaaaaaaaaaaaaaaaatttacttttatgtttttttatttttattttttgaggcagggtcttgctctgtcacccaggctggagggcagtggcgtgatcttggctcactgcaactttccctcctgggctcaggtgatccccccacctcagactctcaagtaactgggactacaggggctcaccaccaccctcggctaatttttgcatttttttgtagaaacagggttttgtagtgttgcccaggctggtcttgaactcctggactcaagcaatctgcctgcctcagcatcccaaagtgttgggattacaggcatcagccactgcacctgacctattttaaaatttttgagacaaggtctcactctgtcacccaggatggagtgcagtagcgtgatcacagctcactgcagacttgacctcctgggctcaatagatcctcccaccttagcctccagagtagctgggactacagccatctgccactatgcccaggtatttttttaatttttgtagagacgggtctcactatgttgcccaggctggtctcaaactcctgagctcaagcgatcctcttgccttggcctcccaaaatgctgggattacaggcatgagccacagtgcccagcctcagtgaattttaaatcaccttagtattatcctacatttttctggaaatagcccacataaaaattagtttgaatcacttaagaaattccagtcagatgttctcagagaaatattctttcttggttttccattgtttatatttggtagcaacaaaagacttcattactgcagtggtacaaagaagtaggcactagagtttttatccagctacacagaaagtatagatttaaagccacctattcaaactggtacatttacccccacacatagatgattctcagatttatttggaagattatgcactactaaattttagtaatagcgatttcccttgcttattacatatttggtctgtttctacattaagatagtgtaggccaaattctttcattccttcaccacatattaagtataagacagtgtgtgaagccgctctgtaagagatatataaaatataaatcttacactcaaggtgcatattctctaatgtggattaaaaaatagaaacccaaataattaatacattgccaagatgtccagataaaatgtaaaaggaatagaagaaacaaagatttcttcttctggggtcaaaggaggaagagccaacagaggtaggctctggaagagaaacaggatttagatatgctgagattagggaggaatcaaagtgcagggtctaatatgggaaaaagagaaatagctctgtttgtatagaacttgagtgtacacagagaagtgtgcatgtaaaaagtctggacagagagatctgaatcctgttcatgagaagtaaagaataacatgctataaagttgtcaatataaaagacatatatatatatatataattttttttttttttgagagggagtctcgcattgtcgcccagattggagtgcagtggcgcctctcagctcactgcaagctccgcctcctgggttcatgccattctcctgcctcagcctcccgagtagctgggactacaggtgcccgccaccacgcctggataatttttttgtatttttagtagggacggggtttcaccatgttagccaggatggtctcgatctcctgacctcatgatctgcccacctcggcctctcaaagtgctgggattacaggcgtgagccaccgcgcccggccagacctatcaatatttttaggaaagcaaacccaaggtaaaaattgtgtaaattaatgcaataatagttaaaaaaaatcttttggcttgttttccttcaacagtctgaataactgtggagtgaatacactgctacttgcctccacaaacaccttctagagggctctaggacccaagtaacaacattatacaaagaggattaacattgtttatatgtcagggaattcctatactgcttgtgttcacgtaagttaaaaaaaaagtcaacccaaacaagaaaataagttttagactggtttaattctatgtatcaaagagatatgctcaattccaatgaatcaagtgccaatccttcaatggatagaaagagctgttattaggttgaaccatataaaactggcaatactggactatatttgacatataaaaacaatttcatacgcttcaacctaagagcaataactaaactgacgatgacttaatcaccattttgagtcaactttcacctttgatcctacactggttgggggaaagatgaacaagagatttattaagcgtgacaaaatgctgtgtcacgctctagtttataggccagaaaaaagctagagagaaagagaaagctgaaaaaataaatggaacagaagaggaggcacaacaataataagaacacaaagagaaaacaagagatcatgaggcagttgttctctttaaaagaaaggattatttttaattgttgtttttaagattttatcactgtgaatatggagaacagatgtaatttctttccacacatgcaaataaatatgccagttacacagttaaaacactcactaacgtaatagagtagatcaatatttaatgaatgcttaatctggggttactaggaacttgacgttttcactgagtatgaataataacacatagttggcggtttcacacccatttcttaaaggtaagattactgctctcattcagggctatagaagctaataaggaatgagttttttttttttttttttttttgagacggaatctcgctctgtcgcccaggctggagtgcagtggcgcaatcttggctcactgcaaccttcgcctcctgggttcaagccatcctcctgcctcagcctccagagcagctgggactacaggagcttgttaccatgcccggctaattttttgtatttttagtagagatggggtttcactgtattagccaggatggtctcgatctcctgacctggtgatccgcccgcctcggcctcccaaagtgctgggattacaggcacccggccggaatgagttaagatacgaagccagttctgactccaaagcctgtacatttcctatctcatcctagtatatataatgcaactctattgtcatgcaagtaagtattttaaaaatttctgaatgcttgtcatttaaatttggaaacctacaataatgtatttcacactgtacgatttaagtgtgttattgctgagcaaagaaaatttagcgtaaaaaggaatggggaaacattttatattctgagaagcacgacaatgtgcattagatttcaagcaaaaacattttaaagataatttgaaattcaattcaataagtatttgaggtttattttgtgatgcactgtgaagaaagagttgtataaaatttcagtcccataattatctggttagagacagaggtaaaagtggtgaagatttaccattaataaatggaactggaaataggcaaatacccaccattttcacatgtacggcagactcttgattagtcatttcttggttatccaatcttctggattttcccaggtgatgtcacagcaaaagagaaaaaaaaaagtacacgtgacatacataaatttcaggttcttcctgttatgccaataatatattaaggtggaatttttggtatgacttatttattttgttttttaaaaatgtttattttatgtacaaagaactaacatggtttctttcattgggtggatgccttggataatccattcaaggaagatcacttagtccaactcaatgaaacctatgtcctttgcatactgatggaaacaccggcggcacatattgaggccgtgtttccagatcagactatgctggtttgggcagatgtgacaagagtgagaaccctggcccagcttccgtgggtggctccagtagggctgctggtgacccatcttgctttcgggagtgcaatgaggcaaaaggctttgctatgatttaacatagcctatatttgacacataaagcatcttttttttttttctaagaagctcagcaagggttttactctatccagcatagttttagattaaccattttgtatggagaatctgaagctctcctgtaagaacttatatggtattaagaaaattgaataaacagtgaaaatgaagtacatatttgcaaagagcactttattgcaagaatattttatcaacactttctctacatgtaaggatgaagtttgtgggaaaattatgcattgctactaccgaatcaatataggaatatacagacagaacaaagtaagggaagacataacacaaaagtccattttttccttcaattttcttacattaaaattttatttttatttttttattttttatttttattttttttgagatgcagtcttgctctgttgccaggctggagtgcagtggcatgatctcagctcactgcaacctctgattcccgggttcaagtgattctcctgcctcagcctcccaagtagctgggattacaggcgcatgccgccacgcctggttaatttttgtatttttagtagagatggggtttcaccatgttggccaggatggcctcgatctcctgacctcgtgatccacccgcctctgcctcccaaagtgctgggattacaggcatgagccactgcgcccggcctaaaatctttaattttttaatatgatatgactaagacatgagctgtatttgaatcgagcattgtgtctagcacaaaataggtatgtgagagtgtttatcaactgaatgaaccttttagggtctgggtgaagtttaaatatatctgttcatcaaacaaaaggaaccagtttttaaaacatctctcatcattattctaagatttttggttgttgctgtgttggtagtataaatcttagggaaaattactaagctatgtttgttccataatgactttacttttactttatttcagataagtaaaattttataattaaagcactatttaaaaatggcaacttagttgaaagcgagaacatatctgactttttcttaaactctagtaatataagttggacattagatctgtgttctttataattaaaaggtgttatagcagatatatcaaattttctcaaattctaaaattcggtccctactcccttccattttaagtccatgaaattacaaaatgtctttttctccctctctcagaaagcctgctagtaagttgatagtctcataattgacggcatcttagaattgagtaaacacgatttccaaacagtaagatgataacttgcaatttttcacatctgaaaaagaatgtatctgcagtatgagtgtgtgtatatatatcgatataaagatgtgtatgtgtatatatctttgtacagctatatatatacacacatacactatataactcataaaacatttgatcaccaccctcaaaatataatggtagtttggggattagtagtctttagcttagatgattatagtcaagtttaagtagactttccttggtctaacttttttctgtcacagtcatccagatttttaacaaacaagatattatagaagctgcatgcaagtctatttcttcattcatagcaatcaaagcctaattattaaatgcttacagcttttctttgatgtttaatatgtgaaaagcagtctagatttctcaaagagcactatttaaataaaactatctcattagcttgaaaaaaaggaatagtgtggagactgtggaaaagtactgtagagtttacaaaaataccgcataatctgtgaaacatttgaaaagcccaagggcaaacaattcacacagtgaagaattaaacacattttaatatctaggaatctaagatctttttgttacacattcaggtagtagaaatcctctttattctctacctctgaagtatggctctttttggaacatacattttgagtttaaaggggaaaaaagtcagtataagttggtaaaagaatgatcatctttctcatggtctcatcaaataaaaacaaagagtgataagaaatttgatggccaactttaggaccttttttttttttttggtaagtataccaacaattcatgaatactatgcaaatttcaactaaagatctttcattcttgccagtcctcactagcaatctgaccagaatttatctttgttcaaagataatctcacataaagtgatactgcagtccttatacaaaaattactctaaggtcttatcatttaaaaagtgtaaagactcaggtgtaaaatgtcagcattctggcactattctaaggaagacactgaaaattagggcagagtatttttaaaccaataggcttgtaaacctatacctggtatataaagttctggcttactttgccaatggtcatctgttgcagatgcttcaagagaagagttgctggaaaaaacacatcaagtgtagaagacgtgttcaaaaatag

SEQ ID NO: 37643 - DNA, 6229 bp, Homo sapiens
actcgcctggagcgcgcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttaatacatgtggaccatgaacagtattcattctactttttcaaatgatatgctgtagaaaatattccttgaagatgtgagatttaaaaatttttccctttcaatgttgttatgtattctactggtttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactccttt

SEQ ID NO: 37644 - DNA, 64115 bp, Homo sapiens
gctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtgagtacaggctgcgcggtgagtcccgggcgcggccggcgctgccctcggcgggggacgctccccggggctccgcgcgccaccggccctgctccctgaccttgcgcccggccgggaagctgcggggccagcgggaccctggggcgccgacgtcggggagcagagaactttctcagcctcccgcgggccgccttggccggggctgggtgctcgccgggcatcccggtcccgcccgccgggagccccgagcgggacccgggcagggcaaggcggggccgccccggggtggcgtccagtgatacccgcagctgggagcaccggggccggcgtggctcctgcccggccatccgagccggccctgaccctgaacctgaggtttccagctgctcgccggcaacccctaccccggacttaggctgcgcgccgccggatggggagagactggcgcactcttacttgttacctctgcctgggcagagggaggtgacgcgcggtgtggggaaagcctttaacttggcctctggcagccgatttaacccgagcgagcaggtctttgctattttcatcatctgtagaaacgggagttgcgaggcggatgagtgactgcaggtaaaatgaaagtacggtactcagaaattctggaaggaattaggcatttaatgtgtccacaaactgagcggggaaggaaggcttctattacataagacagcactccaccttcaggtattatggaagatgctgttgaaggttttagtgttttaatgaacgaaacacattctttgtgtgtgtgtctctggagaaatctcgaatgctgctgtcttgctttggctactttgcaggggacgttcttatatttagcatcagcataaaaaggtgttcgaaggtgtgacttcctctttcaagccaagaagccgtttatttgtctgaattgttgtggaacaatatatgtgataattgtgtactttgaagattttatatcaaaacttgagcacagataactggaagaattgtcaacattgctaatttgtatatcctaaaccacacttcgaaaattgaagacagtttcaacactatctgaaggtctaaatcagtacttatttgctatttgcagtatttcaatagaaaaatttttggctatgcaaatgaaggtactaacctgagtaatctaaggtttcttttaacccccaaattttgattctttgttaaaataatgtttgaaaatatcgtaccatgcagggcaattactgaaggtcatgaaaatgtcatcgtattttattctaaaaacaaaaatgaatctatgcagaaaatttccgtgtcccatgaacttcatattagtttaattttaaaagtactgtctccaaaaaaagctaattttcacttccacacaagggtgattaaataccagtcagagattgtttgaggtggtagagttggaaatgaggtggtgacctggccacgtccctgggtgcatctcagccttgctgtcctcttccagccagttcttttcccatcgcatggggactttggctcttgggctatttctcctcctctagacctaaagtccatgtgggggacgctctagatgcgcacttccttgactgtctcaaatccagtgtcttccatgtactccagctaccaagtcctctaagtacctccaagtcttgccctctcttgagatgctcaacttctgaaaactcttagtgcctccaacccgcaagctccttccttccgggttgcaaaccggactcccactgtaatcttcaatgcaagcgatctccaatgcttttcctcttgcgggtttggcaggtgactttgtagcccattctaccaggagaatagaggtcataagtatctcctcacgtcctcccccatctcccctgtacagacttttctgtgtttacccagtcatccaataaatcttcttaagcatctactgtgtctgggtactttgttggatactcataggtggtaaatagagcagatccttgctcgcttgaaactgtcattcttgtgggagaaaaccaactaaaagcaaacataatatgttgtaaaatgtatgataaatgaataaggtagaattataaagaaaaatcaagttagactgagaacttagagaaatatagagagatggcctccttggggcagtgactaatgtctccagctgtgtcctgaatcccaactcccagtgcctctctctccttgtgagtgttactcccttttcttacttttatcttcagtctctccctgtgagcttttttcttttttagtagtattttaagaatgccttaacctcccttgtccctgcatcctcagctcacctgtagtgacaaccacgtctctccaggcttcttaaactggtctgcccttcctgttcagctctttgcaagctggccagagtctcctcaaagttcaaggcctgtgacttcctgaacaagcaatcttttttttttttttttaatttttattaatatgctttaagctctggggtacatgtgcagaacgtgcaggtttgttacataggtatacacgtgccatggtggtttgctgcacccatcaacccatcacattaggtatttctcctaatgctatccctcccctacctcactccccgccccccaccacaggccccagtgtgtgatgtttccctccctgtgtccctgtgttctcatctgaacaagcaatcttatggatacccactaggtttctccgtggcatttgatgaggttcttctattcctttctgatggtttttttttttttttccatccctggttgccaccttctggttttccttattcctccctggcatctctgctacctcttggggttacccagggttcgctgtcatcccttttgtgctctgtgtatttgggtgaaccatgttcccacagcttcgactctcaccaatatgaagcgagtcccagattggcatgttaagctagcttgagcatgctcctgtgttccaatcagttacctgcagtctggtgcgcttacccgtgccctttaggccaaaaaaacaccccaaaataaatccaaaattgattttagttttcaccacccaccccatatccgcttcattgttagcgaagatttgtccgtttttttttggcagtggttccaccgttcatggagatgttggagcaggggtctcacggtgatgccaggctcccgcactgcccacatgcaggctgtcaccagatcctgttgcttcttcatgctgtgaaattccacaaaggtccgctctagtcacgctggccttgccttgctttagagcccaaaagtggcaaaatggtggccggtgtgccacttctagcagtaggcagcagtgttgttggcctgaacaaagtatatacaacttgagttaatatttagaaatctggagatgccacttggatgtatagcttctcctaaaagccagaagacctggatgaggcagtgcgtggtggctcatacctgtaatcccagcactgtgggaggctgaaccaggcggatcacttgaggtcaggagttcaagaccagcctgatcaacatggtaaaaccgcgtctctactaaaaatacaaaaattagctgcgcctataatcccagctactcgggaggctgaggcaggagaatcgcttgaacccgggaggcagaggttgcagtgagctgagatggcgccactgttctcgagcctgggtgaaagagtgagactctgtctcaaaacaaaaacaaaaacaaaacaaaaaaaacctggaataggaagcttacattcccatgtggcaaacctcagctgctgctgggtttccagtgcctgaatacactggaggtaggttgctttctggttcccccagacctgtgacccttgcttatagtggcgttctggctcccatgggcttcagagctagagaccctaggctgagacgatcatcgacagcctgggaatgcctagtgcttactgcacagtgtcgtgcacctcatgttgcatcccttctaactctcttccatgttattgctggtgtgactttcctcctgctgccccaaatccaagtcttcttgggtccctcctaataaaattcaatggctccctcttgatctgggcttaaatccctgactctaaaggagtggccatgtcatatcacaagtttggtatctcaagattgaaagatgagctctccgctatctttatacagtgttgtacccgagtttctgaagatgcttttgagcttctgtagggtagttaatacagagttctagtgttgatgacagtcctgctgtttacaaagcatttctacaagcctgactactgccccacttcctcgcagcccccctgggtggagatagggcagggtcgattctatatcccaaacagcagtggggagtctgtaaatatggaggcataggccatcccagggagtcccccacccttggaacatggggaaccttgttttacatgtggtatccagagtcatacagtgtgttcctgaggtcatttagacaccttagggcagagtcttgacccagaactcagttcctgtcagcatgcagccagggaactttccacagtgctccatgggctcaccaggctgctggccatttgtaatgacccaacagagtcaaagctttcttcactcccttcccatctccttgccttgtcccctgcctgaaacattcttttcttgcaaaactgaacctcccgtaaactgcactggtaccgcccagtgcttttctgcctttgctccttctgtacctctgcctggaattccctttctcctcctgtgttcattgtctggctgatttctcctttttcaagactcaggctcaaaaaggccttgctggcagtcaccaccccagccctctgtggcacatgtgcagtgtacacacacgtcacccctccccgtgcctacctcaatgatggcagttttttgtgttgtagcaacatgccctatccagtagactctaagctccagaaagacgtgcctgtgttttagttttatttgcaccagcggtggtgtgtggcccaaaggcaattaacagatgtctgaactaaaccatattcatattttttgtaagtttactgcatgctttatggaagagtgtttgtattccagactcaaaggggagctctctctgccagacctccagccctcattttggtactagcaaatttaatatatatcctcagacattttaaatttttgattaaccttgtcttttgagataaaacattacttagagaaaagcggaagtctaatacagaagcacttgtgtgcctgtgttcacttcagttatcctcatctgaacctccctttggcatggttctgccctccttgaggtctgttggctgggctgcactctgcatttcgtggttttacagggtaggagaatgcattttggtttatttctattaactttggtgatggtgatatatgacctcttggtgactttttttttttttttgccatggaacttttttggctggtatcgtcagtcacatttggtggaaagagcaggctgggagagggtatgggctgcaccaccaatagagcgtgtaggttaccatctagaactcagtttccttgtctgtataatgggtatattgaaataaatgatctaaaaggtgtcttatttttaaaacctataaattcttggctcagtttccttttgatgtggctttctcataagtgttaagtctagataaaattttttcgtaaatgcattatcctgtgctcatacaccttaaagttcttgtctctcacttttttaagcctataaaatcattcagcattatattcagaaacagcatcatgggccaacatgaagatttagtttgtattcccacttagagcatttataaaaattttaaataaattaggtcccatatacttgaatcttgtcaacctgttctccacacataaatgtgcccatcttctctttgcaaaccatctttcctcatgagtagattgcacgcctaatctgaaaaccaatgttgggtttttaaaaaatacccttagatacagaatggagtcaaatgcaataaactacatctttaggttatctcttgtctgcaagttcccaatttaagaatactgagagattagtatgattttatttctcttttgagaaataccacctcccatccaacaggccaagtctatttctacagtcagtgagtcttgcctttattctgctgttagatttctaggtctggatgtaagcccagtccagggaagtcggcatcccttctgggattctttctgtgcatgaggatggccactgagcccaagcaatcctctatttgtaattccactcgtatgttttggcaaacatgtcctaggattcctccaaaggttggggtggacaccctagttcaagattagatcaggaacacccaggcttttgccacagtttgacgtaagacattatcctttgcttcagaagatcatttgagaattggaatttacatccattgtgcctttccatttttcttatttaattctttgaagaataatatgaggagactttaatataaaagaaaaaatcccatcaagagtcagaaaggatttcctgttacggctgcaaatcttggtaaatgcactttgtttttgtaaaccgtgccccacccccaacccctagtgtgaactcgtaacctggggaatttctcttgagagcataccaaaaatagcatcagtgccttctcttacccctaccccaactttcgccctccatgtagttccagcaaatatagctatagaaaaaataaccacttgtttttatcctaagtttttatgggccaaatcttgaaggtggatgtgggtatgtgaaagagtttaatgccaaatacaaagcccactcggaaatgaataaggtgactacaaatgaaaatggatgtttctttcttcctttggggaaagtgctatgtaaataaaggcaatgtttgcttcctctactaaaatttatttctgcagtttttaaataagaaatccactcaagaagttattcttactgaggatttggtcactgttaagattataggaactattaactactgcattatcttttgcttacaagagaacaaacccaaatcaaaataactcggaaacaaggcggagagctgttggctgacactgcccactcaagcatgggagaggtgactctggccctgaagatgactggaaccaaagactgaggacttggaggctttcttctctttctccttgcctctcatctctgcttctgtctgctgattgtggttgtcctctccgggaccatgactgtaggtagctccaggcttacctccctacagcctcctcagtgaggaggaaagaggggcttttcagccagttccagccggcggggggggtggggggtggaaatcctagggaggaattctgattggcttagtttcagtcacatgctgttcgctgtaccaatggctgtgggcagaggagtgaggtcctatgattggctgatgctaagtcacatggtcacatgctcgtcccgataccaatggctgtgggcagaggagtgaggtcctgtgattggctgatgctaggtcacgtggtcacatgcccttccgtgtaccaatggctgtgggcggaggagggaggttctatgattggctgaatcccaaatcacatggtcaatccttggttaggaggaaagggagtggagaggaccgtgctgcctggcgttccccagctgcctttctttctgttttccccccaacggaatctctatgtggtctcctagagcctcgtgcctgcctctcagctagatgctgatatcattcccactcatgtagttgggaaggaagggtgtggcagagataaagggtccacggtcacgcagtatgtggggggtcacacagcctgtatgccaaagtggcacaccctgtgaatatgtagggtcgcacagcctttatgtgtcagtgccagagcctggacccgggtctgtagatgtgtgaaccgtgagctgataccatggatattcaaagatttacatcccatcaatgtttataccttcttgagaagaaatttgtgtcaaagcacactcctcctttcaagactacctcctcgccgtgctgcgtgatagccctagtatcacaaccaaaacacatgatacagaaagaggccagtatctgtgtggtacgtttgaatcatggttttatgcctttggccccctagttccttcctcagacacttgtttttttctgggactgaaatctaaaattagtactgacctttggattgagaaggtagagagatttacacaagagtccaagcgaataacttaagctgagctggataaaactcagcagaatcacagaacaagtgtgccatgacttttcaaacatgcctaattgaactctgtttgcgatttaacttctttttcaaaggtttatagttacctttatttcaaaatttgtcattttaaaatatgtgtttcctccttttcctccactgtatagtaattaagagtgtggaggatttggaggccagcgggctttggtttgaatctagaggctacatattggagggtatgagccaaagccaaatttctaaacatctccaagcccatccgtgagttgggcctaaaggtgtttaggcttaagggccacccctgaagtgttgtgaggatgaagcgaagagtatatcttaggcgctaagcacagtggcaggaatggagctgactttcgggacacgaggtggctgtggttgtggcattgggtaatatttgtcacagaagtacaggtgagcacttctctgagactcatgtcttcctcgtgtctttggcctgatgaatgagtgacttgctctgtgtctttgcatgctttgtttccagacacctttcctgctgcactctcagtgggcagtactccccaatgatcacctggtcatctgtcctgcccgcaggcttcaggctcttgtgcgttggccatgaagcaaaggaaggctgttgcatgaaataacctccttctgactccacccttgcatttgtgagatgtaaacagcagtgttaccaagaggtcttccagggaacacgttgcaggtagccctgtcatgctggctgcttttttccattaggttagttgtgaataacgaataaatgtctatgcagggccagacatgtctatgctggctcacgcctgtaatcccagcagtttgggaggctgaggtgggcagatcacttgaggctcggaattcaaaaacagcctgaacatagtgaaaccctgtctctactaaaaatgcaaaaaattagctgggcatggtgacgcacgcccgtaatcccagctacttgggaggctgaggcatgagaatcacttgaaccccggaggcggaagttgcagtaagcagaattgtgccactgcactccagcctgggtaacagagggaggctctgtctcaaaataaaacaaaacaaaaaatgtctatacagtaggaaaaataatctatttggtttaatatttaggtctctgcaagggtagcatccagaggcttctcttttcattcttgtttttctgactgtgaaaaaatcattctactgtgtccagtgatgtccagataccaagaaataactattttaaacatatggtgaatattgttaaagcacatggtgatggtcatttaattatgatttgattccgtcaatatgcaaaagagttctaagaatgttgggttaaccttagcaagcattcccagataggaaatgtgttttctgctaccattgataggatttttttaaggattttactggcagttatccactttggacttcatacagcagtctgagtatatgcccacacctgagttgttgctctaacagtgagattaggggatgccagggagaatctgtgtgatgacttaattgtaagggagagctttctttctaaaggtgtggatttttctgtttgaaatgtgtatactaaaagaatcctattatcttatgccaaacctgtgctaatttcttaatgacatgttagttaaaataacaatttggaggattggctaaggatgccacagtattcataataaatctgttcttgtgcagcaaggtggtaaatcatgaatatcaaagttctgatcatactaatttgaattaatttagcatagtggaaagtatgaagacatagtttttccaatgcatatgtcacttcttagcctaaaatttctacgagtggggcaagtacattttttacatgtacagtggcaaaattgtgcttgtgtactgctctctaccttgtgttctggttctgcgtgtgttttctctgccctgttaggaacctgcaagtggagtatcttattcttttgggctcctcccaccatagctggcacagaggagcccaaaaagtacttccaaggggagagggaagtggaaaattatgcatcatcagtgtgtcaagtactattaggcatcttttatacacgatcctgttgaatcctaacaacccttgtaaggtagaaatcattcctggtttataggtgagaaaaatgagattcaggtgtgtagaacacccggctccgattcccactgatgggatatagactccgggtctgtgtctctctgtggtggacactttggatcctgaaacgctatcttcaggaatgattgaggctaagccatgtggctgagcagtgatgcacggcctcacagattgaaggtcagagcattgctgggcagaggatgagtttagaggtcaaacaaacttggtttcaaaccccaggtccacacttagtagtgtgtggctttaggcaaaatacttccctctctgtgctttatttccatagctagagaatagagaatgatgaggatattaccctccttgcagagaaagatcacagtgtccccagttaacatgcagggaaatgggaaataggaaatacagtgactcaagttgcttggcaaaggcagggctgtggcaggttgagaattcacgtctttgactcctgtcacctgttacctctccagatgccaagtctgggtacagtttgatgacagaactgccatcacctgccactcacccttggttagcccttagcggcccacataacttggtggctcttacaacccgatcctagagtcccatggctgattcatgctctttttctctattgtgtcgtctctgtattcactcctgtgttctcgaggaagattcattctagagggtaaaagagagtccacaagacttgttcttaatgtatacaccccacacaggacaagaaggaagttgaaggtggcagcctgttgtatttgggtgacgtgcagctgaagagctagtttttgagcacttactctgtaagaggtgcttagaggggcacagaagtatctgcaaaacaggccaatctttgaggggtttatttaggtagaaagggcacatccatgatatttaataacaatttgagatagtctagaacagtggcatatggtatgggggagggggaggcaatcagggagcattgtctgtagaggatctgaaagcaaaaatgaaattacctcagttttttttattatcatggtgataaaatattcctccaccagacccaaccacttctaccactcccaccttgtccctaagtcctgtactggatcaataatcagttgccaaaatgagttgataccagtgacatgtttgggaggtcaagctggcagtggtcagtgtggactgaactgttggggaaggctgcgtggaagtcccctcccctccctctcagttaggacaggacaccaggagagcagtctgtgaccctgaagactgcagcagtccctgatgcccatgcgagccatgggccaggaaagtgctttctgtgcattgcctcaccacgtgagaggctgatagcccaagatggttctgtagctgaggaatctgggtgagtgacaggtgtcctcctatgcgagattaggggagtaacgcccagctttcagacagccagcaggggggctcagtagtgctaatgccaagcccttcatgcagagaagtgacttaagtgtcagttactactttgtgccagaggtaaatctctctgcagagggaaatgttggcacatagctggtaaacaccagtgtctaggtagccctcctgggcacaaccgtcctcattttttcttttacttgactctccactaaatcctttttgcccgaaactttgtagaattggtatttattgatttgtaccagctaagagttggctatttagtctctgacgtgctctttatggctgaagaaaaacaggtaactccttcacagaggagagattaattccctagaaaggaagacaaaagttttcatggacaactttggaaaggtgtgaagcattaaatatctatgacagcaagacacgggaatacacaagcctgtgttaaggcctgatcccttctgggccaggcacataagctgaaaatggtacctgagcaatttctgagtatgtcacgaaaaggcactgaaatacagaagtttctctatggaaaagagtgtcccggcttggaaactgtgtctgaagcaaaaaatttcctcaaaattgttcttcagaaagggagttgccgtctagtagggtccttacaaaatcattaagagttcgcaaaaaaactagatagatgagatccatgagtgactggctgagaacagatggggaaggcaaattcgcctgaaattctctcagtcaatgcatattatgaatgcttatcgaggttgcttcatgaaaaggggttaaattttaaaaaagagaggcaaagaaattgaatacagatttagtacttgttcttgaggttataacttcagagttgccagatattgaacgttgaattagttaaggtagtgctagttgttgtaacaaataaacccaaatatgtaccgtgactcaaacatgatggaagattattttccacttgtataaagcccgaagtgggcgtgtttatgtgaaacctggtgatttggcgacccagcctcttcctgtctgtggttccactttatttaacaggcagctgctaaggtcacgtacttgtcagcattgaactggcggaagcagaaagatcatggaggactgcatatgggagattttgataggctaggcctgggagtggaatgtgtcacttctcctatttcattaagaacagttcagccttatggtcacgcccacctaccttgaaggctaggaaatgtagcccagctctgcggttggcaagaagaggaaatgggtttcctgaagagctagctgccctctgtcatttgaaattttattaagaccattgaaggtcactttaaaagtaacacgatcactaatatgctgtgtggatcgtcaatatatttttgcctctgagggcaactttcttggtcactctgaagggcttctgatggcctagggtaggtgtttcagtggcagtgttgcacatcgttttgaaaagtgctgtgtgataggcaacttggaaggtaaggaggtgctgtgcttagaagaatggttacacaactcacaaattgaggacaggcatgtggacactacctgggaagactgtgagctaaattgcttcatggaaggtggacatggaatgaaaagtactatttctaactcatagggtatgtgatttcatgtgagtcataaagtttatttgggcagattgaccaaaatttgtagggggtagggattttctcattgggaaaagaagagggctgtcttatctgggggatgccctatatccaagcatgcatgggaattagaagttaatcaaagaaataaagaattaacgctggaggaggggagcctcactcttgcaatgtgggagaagttggtcagatgtgctggaaacacacttatacatctgggaggaaaaagagaggtgaaagctggggaatggggttagtgccaatcctgcactctgagggaatgaaaagagacccaggggactgggcaaggggcgggcaggtgacctgtccctgggagaagcccttggccgtgccagtcttgtggtgggtacccccgtgtgctctcttttttttctgtgtgatgtgggcaggttccccaacctctctgcatctctgtgtgtaagagtctgtgaaatgatgtgttcacagagctgtgcacatagtaggggctttatgaaagtttcttcccccatcttctgtgcagctactcaccagccccattgttggggatcattgtctccataattggctgtgagtaactggggagatgttctcccctataaaatgcaacttcatgacaaaaagaagctcagcccccttcatccctaaagattcgttggtgcagtttcttataccagaggttagataaagctgagaaggagaacttccattgtcattgacttttaattctagaagtccctgttctcctatcttagctttggatgttggcagcagggcagcaggcgggtcttgtgaagaaaagttctgtggaacctaagagttattgacttgttcttcagcatcttcgcgtaatcctcatagcagctctctgaagttcattggtggggaaggaggcttatcactgatcttatagatgaggaaactgagttgcagatcaggtatgtgacttacccattgcaggcaggcccaggactagacaacaggcctgttccacagtagtgttaaatgggcataggtttcttctgggaaatagcaaacgtcccctggcccttaaatcccttcacaaggcattagcatcaactgtagcaaaggaaatggagtcaggttacaggacgaagctcagtagctgggtgactaaatccaggttcggaaccatgtttcccatcacttaacatggtttctgagctttgaagaacttttttcgtttgataggtgcttgcttggcaggaagaggtgggcagtgatcacctttttacaaaatttttttgagattttctttgcaaactctttgtactgaaggaagaaagcaaaaggcgcaaagagttggagataaaagcacaggaacctttcttaaagtggaagttgtcttctcatatcttccccatccctcattcccttttcctactttagaagtatttctataccttgtgcctacagatacatatatttttatttacttactatattttggaaaatggctcatatcatttttccccagaagtcaaaatgtgggaaccagggaccacccacctcttgtacccagttcaaactctttctgggtcactgttttatgtgtaattcatgccaaaaagttacactgaaggatatggatggaccaaagctgcatgggtttcttacaacaggcctgggtagagaggcttggtgcaagaaacccaccttgattacaagagccagaatggagaactgaaaaagaaaagaatgtctacccagtgtcacaggattacttttgtgggtgccaaaacatatctcaaagtagccctttagtcacctaataaaagatgggaaatgtttagtccatgtgtactactggaatccatgtattttaatatgacacctttgatatatttggagggagggtaggaaagatgttctctgttttatttcttctgaacctttttaaaagtttctgaactgcttaaatgaacctacctgtagacttaaatgtgttaggaagctgatttagctgcactgagctcttcctttcccttacttccttctcaggttgtagaatacaagctcagcactttcctggcttccctctattgctctgggaaagatagtaagtaaatagtgtctgttgccaaagggagaagaataaacataggctggatcaccaaatggtgctgcattttatttgtatggtgtcagagacactggctgcttagatggcatcactgagggagatccccagcatgaagcagagaagacaaacttgggagtttgtcaggatacccagggtcattgcaggtcagagagactgactaacaattaccagactcacaagagacggataaataacaagagggtcctctgaccaataaggactttcctcaccttaacaaaatcttcatgggaagcccacttgttataggaggcttgattggtgtattagtctgttctcaccttgctataaggaaatatcccagactgggtaatttattaaggaaagaggtttaattgactcacagttcctcagggctggggaggcctcaggaaacttacaatcatggtggaaggcaaaggaaaagcaggcaccttcttcacagggtgacaggacagagtgagtgcaagcaagggaaatgccagacacttataaaaccatcaaatctcatgagattcactcattatcatgagaatagcatgggggaaactgcccccatgatccaatcacctcccacctggtcctgcccttggcacagggggattatggagattataattcaagaagagattttgggtggggacacagccaagccatatcaattggtaagtaccatgtgaaagcaagttaatggcccatgtcatagaactaaaaccatttgttttagttctgtgttgcttgtagggaattttctagtcagttagcacaagaggtttagtggttcagccaagtttcacatactaggtcccttcatttccagagattgggagtgtctaaaggactaattttgtaatgtcagataatgtaagagaatagcccctggtgacaggtgattgaaatagataatttctgagtcctttcattatttcctatctgtttcttaattcgtgaaataaaagttaagggttatctaaggaagaacactaagttatgactagtactttcatttgttcaataaatacatatctggtgttcattatgtcatttaactttaaattttttttttttttttttcttgagacagggtctcactctatcacccaggctagagcacagtggtgtgatctgggctcactgcaacctctgcctcctgggttcaagtgattctcccacctcagcctcatgagtagctggtactacagacgtgagccgccacacctggctaattttttttttttttttttttttttgagaaggagtctcgctctgttgcccaggctggagtgcagtggtgtgatctcagctcactgcaagctccgcctcctgggttcatgccattctcctgtctcagcctcccaagtagctgggactacaggcgcccgccaccatgcccggctaattttttgtatttttagtagagacagggtttcaccgtgttagccaggatggtctcgatctcctaacctcatgatctgcccgcctcggcctcccaaagtgctgggattacaggcgtgagccaccacgcccagcctaatttttgtatttttagtagagactaggtttcgccatgttggccaggctggtctcaaactcctgacctcatgtgatccacccaccttggcctcttaaagttgggattacaggtgtgatccactgtacccgccttaactttaaattcagatacttttaattctttggttatggtttgttggttgctaccactgtgggtcactgtcttatccttcccagtagggatagatgtggctgctcttctgattttcacctcctcttactaatttaccctgtggtgggaaacacatcaactgatagtgttatttcatgttaagtaaaggcaaatagccaccttcctcatttgactgaaactcaatgtgtcacattctacctcttttcttagtccttaaggatttctgtcatctgttagtctgcaggctcttaaggtcaggctctgtcttcccttcatctttgaagcttctactcttgtgcttccctcttgatgtaggccctgaatcactgttttgttgactaggagagcacatgaactgtttgtgcaacctctcaagctccgtttgaaatggaagatgatcatacatcttgtggcacccctttttcccagatcccaagcttccgggcaccctttctttcttcacctccacagatgctgccttcacccaccctttgatgaaccatcttgatcaactgccaagaatgtcaagggcatttctaacgccagggcaacagctatgagcacttatgagaccacatcaggtttgactcctgaacgaaggatgtccttatccatggtctctttttcctggcaggcatcttgctgttattttggaaattttctctgggccgtagaggtttgaaccagtcatgtctaggagcgtttgttttctcaggaaaagcaaccctgttaaagccattgttttaaaaagtcacttggagcattaaaaacctttgaccatccattcatagtgctaaaatttaggagtggggcttcaggcaagcaatattgaattaaatgtgtggagcactttaagacagcatttgattgtacatttaaaatagggaatgcaaattgaaattcctcctgggtgctttaaatcatgcattatatgtgcagtattttcaattagctgcagaaaaaaatatgttcggtgtggctgtatttttacagctgggaattgctcagagaacacaattgactatttcatccatgtgagatttatttaaatgactcgtggggcatttgcagtttagccaataattgaaaatattgttgcaatgtggcaggtaaaactaggaaatcatttcgcattcctgcagaggtgttccaagctcagcagcatattatattagttgaagaggggcaaacggagtgagatcagtgttgagtcctagtctttcacatttcattcctgggttttgccccaccatggaaatatatgggatggtgctttccagaaggacctgaaacgctaaggtgttatcttgtttctattctgtttttatatgccaaacacaaatgaatggtcagaccagatatggaaagacccatctatcccccaactctcttctgactcctatacctttctttctattcttcgtaccatttcacttcagacgtcacctggaatactgatgcaggaggctaagctgagtctctcagggtagacagttcaacctttccatggttgttcataaatattactagggatttggaatgcatgttcccactaaaatgatgtaaatgtggttaagtgataccatattaaaatgcatcattacttgtgtgattcagacaaagtatgggttaactaggcattttgaaggcagaattaaaatactaaccaccaccactttctctgtaatagtggttgccaaccaggggtgatccttcctctctccttcagggacatttgtcagtgtctccagacatttggttggtccatctgggtggggtgctattagcatctcttgagtaaaggccaggaatactgctaaacattctgcaatacacaggatagccccctacaatgaataattatccagacccacatggcaagagtgacaaggttgtgaaactttgctctagaaatgtgtacattctttttttttttttaaaaaaaaaaaaaaagacttcctcaaatgctttagaccatacctgcttataagatggtggccactgtaattgaccttaatacatgatggtaatcaacagatcattgaaagctttgctttttcatcaatgcctccattatatattgagcacttcagtgtccatgtgccatgctggaggctggggtgccatgctggaggctggggtgccatggtgaacaggatgaacaaggtccccagtgggctcacaggcacaaagacaagggaagatgacagtgatccagttagagggaacataggcatgaaggcctgaggctaggaagaaccaaccacgttctgtaaactgcaaggaggacagggcactgtagtctccaccttattggtggcctaagttacctgcagtctgaaaattggtacatgcagtacagtaagatgttttgagagagacatcacattccaataacttttattacagtatattatccatatgtataatatataaaaaacaatatatttttattattgtactattgttattgttcatctcttactatgcctaatttataaattcaactttatcataggtacttatgaacaggaaaaaaacatagtgtatatagggttccaaattttccatggtttcaggcatccactgagggtcttagaacgtatttcctgcagttgagggggcctcctgtctgtggaaaaggaagccaaatccagaccagacaggccgactcagagcctatggagagagggtgctgaattttcttgcaagagcatggagaagtcatcatagggattgactcagattttagagtcactggggcagtgcaggcagagagatgggtctaggagaccagtgtcctcctccggagatgttggtggcttgggctggggatagaggagcttgagaggggtggatcattcaaacaatggagagcttttccttgttgatggttctgtgggataaaggaaatgatgaaggacagtttccagactttggcttaggttcttggatgaacagttggtggtgtcacttagaaagatatagaacctgggagaacagcagggttggggtgaggagtactttttcttctcatcctggttttctatgataaagggacttctatatatctttctaccccttttattattttattattattttttttttttgagaagtactgtgttttagagtctgcttgcaaaaatggagggtttttctcctggattacctcatcttccagttaccattgttacaggctttccagtggagctcagatttatttctaaacgatctctttgagcaatgatcaagcattttctatatgaggtatttcatccatctaaacaaaactgtgatgagagttggcctaaactctagacttctatcatggaatgtgttgaccactgaggcagggctggtctggctttaacacactaaaacttcttaaagaattatgttagtataatcccaccctatttcagtttcaggctggtaggaaaacacttccttattcatgaggttggcagccttggaaagaacacaaggaaaatcgccagagcctgacgcccatttcctcagtcgccagtgaccatcaatcatttcctaagcccatcatcagggctgtcgatggagtcacagggctgagctgcttcccctggggagggcaaggcctctcaagtcaccttccctgaggacctgtgaccagatgtgaaagtctgataaagtcacatactagagacccttgactccctctaataacaaagaaataaaggaaattgaaaaaagaccacaagtcttaaaggcagctttaaacatgtgttttgatttttagaaattataatatttgaacattttgcccttgaggaaatgttaagctggactgtagtataggccttcaaagcctgaagagaggaccccaggccttcgtgatgatggtggtaaatggggtaacagcagaggccagcttcgagtggggcctcaagaactgtcctaagaacctgagacatagtactttttaaaatccttataacaactcttaaagtaagaactactattacaccgattttcagatggaggagctgaggcacactgaaggctagcacttgtcaaaagtcatacagataattggcagtggaggtgacatttgaacttgggtggtttgtcttaggaacctgcaggggccatgtatagtgtcctaaatccttttgttaatttcttatagaataagaattaatactgttataagtcaaataattatgagaatgtacaattatgcaagcaccctaaaactgtagctattctttttgaaaggaccaaaaatattacatttttgtgtgattgtacatttgcagtacagggaaaaagtaagaaataaaaagatctgtcttaaggtacattggcatttgtttgctgactaaaattttacagtagggtttttttgttgttattttgagatagttatatagattcacatgcagtcgtaaaaaaaaaaaagtagtaattcagagagctctcgtgtaccctttacctggtttcctgcaaaggcattatcttgcataactgtagtacagtaccacaaccaggaaactgacatcacacaatccacccaccctattcagatttcaccaggtttacaggtactcactggggtgtgtgcatttacttctatgcagttttatcacatgtatggacttgtgtgggcaccaccacaggcaagatacaggacatttccaccacagggacccctcatgcctcccttttatcgtcacacacatccctttccctctcttgttctctaacttctggtgactactgatctattctccatctctgcacctttgtcatttcaacaatgttatatacatggaattacacactatgcatctttttgaaataggcttttccattcagcatagttctttgaaatccaaccaagttgttttgtgtgtcagtagtttatttctctttattactgagtagtagtctgtggtgtggatgtaccacagtttagccattcacctactgaagaacatctgggatgtttccactttgggactattaaaaaataaagttgctgtgaacattggtatacaggtttttatgtgaaatgattttcatttctctctaataaatgtccagcattgctggattatacagttaagtgcatgtttagttttgtaagaaacggccaaacttacattaaaaaaaaataaataataaacagaaactaccaaactattttttttttttttttgagacggactttcgctcttgtcgcccaggctggagtgcaatagcacaacctcggctcactgcaacctccatctcccgggttcaagcgattctcctgcttcagcctcccgagtagctgggattataggcacctgccgcgacgactgactaatttttatatttttagtagagacagggtttcaccatgttagtgaggctggtcttgaactcatgacctcgggctcaggtgatccgcctgtctcggcctcccaaagtgctgggattacaggcgtgagccactgcacctgacctaccaaactgttttctagagcggctgtgccattttatattcccaccagcaatgtgtgagtgatccagtttctctgcatcctcaccagcaattggtgttgtcactagtattagccattcatctggacatatagtgacatctcattgtggttttaaaaatttggatttccccagtggctaatgatgttgaacatcttttaatggacgtatttaccatttatacatcctctttaatggaatatctatccatgtcttttatttcctaatccgatttttttttacagttggggtttaagagttttctgtgtagtctagatactagtcccttgacagatacgtgattggagaatattttctcctagtctcttcatcatctttgcaggatcttttgcagagtaaaacttttcattttgatgaggtccaattgatcagtttttcagtttatcagtttttcgttttatgaaactcaggcttttaatgtcaacttagggttttgattcctgcctgttgtcatgcgcagtgccgggtggtgagaaagagagccatggaacaagatagacactggagtgtgaatgattcttccagtttctgtccggttgggttctgcagtatgtcttgatgagctgcctatttgttggagtcatggacacagagttgcccttgtcttgcaaaggctgtaaggtgatgatggtatgaaaggaaaaatatttccagaataatccatggtacctcccaacacaaggtttgtttgcacttgagagcttctgtctggaatactcttccttgcttccatctctccgcccctttgtccagtcacttccagtccatcctccaatgtctgcccatgtggcccttcccaggagcacttccctggccactgcctctcaccctggcccaggtgtgcctctgcttccattcttacacactctcctcgatgtcagagcatttgtaaagtaaatacgtgaaaatgaaagtaaatatcaagtaataagacgatttgattaaggtctgtttcccctctagaccaggcttccccaaccttggcactactgacatttcgctggataattctttgttgcaggcggctgtcttgtgcattgtgggtgctgctcagcagcacccctggcctccccccacctagcagatgccacggcaccaccctccctggcccccacctaccagatgccatggcaccaccctccctggcccccacctagtggtgaaaaccaaaaaaaatgtcttcagatagtgccaaatgctccctgagcgacagagtcacccaggtggagaaccatgccttgagactctgagaggtgggagggcaggtaccaagccccttttcatgcctattctctctctagcatcccagcgccaggcctggcactgtggtgcttcattaatatttgtaggataaattaagggataaaccaacttaataggggacacttgtttacacggcagccttggaaatgctaccctgacttcaaaggaacaaagtgggttttgttgggcacttgagacccaggagaatctagagtcttctgtattcaggtggatatgggtttccttatgcagtacccaagacagcccccacactgaagagttatgtcagtagtgccgagataaagaaagcctgctctagggcacaagagaacacacattcccactctcgccccaggcgccacacaatgatccctctgactttccctctgactttccttagtttagaatcagagtctccgtctgaagtcctagactgtttctcatcaatgcaatgactgcattgataccaatttacctagtggttctccctggaatttttctttttttctttttctttttttttgagacagtgtcttgattgttgctcaggctggagtgcagtggcatgatcttggctcacttcaacctctgcctcctcggttctagtgattcccctgcctcagcctcttgagcagctgggataacaggtgtgcgccaccatgcctggctaatttttgtatttttagtagagatggggtttcactgtgttagccaggatggtctcgatctcctgacctcaagtgacctacccaccttggcttcccaaagggctaggattacaggcatgagccacctcgcatggccactccctggaattttcaagccaaggcttctctatttgggagaggaaggaatgaggccagttacttttgtgtatcctagaagggaaaggatgtggtactggtaattgaagctttggcctgccagcccaccttatccaatttgtcagcccaggttcatctacatcctgttgagaagtttggcagctggaggtggacatgcacacactacactgaacctcctgcaacaagcactgcggaaggtgtgaaccccaggctgagtgactgggcagctgttcctctgcaggaatagaggagccccagcctcctgacacggtgcacctcctgaaacccacaaagcagcagtagggaaccgtggatgacattaccagtcctccccacctaccgcctggtcactccttacaggctgcctttttcttcctaagccaaagccagctctatcattcaggttcaggaaacagaacagccagccactgagagaaaaacctaaaacattcatatataatctaaattattcttacaaccactgttcttactccctgggagctttctaaaccaattttatccagttacctgcttagctaagcaaaacggagcccaaacccctgcttccctcctcttcctcgtgaaaagggagcaggacccagctagagggaaagtgcaagtgaacactgcattaggtctccaaaccgccctgtgcaagtcaccccagaaaggccacctgaaggagggcctgtcctgtctgctgggaggccctctttttctcacaaggagagtccatgccttatggataaacagagatgccttttctaggctgtgagagcaccactttggcagtgttcatggaggatatggggttttatcaggcaggaactcagcagctcccacgttcctatttcagtgagccggggagaaaggcaaggaaacccaacatatattgagttactactatataccaggtactatgctaaacacagagaataaaaaaattaagtcataatccccaccattaaatatctaatatgtagatttggccacatacataggtcaaatcatgttcaccaaaataacaccaccatttactgaaaaaactcaacatgaaatggtctgtgggttgtaatggggtgtaacattcatcttagtgtatataaaaagattccactttattatttctcaactctttctccttttccagtaaataccatttttattaaagttttatgatcctttggtttagccactgttgtgctccataaccttctctgctcccctttagaacacatttcagctattccagagtctcagttcctgataaaaggaaaagggatgcttgttataagtggtgatttcattacagaaattttgaaggctacataacggtatacagaataataaatattcatattcccaccatcagaaataactatatagatattttaatatctgtcctgttagtctttttttgtgcctgtgtataattttttttttttttttgggatggagtctcgctctgtcgcccagactggagtgcagtggtgggatctcggctcactgcaagctctgcctcctgggttcacgccattctcctgcctcagcctcccaagtagctggcactacaagcacccgccaccacacctggctaatttgtgcctgtgtataatttttacatagttaattataccatacttttttccagttaagatatatccagaatgtattaccatgtctttaagttttcttcagagataggttcttaacagccaaaggatattgtgttggatggatgtcattaactgttccttattgttggacattttaggttatgttctcccagaagcaatccctgagccaagcataaagtgcaagtgattcattaggaagtgctcccagttgaaatagtaagggaaggggagaagtgggaattagaaagggaagaaaccaagcaagaaataccaggtgaagtcccacactcagagctcatggggagctctggagagtcagttaacaagcagaccagtagtcaatggctgttagtcctcagggagggagtggtgtttgtgaactctcaaccacttagggccaaccaagaaagtggccttcaactcccactagtaattgaccgaggtaacaggtataaaccattagcaacaaagcagataaaaactaggagataagtgcacaaagctggtaaaaggtcacccacagtgtcccctccattggagatttaatttgcaattataattgctattgcaattatttattgcagagaatattgcaatacttttgctactgaaaataatagtaaacatttttggacctgaatcttttttattatcacattaggattgattgatagaaggggtattactgttccaatagatagatacattattaagattatttatgcgtactagggattgcctttaaaaaagatttttaaaaaatcaatttacatttctaacacttgacactcattttttaattggcaagaatccagagagtgttagtttctcgtctctgaattggaggcccataggcatatcagggttattctaaaggatcagagaaatcatgttcatggcccagttttgattatagattgataaataatatctcaaaatatgatttcttaaaatgtatctaggtactgataaaaagaatttggattttattgacatgtttaagaattcatggttgtattttatgtatttttaccaatactaaaaacatggtcatgaactatgtgtaatattttttatgtctaaaaaaggtacttccatgtctcttgctgaagagagaaattaaaaaggtacttccttgtttttaaagattgagaaccattggtcaatgtcactataatgtcttgggtcacctcttggttgctggattaggaaatcagccatttggaccattacgtcttaaagacatatcaaaaagaaaagtctataggacttgatacataggtaaaccagatttaatgatctgagtcagcagaccgaaaaacatatctcagcactattaaaggttttctgggacatactcacccctccccctccattcccacagtaatggacccctcagttctcttacagagacggcaaaacgcaccagcattgtcttaatttatttctgagtcttaaatagtctaaggaagttataaagatacagacaaggctttatcaaggtagcagtgtttgactgttttcttagcttgatccttgagactttctaaatggttgctgaaatacaaatcagagtatttcaggtcttgagcattgaagaggaccagaagaagagagccagcatttactgaacacttgctctgagccaggtattaggctggttactatgtctttcagtttgcacctattgaatttccatggccacccttgagatatgatttctaatatggcagaggacaaagctaagacggatgaagattgtgacttgccttggatctcttggttaatgggtagtaggattggaatttgaactttaggtgaattttcccggaaacttagaggaaaatagaatgaatatcctgtaatcttgaattttaaaagacagactgctaacaaagctctaatcccctccttccccctagccttttcccatcaacccaaagagatttcagaatggataatatatggataaaaggcacttgatgtcagagtgtactttataataaaatatgtgtcttttcattgaagggaccatttggatgttgctgccatacttttcagcggctgaaaaggtatttcctaaacatttttaggttcctttttggccaaattaattagtgtcatagaatgagcatacactttgaaggcagacaaaaatttaagaaaaaattcagatgtctctaagtctttctccactaacctgaaaaacacattttaaaactaccaagctgctgtccccttgataagttggcatttcctgtttgttctctaaattttaaagatgctgagtcattttgctagtacttagtacacttcccaaggataaccaagatgtactttagtttgcttgttcacctgatttggtatcataagaaaatgtggtagatgtttggaaaatgaatacaggtcttggtggacattatttcagtaatgcttatacagatttgagagacagagaccatatgtgaggcttaaccccgattacttgtacattaacaattactgtcatcttacagagacagccttaatctccatggctcacctcctgaagagtttctagaatgcctcttgccaaacaccgttgagtgttggcaaagtactgatgagaaatgtttggtctgaatgctggacagcacgattttacttaaggccattcagaagtctcagtttggcagccacaaaccttgcctgtacatttgttttgttgttgttttttttttgagacagagtctcactctgtcacctgggctggagtgcagtagcacaatctcggctcactgcagcctccacctcctgggttcaagcgattcccacacctcagcctctggagtagctgggattataggcatgtgctaccacacccagctgatttttgtatttctaatagagacagggttaagccatgttggccaggctggtttcgaactcctggcctcaagcactctgcccacctcggccttccaaagtgctggggttacgggcttgagccaccgtgcccggcctgtacatttatttctttgggaagccctggcaggaaaagctgttgagagatgtcatgattcggacaaaacatacctgctgtttttctctacctgctgtagcccctgtagattaataaggggccttaggttccaagaaccaggatcctagcaacacagagactagaaggatggcgagactttcccagtgcctgagaaggtgtcagctttcactgaggggcggggaggggagaggctgagataaatccggggactcaccttgccgtgctgtgtgtcggttgtttgtcgctggcatctgcactgttaggattccatttttaggctgggcttgattcaggaggctcgctgctgtcacacgagggcaatccactttgattctcccagcccagcttttaatgcccagcagactcctttatcttgtcatcatccagcgagcctccctcggtctagatggccatgggaggcaaacccgttcagtgtcagcagctggtctttcataatttgattttccagtgatgtttgagccatcggtgtgaaacagtcaccagtctggctctcataatttgaatttcagtatttggatatattccagagagtggtgtaaatggactttggattttccttatcactgttgctcagcatttccacagtttaaaacatttagggtttattagataagggtgctcagtgctactgtttctcactaaaaggaaccagagctccctggagaagtggctgattccatctggaacagaagatgtataaaatgagcctaaacatctagtcaaaccggaaagcaaggaggctaacaagactgtagggttgtatcagaaggtttaagaacgagtgtgaagaggctcattttgagcaccaataagaataaatttgcagtggatcgagacccttaaagtatgttgaaaaacacgagtttatagtgatacagaaaatagaaccctctggtcaatcaacctattttgaattattttgaaaactgttggatatgggaaatgaatgaagaatttgtcctgcccttgtaacacaaaataaacctcagggcaaccaagtagttgattatggaaaacttctttttatataaatattctaattaataagtgagggaggaaagttagaattataacagcacccacatttggtaactcttaataaaacagtgcacttaggcggtcatcataagtagcttgctaacaccacaaaaagagacagtcagctaccgtctactgatttcaccaccctctacggcacctctacaaaatattcttacaaaaagagaaaattgacttgaatctgatcagtccctacagctggggtcagcaggcttttcacgtagagggccacataataactgtttttggctttgcaggctataccgtctctcttgcagccgggcacctctgctcagctccctatcatagcacagatgcagccataaacaaagaaaaaagcgtggccagatctggcccatgggccgtagcttgcagacccctgctctagctctaacagtttacaggaaggacagaagacagagaaacttgttgaacagcatgacattaatgcagttagcaaaatctaccctggggaaactctacagggcaaataacctgtttttttcaacagaaaaaattccaaggttaaaaatgaagcaactagtggaagatgaaacaaacaaacaaccaaaaaaacaaaggcaagaggtgtaaccagttgcaatgtatggagcttacttagatcgtaattcaaatatactataaaaaatgcgaacatggactagatatttgacatgttaaggagttattttgcggtgtgataatgatgtcatggatatctattttaaatccttaggctgagtctatatgttgaaattattttgaatgatattatatgatgtctgcagttaactccaaaatcatctttgatttgagtagaaataaaccaagccgtgagttaataattgttttttctggatgttgagtatgggggggagtattaaatatttgcatatgtttgatatttcccatgatataatgtttttaaaaatatatgtatgttttataaaacatgatcactttaaaccttttatagagaatgagagagcatggagaacttttccttcattagacgcttctgtgtcctcccaaaataggtgtgcaccatccagctatgaatggacccagaagagtctttccagtggtttttcccaccaagctgtctgcctacaacttacttattatgctacatagagcagactagtgtcatattatttatcatttgttcatgcactatatgtaaacttttatttcataaaaagaatttattaggtagaaaatgagcttcatgttttgtgtctggctatcctagttgccactgttcagttgttcagcactggttccaggctaaggggtctcgtcacaggtgctcacacagcctggagaggtgatggcagtggcggccatggcagggtgtgaggcagcagggagcagcgggagcgaggcacgctggaaagtgggtgcccagcccataaggggtggcgtctgtgcagaacatttgccatgggggtgagggtccagtagtactagaacgtccactctttttcatttttcctgagaataaccctaatctagacttgtgacattttttgacttttagttgctaaaaatatttttagaatactctgtattgcacatcaaacacttgctggattagtcccacgggtcaacctctgattttgtgtctaccaatgaatggtaaggccctaaactgaccctgtgggcaccaggagtctacagtccctgctttccgtgagcttccagtctacttgcgaggaaagaaaacatacttggaaaacaactaaaatgagacaggcaaataggaaatgctataggaattcaaagaagagaataaagaacctcatctttaacaatcaggaaaaacatcacacacaccgtggaaggagttgggtagaagtgtcactgttgctaggtggaggctaagggagagaagcagaggctcgggcttgggtaagcaagctctttcaacagaaactatgattcttgaaaaagagaagagttggtagatttttggagactagtacccctccccaccagtggataatttttctgaacgatcaagtgaaaacaggtagcaaactgttgaaagtatagcactgcaattcagcagagagtttgaggatttgagctgcatatttgagcatcacctgtgtagaagagatggttgacgccattgggtctatagagagtgggttcctctaatgtctgctattggcaagcagtctatttataaatgttagggttatattttgagtctggcatttgcaaaactaccatcccattatttactacgttaaatcatggttaaaactcaaagcagtacccagctatttcataaacattccccgtattggaaaggagaaaggtttgaagtaagagaaactagaagaacatagggaaggagatacctggcatttggaaggatatgcctgtggcgatggctctactgatgggcttatgatcttccctccaatgatggcctagagacctatttttactgttgtgaaacaatattcaagcaaatgataatcttccatcttgttgctatgcagtacatttgggcagcactcttatttctctctgatttgaaagtttaaagtgtaatttctcttaaaaaggaaaataaacaggaggtttctatgtacttcccattatggcatctgcttgttccagagatcaagcatttcaaagcttgagaactccaagttacttcatgtaaacgattgtctatttggacatgagtgtgtttcattgttaggaattatgcaggcctaaagtaatttatagatcaacacccactctcctggctactgaactttggagaaaaatgaaagcttattcttagacacgtatataagccaggtgagtttagacgagtgagcatttggcctaggaaaccaaggccaaggagaagttctgcccagcacatcaatcaaaaatagctctgattccaagttctgcacagctctaacactgtcccagtgcacttttatgaaactgtacatagacagctctcaaaaacttcccaagtccaagaaacccagaaaaacacccataacagctttcttccgtgtcataggaaaactgttcttttagcgaaaatttataatgaagcagaattctgctaaataagatggctgtttatttgggagactgtccttgtgactttaagacattggagctgttagatttctcactgtcactgatcctttcaccctgtttttacaatgttttatatatatatatatatatatatatatatataatatatataaaatatataaaatatatttatatattatataatataatatataatactacatatatataatatatatgtagtatttgagtctatcaactttaagctaccagaggcaaaaccagtttaatgttcatgtcttctgaatccaaattctaatatttattcaaatattcactaatctaggagcatttctttggggaggcttcaggagtacagattatagtgggccgaatgtagacaccagaatagactataatgcaagagacaacaattgagatggatgaagttggtcactgcatttggccatttgtaagaaagattgtacacaatgttttatacttatgatgactttgtgctatattaaattttaaagaggatatttattgctcaaaagaaagaaaaggcaagagggaggaaggaaggggagaacacagtttctagtttttagatggaatgaataaagcttccacggtcatgatttggacgctctccaaagtccagtaggctccaggaaactccagggattgtcgtggcattagagccagtcctaggtgccaaagtcaaaataggccacgctggcccgttgagcccaagcgggagcagcgtatgtaggtcacttacatgttttgaatttagacgggctgagttgatacaattgttttacaatgaagctctggagaaacacggaacattctaaatctttagaaaagcgcttgtttcacaacatataagaaacttgcaacatcagctggaaggatggcctcagtggttcacagtggggccctctgtgtcggggggccaggcagggagttctgcgtgtgcccacagtccttgctcgatgtgatggtggctcttccctcagagagtgtcttgagctgaccgtgaggatcaggattaaacacaagcgttttcttagccacactccataaacgctgttgtgatgcagggaaagattaattaataaaaataggaagtatttatgagccatcggattaatctcacaagtgtttattgaacatctcctacgccctagggtgggaagcacagaaagtgtgtagaaaggaaggcaaggagacaccaaatacggggccagttttgcctaacactgtggttgtgcccatgctttcccccagagcacacagagacatgatttccccctccctccaggtcacctgtctcttaaaaggcccccttctgttttattctctgcagtcacccctaacctcccacacgtaacaacagagtgggacacattggctccacgggagactgtgcttagcaggagcttgggcctcttggggaagaactgaattagcaacatcacgaatgctgcttttgttttaccagctgccactgttaagttcttacttaatgaaagtatttgcttttccataaatacatgtaaatttcctacctcttacttgtcatagccagagaaagctctgtgagtggtaattaaggaaggaagcttctttaaaacaaatcactgtagttgagaacatccgtgtaagcaacaccatcctcaaaattgatgaatttaccaattgtcctaccctattgtaactttaaagcagtcacttaagtttattttaattaataattctttaattttaaaagcagtgtgcttatggtaaaagaatcaagcgcttgtggttataagataatcagagcaacccgagggattcactcccttgtttgaaatcctccaggggtttcttgtaacccttggagtgaaatcccagtgcctttccaggctctacaggaccttaccagatctgaactctccttcggcttcacccacctgtctcccttctttacgaccttgatttcacatccacactggcctctaatacaccaagtttattcccacgtcagggcctcggccctgctctccctctgcccagcgtactgtttacccatcagagtgtggctggctccttcccccattcaggtctcatcacgatgttcctgccatagagatggctccctgatcaccctatctaatgaccaccccccgcaccctgccggcccctcatctgctcgcatccctgtattttatcattgtgctctttatccttttctgaaaatgctttattgcttgctggcttattttctgtctcccttctagattgtaagctcagtgcgggtgagagtcttgtccattcagttatgtcatatgcctaacacttagaaaagggtccgacacccagtgaaccctcagtaaatattggcttaattggatgaagggcacttatgagaattaaataatgattaggctgagcatggtggctcacgcctgtaatcccagcattttgggaggccggatcacttgaggccagacattcgagaccagcctggcaaacacagtgaaacctcatctctactaaaaaaaaaaaaaaaaaaaaaattgccagacgagttggcgcacacttgtaatcccacatattcaggaagctgagacgtgagaatcacttgaacccgggaggcggaggttgcagtgagccgagattgcgccactgcactccagcctgggcagcagagtgagactgtttcaaaataaataaataaataaaaataaaataaccgagaattaaataatgattagtataggacctggcacattgtaaggacccaagagatggaagtttgcttcctttccctccccacctccccagggtgtgttttgaaaactgatttaattacactgttctgtcttaaatatattcacatggcattcaattatgctgagtacagtcaagcatactaggtgagtacaaaatggcctcgcaggccaggtacagtggctcacacctgtaatcccagcactttgggaggctgagtcaggcagatcacttgaggtcaggagtttgagaccagcctggccaacatggtgaaatcccatctctactaaaaatacaaaaattagccgtgtatggtggtacacgcctgtaattccagctactcagggggctgaggcaggagaattgcttgaacccaggaggcggaggttgcagtgagctgagatggcaccacttcactccagcctgggtgaaagaacgagtctctatctgggggaaaaaaaaaaaaagtagtaaagtacccatttaagtataatttaaatattttttaacttacttttccaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggtgcgtgtgcacaattgctcactggcggagcctttgcctgagagtcttgtgacaggagggtttatggcttggtttttgctgacaaccccaagaagcagagcagccagaaggggatttgctggtgccacttggggcttggggtcagtctcttctaaagaacaaacactgtggtgctggcagttaggagaactagactctggtcccttttttgtacttttggagcttggggtctgccactaggtctcctttcccagggctccagccctcgttccagcgagggggacacttcctggcttaccgcctccatggcgcccagggttgagttgcgctgtgatcgtagatgtgcttgtgaagcctgtgagaggagctgggaaggggtggctgtggagggcccaggggcctcgtagtgatggagccatcctgggtcttgattgtggtggtggccacacaaatctgcacaaatgataaagttgcacagacccccctccccaagcccacaacaggagtgtatggaaaatgagtgaaatctgaatgcaccctgtggactgacctgatggaaatttcctgatgcaacgacggtaccactgggaagactgggtgaaaggcacgtgggacttccttgcatattgttttgccacttcctgtaaatctataattatttcaaaatataaagctaagcaaagacttggaaccaacccgaatgtccatcaatgatagactggataaagaaaatatggcacatatacaccatggaatactatgcagccataaaaaagagtgagttcatgtccttgcagggacatggatgaagctggaaaccatcattctcagcaaacgcaggaacagaaaaccaaacacggcatgttctcactcaaaagtgggagttgaacaatgagaacacatggacacagggaggggaacatcacacactggggcctgtcgaggggtggaaggcaaggggagggaaagcattaggacagatacctaatgcatgtggggcttaaaacctagatgacaggttgatgggtgcagcaaaccaccacgacacatgtgtacctatgtaataaacctacacgttctgcacatgtatcccagagcttaaagaaaagatacagatagatagatagatacgtagagagagagagcgagctaaaaaaattgttttaaagtaaggcccaatgaaaaagatttagtttgagttaaagaaaaacctttcttaaatgacccatttaactgcacgagcttcatcctctggcactgttttacttcagctgaggggtcttgcccagagccatgtcccacctgctgtctccataaatgcagtgctcaggggagcaggactggctccccccctcttcctggccaccagcaccctctgtgaccttgcaaaagtcacattcacatctaggtctgctcccttcgttggaaacaagggagtcttcctgcccgtgttcttccacccaggctggcccgaaagttctgagaatcttgactgcactggcgtcgtcagctggagagtaagatcagtgaggtggcgatttgtgtccttcagtgcctcgctctgcacccgcctccgactctgctcagcgtggcctccagggctgccagcaccaaatgcctaatctcactgctctgttgatgcagcattacacttctgtacgagtttgcagtttgttcacctgttggaagcatggaaggactaaatacttggaacacactcttctgccccttgcttggaagttcagaaaactcctggtgatttataacttcatggtggatcactgctaaaatttatgacctttcctagtgtgatccaggctgtgtcggccgagacagttccaaaatagcaactggacttttgttgtttgttttaatgctgagccacactgattttaagccattatttctgaagttctaagaatattggcccgttggccatccaccactgcctcacccctaccccaaaagggccaggagctggcagttggccttggaattgtctttcagcctccaaagccggccgttttcttacttgtagaatgggcctgcaccatagaacaattgtaaggtgtggtcatgggcatctaagagagggccatgcacgttgtaaagccctacacacgcccctgtttgtgggccctgagaagactgcccccctcccccgtgtaaaaggcctgaagaggacgcacattcagagtgacaaatcggctctttagaggaccatcaaggtgactctggcaggatgttttaggacagtgccattttgaagagaccccaagcgatgaagaaggatctgtaatttgagctctctttagaaacacatttcatccttataacttatttgcctctttttcaccctctcaaactaaatggagcatgtatgaatggctcatgtaaaataaagcttacgttgccataaaattaatctccttactctttgagcttgttaccaagtaaaaaccacattgttctggatggtggcccatggtaattttttatagtctttctaatgcttattttattcattttttttccaaaatagaaaaaaagaaattacattgttaaatctttggcaagaaaggaagtagcacttaataacgttagacaagaaagagagaaagcattaggaagttccctttgatttgttcccccttggctatagaactgaggactgtgccagcattcatactgacctggtgcccagaaaggctaccatgagaatgaggtctgcattgggaaggtggtgagaacaccttgaatattcctgttttgatgcagaagcacagttgatttttgagagcttcagtggttagactttaaccccactccctccttttcttaagaaataggcccctgagagaacagaagacttagtttcttgctactcatagctatcctgtttatactgttctgttatttttatttttgagacagggtcttgcttagtcacccaggctgtatgcaggggcccgatcatggcttactgcagcctcgacttcccaggctccagcgatcctcccacctcagcctcctcaagtagttggtatcacaggcgtgccaccacacccagttaattttgtatttttggtagagacagggttttgtcatattacccaggttgttcttaaactcctgagctcaagcaatccacccacctcagcctctcaaattgctgggattacaggtgtgagccactgcacctggcctatactgttcttacttgctgcaacataaaagattttaaaaacttttctagattcttatggaagtattgctgtatcttctgatttctcttttaggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccaggggtgagtggccgcagtatgtcatttgattgcatagtttgtgaatgaagcatgagttagactccagggttcaaagtggtgtctgcaagtccaattcaatggcctgtgggttgagaaactcctggaccaaggaagctctattcagtctccctccttccccttcaatctgccattgctcactgtgctcctgggaggtgtttctcctgtagtttgggcaacagaacagaatccagcccctccactgtctcctctccttgccatatctggtctccagcatccttgcccacaggctcttgttgattttgaaggttttcttgctcattccttcctgcttttgcatctgcctctccctttacctggaatgtcctcctcatccttccaggttgattgatctctttgccttccatgcctcttgcttctgccattgccaaagacataggtaccctgttgtccgttatgattggcacatgattacaacttttacacccccccgattacagccctttccacatctcaaaatgattactcatttgtaagtgtctcttctcccattaaataaaggagagtctaacgttggtgttttaaaacttaatttgtaggccaggtgcagtggctcacacctgtaatcccagcactttgggaggccaaggtgggtggatcacctgaggtcaggagttcgagaccagcctggccaacatggtttatcccatctctactaaaaatacaaaaattagccagacatgctggcgggcacctgtaatcccagctacttgggaggctgaggcaggagaatcgcttgaacctgggagggggagattgcaatgagccgagattgcaaccctgcactccagcctgggcaacagaatgagactgtgtctaaaacaacaacaacaaaaagaaacaaaaaaacaaaaaaaccttaatttgtaacgtggaggtccagttggaaacatgcaggaggagctgtaggtctggaacaacaggagaatgtgaaggatgggagtacagatttgggaccttttttttatttttaattttttggagacagggtctcactctgtctcttaggctagagcgcagtggtgcaatcatagctcactgcagcctcaacctcctgggctcaagtaatcctcccacctcagcctttccggtagctggaactacaggtgtgcgccaccatgcctggctaatttttttattttttgaagaggtggggtctcactgtgttgcccatgctggtctcgaactcttgggttcaagcagtcctctcgcctcagcctcccagagtgctgggattataggcatgagcccctgtgcctggctatagagccttttttcatagaagggagagagtcaataggaagaagaagcccaaagacaaaacctagggaaactgtcgcctttcaggctatgtttcttaaaagtgtggttactggtgtccctgcatcagaattatctgggctatgtgttgagaaggcagatccctggagcccagcccactgcattggaatcgccgagggagtggctggcaactcccagtctgcctctgcctcccatcaccattcttacacacccagatgttggagacccattagcagaactagtgaagaggtggacaaagaaggctccagggagggtggaggagaccccaggtgacttgggtaaattcgtggcgtcccttctcagtggggcctggaccatgcagtctgggcgcccttcctaaaaccataaaccatcgggaggtcagcacacatgagggtgttcagtggagtctccaggtgtctggcatctgtaggcttgtgaagagtggtcagaagcagacgccctcaggactggttcttggtcctgactctgtggctggaggctgtgtgactgtgacatgtcattttgtcctcttagccgctgccttgatctgtagaatggcaatattaaaccacattagttagaccatgtgacagtcttcagagcacctggagaaaacccccacgtgtgctgggaagaagcatggagactcctgcagcactttgcagccctgtcagccccagctcctccgtttgtaacaaatatttttaatactctctttactattctgaaatgaaattcatacatcatattactctatgcacacacacaaatttttaaaaatttgagacagtgccaaactgtaatacaaaggaaaacaaaagaaatgtatatatgtagttcaataggtaaacccttgggtacaactacactcaaatacgtaataaagtagtcagagtctcagaataattgtgaattgacagctacaaaagcagacagagacaggcatgttgtcctggtgactcataaacatgagctgtgttaactattgctgatgcaattttttctgaaacggtgcaagacttttgataaatttctgaacaaaacaaagcacaggctctgcttgatttgcgtgggactcacattcctggcaaattcagcatacatgaaaaggatgcaaaaacaaaaacaaaaacaaaaacaaaaaacccaaaacaccctgtgtttacacacgaaaaagaacgaggttctgggctcagataattataagtaggtgtcctaccaatgcagagatccggtggggtattgaaaagccacgggagaagcagcacaattcttcattgggtgggactgttttgaacattgcaggacagatagcatttctggccactgcccactcaattaaaaacatccctgccaaattccaaactgcctttacctgggggtgaactgcccccactgaaaggtacatgaccacatggtagagctcagaagtgacttggagctcaactgtttgtgtctggaaggttgctgggtctgtctcacggaaatgatagttccttccctacagagagtgggagagcccaacgcgcaggccttttgcaggaggagacccatcagggatgggtctggcctgttgacctctgcagactcactcatccttgtactctatgttccagccacacaggcctcttcctagtccccttacccaccatcctgtctcctgttggagaaccgcacacatacactcctgctgccttctctccctcttccctggttaaggccaactcatttctgtaccataccatgagtggcaggcatgaacattaaaagcacacattctgagtttgaatctcggttctgccacatactacctgtataaccttgggcaagttatttaagcttgctttgcatcagcattctcgtctgtaaaatggagagatgtaatagtgatacctattcaaataattctaacaacaattaaggctggtgtgaggatgtgaataatacatagaaagcatttagcaaaggactctgcacttagtaaatgttcaaccagtgtgagctatttttatagccatttctgaggtactgtccatctcagacctcaccaactaggtcaggtcaccttcttagccctccatagccttgagtaattccacttccagatatttatttaaattgcagctgtatacttttccaagttattttatgtcagcctgcacctctctctcattcgtagtttttgagaccagatttccttcttggtttcttatttaagagagtaccaggcacatggtaggcaggtaggtatccaaggatggatggatggatggacggacggatgatagatgcatgtctgtggcagttactgatggcaggtttccatgtgcctctttgcctctaaactatgcattttctttttatttcttcatgtccccttattatatcttagtcctcccaggggcagttggaggcattatttgtctctgtaaaaaggggctaaggacatttctacagacagttattgagcactgcctgtatgctccatgtagtgctaggagtaagcaaaaagtgaatggcagagtctcatgcaggtctcagtgtagctgagggagacagacacattaaaattggctagaataaaatactgcaggtgtcatggtggggccaggcattgggctttacagaaatcgggagcagagacatctcttaggaggtggcgaggatgatcagagaagatttagaagtccaggggaccattgagctatgtcttaaaggcaagtaggaattgaactgggtaatgttcccagcagaggcaagaaacaacattcactattaggaagtcaattatgagcttgctagtgggatggcataaagttctaacttcgctcccacaggacagtctgtttgcagccagctttgtgttgagttgaatgatgtctgtttatggcttagatattttccttctttgtcctgacttaaggtggcgttagtgcccccttgtggaagtagtgagtggtgatggaactgtcttagcagcacgctgtgggaaacttcagtgtttatttatcatgatttatgtaaacacttgtttactgtacatcagaatcctcttgagtttcatttaaaaggacttaatactctcacccctgaattagatattcttgcttcttcaaaagctgttggttttactctcaccatttaaagtagtataacttgtatttatattatgtatttatacacatacacacatacacacacacacacacacacacacacacatatatttgagctaataatgcagtgaactaagttttaatagctttgggcattactgatccctatttaaaaacacacatacatacagacacacacacaactgaaccttcaaagacctcagaataattgtgaagctaactgtataataactgtataataaaaggaagctaactggaagaccaaaccttcagccacaggtagcattttggaaggctctttcagccacgggtagcattttggaagcatcctgaaatgagaagaattgtgttcactccttcactcctgatacaagtaagacggaccattcccaacgtcttgtaaagagcattttccttcaaaattaggagttctaggacagaccttaattttttctgtctttttaaagatttattttatcttattttttttagagacagggtctcattctgtcacccaggctggagtgcagtggtgcagtcatagctcaacacagcctcgaactcctgggctcgggcgaccctcccacctcagcctcccaagtagctgggattacaggtgcatgccaccatacccagctggctaatatgtttttaatttttattttttctagagatggggtctagctatgtttcccaggctggtctcaaacttctagcctcaagtgatccttcctcctcggcctcccaaagtgctgggattacagacataagccactgtgcctgggctttattttatttttcattgacccataataattgtacatatatggggtacagtggtaatgctttgatacatgtatacaatgtgtaatgatcaaattagagtaattaacatttcagttacctcaaacgtttctcatttctttatggtgggaacattcaaaatcctctcttctgttgtctctaatattagcaccttgcttgatgcctgacccataaacaaagacactgattttttgtttcctttcttctttaagcagttaggaggccttgtgatacccagagattccaaaataatgtttgatgtttctaaaatcttaagagaaatgaagcattcacccttaataacatacaggctgaagtgtttatttttgactgggattgaattaaaccaagtggagcaaaacaaaacaaaattgtttatcttgtactgaccagaaacccttactatcagtcatttattggcaaaaaaaagaaaagaagaagaagaaataattcattatcaaatgtagcttatttggatgagtaagatttttttaaagcctggacttgcagggaattgataataaaagaatttcttgatgaaaagttttgtaacccctagctaggggtttctaaagtcttttctgtttctcttttaacttctttttaactttaatatttagtgggggaggggaacctagaaagtacaaaagggtagtttaagaagattctctttaacactccttaaaaatcctttgatttttcagtctacctgatgacagctgccatttgccctcaagccggccaccagtcctgaggttatttttcccttgtttgttctttggcttcacagatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtggtgagttcatgctcagcgaagcctgttctaggatgtgctggcggcagaaaggcccttgagtgctttaacttaattccagagcaaatctaacttttcatcttttaaaaaactggggaacagagcagggtgctgagaggcaggatttttataaagctcatgtaaatctgtgttatgtacaaaagttaccatgcatagcataatatgcataatatatgcataagttatgtacaaaaagtattaatgcatggcgtgtgtagtaggctttttggttgaaaacttaaagatgaaaggacaattcatgaaatgagtataagtgagcattaaacacagcaactcattagcagtcttacattaccaaattaaaaattggatttctttttttacttagcagatcagcaaaaattaaaaacattggtaaaatccttcggtggctttggtggggaggaagcaggacccttgggcactgttcgtggcagggatctgtggtccgaggacttcctcggggtcctggctccagcagtcccgctccagggaatttatactgtgaacataagcacacaatgacaaataaatagaagccaaatacaaatatacagtggaacgtatgtgatcatgagacttagatttatataaatggaaagattatgcaatatatgattgatttcagaaaacgagatataaaacagcagatatcaatctcgcttatgtaaaattcttttctttatattcacacgtcaatagagataggtctcagaggatcttcagtaaaaaatattaatggtaggatttcagaaaaattatttctgaatttgaaaaaactttttcgagatagagtctcactgtgttacccaggctagactacagtggcacaaacatggctcaccgcagcctcgacctcttggactcaagctatcctcccacctcagcctctcatgtagctgggatcacaggcatgcaccaccacggccagctaatttttttactttttgtacaaatggggttttgccacgttgcccaggctagtcttgaactcctgggcctaagtgatccacctgccttggcctctcaaactgctgggattacaggcatgagccaccgcaccaggctcaaatgaacttctaaaatcactttgcctgggatatgagccggtggccgtgttagtgtttcaatgaagtgattttattttaggtcaatcttttgtacacactttatagtccataaaaaaataaaataaaaagtgagggggccctcatttactgtatgtttctcttgctgaaaaaaaaaacaagttaatagttcaagattaaaatgcaaggattccattaacattcctatggaagattttaaaatgtttgtttttacagaaatataacatgaatttcttgagtaaacaggctattcccagagagttacatgtcagggtagcttttcatttggaaactgatttgcctaggaatatacatgtgtgttttatagaaaataatgcacaaatacattcttattgtcaaagatttaaaccctacagaacccccacagtgtgttggtatcttccctccactttccccgattcatgcctctcttctttacccgcttccaccctgctctgggcccccttgccctctctcttcttgctgggtttgctgctgggagtctgcaggcgataggaaggacagaggagaaaggggtcagggtactaacttcccaagcccccccttacagagtcatgggccagctgcattcctctaccaaaggtttcagcttctgccagggggtgtgcccaagagctctttctctctgggtcaccacccctctcttcctccctcccagcccaaggctagccatggtgcccaccgtttcttgtccagggtactgtccatcatgtttctctgtatcctgtctatgctttacaactggtccttcatcaaattctgcttaaatggcccaatttgatgtcttatctgtttactctccaccctgactgatctgtacctaattcggaccagaaaaagaaagtccgctgctcactcctgttctcattccctcacaagtaaacacggcgaacagcttagctcacccttctcaccctcctttccatgcctgtcatcaggtttcactgaggaacctggaactggatgcgactctgttctgggccatgcagcagggcatgagagtgtcataagttccctgttttcttgccttggccaaaacccagcttatcatgataagatagggaaggattgtcttgacagggctgtgaagaaagtaccgccatttgtggtgtccccaagtggctgattgtttccatttccacagactgtccgtcattttctgcctgtttcctcactctgacctgcaggagtggcccagctcgagctgctgtgtccaaactcacagggcccagggtgccacctgtcggatgcttcctgggcctcagccacgcctcactattctgggtcactttgccaaaacattgtcattcagtttatctgccttcttgactgttttccccaagatatcattaagagctctgagaatatttgcttgataacaaaaagagagtgaaaactagaagagaagaaaacccttctgatttatgccccataaagtagaagtacttcaagggtagaaacttttctattaagaaaaagagaagccttaaaatcatttttagtagatttatatttcatgctcattgcaaaatcctcagtatacctccatgtacaatatatatggcagaaaccaaaagttcccctaaaatcctatttcctaggataaaattccctattaagtatcaagtttgtcatttgagaacctttctaggtatatgtaaaatatgtctatgaaactttttacatacataggattgtactgtagtttctgttctataatctgctttcattagagagtggacaactttttgtgccaattcataaggatttacttgatccttttatcagccacataatattccataatacaaatgtatcatgctatcctatggaaagccatctgcttttttcctataacaacactgcagtgagtattcttgtacataggtttttcaatatttgcatcagtaaatttctaaaggtaatttcctgggataggaataggaatggaataggaatctccaagtcatagttgttacaaatgttttatggttatgaatttagacatttgagactttattttggaaaaaaaacatgaagaataacaaatttatatttccatcttcttttctcctgagtttctaactcatacctgtctgttcacattacgtcttaacttggttgcctactaaattctagttgcatagatgaaactcatttatgccaaggcaccatggcacacacctgtaattccagcactttgggaagctgaggcaggaggatggcttgagcctgggagttcaagatgatcctcggcaacatagcgagaccctgtctctacaaaaaaatgtttaaaaattagccaggcatggtggtgctcacctgtggtcccagctgtttgggagtctgaggtcgggggttcacttgagcccaggatgttgagatgcagtgagccctgatcacatcactgctttccagcctggggaacagagcaagaccctgtctcagtaaataaatatatgtattgcccttgcccatttagttctcaacccatcgttccttagcagcaaatggcaccaatactcacccagttacttacgccacccctccttccccagctactgtccccgaactccctttggactccagcctagaatgtagagtattgcacacgatggagcattttgctgttgtttttccaaaatatccatttcaatttctactaaagtgcagtctaaaaagtttcttaagtcctcaggaaatccatatttacttgtagtagaaggtaattagagggactttcatctataaaggtttcctgatattaaatatttaagataccctctttgattttacagtgtgagctcttaacatttcagtgagcctagttacgtcttccctagtagcacttaaagtggaaatcagattacttcaggggctttctggaaaaactgggtcacccaaaacaccacttagagaaagttctaaatctcctccacatttttaatgcttgattcttcacttattgtctcccattagaagttttgttgaccaccattcatctaagagaaaatccttattttctctttttcacctccgctccttttcagaatgaatcaacctattatacttacgtttttatacactgcagaaatgacccttgttaaagaatactcagtctgccttccagaggttaaagaatagagagcatcgggtaggggattttaaagggaaaagctctgggacgatgagaggctccatgctctgacacaaggctcccaagtccccttccttacttgattcattctgcttgggagttgtgcttttatcagctacgtaatattccatgtagtttacctgggtgggccgattttgtgtttagactgtgagcagggacctcacattgcaagaagtgaggtattttacaaagcttcttacatcaaaagacggcagtttttgctatgggccagcttatgctgagcactttgtatgtgttgtctcaatgaattttcatagctctgtaaagtaggtgctattattgtaggcttttacagataaagaaactaagacttggagtcaaggaacttgccaaagtctcagagctagtgtgctacaagtgcaggatttgaatacaggtcttataaccccagatctcgtggctttggcacgtgtcctctataaaaggatgcagtacttgagtgaccaggtagaaagacagaaaaggtgttattttatctcccagctcctcaaggcaccaaataaaggtaagcatgcgtatgtctgatgcaccctggctaccactggtcatcagcttctgtggtcagaagcagaaggagtggggggaaatcagtcatcaagcagaggtgactggatgcggttcatggttattaatattactgatcagttaataatgggtccagccaaggatggattaactggtgaagctagatgatctctctcctcccttgaacacattccagctcataacttttcattattcattacttcaatcctccttaacagaaatagtaaacatttctagaagcagttaacacctccaggtccttatttcatgccctggagcaatcacttattaaccacttcccatatttcacagtttctgaaaattagctccgccagaatagagatttaatgttttcttcaaggattaaagagctcattaggaagtgatttttttctcactttcccattgatttttccgtttctgctgagaccattttgttatgcaggctaagagtaaagacgaagaatcctctctttcattcttaggttgccgcaagacagaagccaggcttgggtgagagttcaacacacatgggagctgaggcgagctgcacccgggttactgaacagccctgcaggaaatgcagtgtgctaggaccaggagagccccagttcctctgccagttctctatgttgtttcttccttagggaaaaactgtagtgtcatcctgtggtgccatatattctaataacctcagtatttttatgatatttcagtgttcatcaagtacactctctttccctctcttggtatctttctcttcatctctccctctgtccatccctcccaaccctgttctatggagaactggcatattgaagttccctgtctcaaaggcagtgattggcacatgtcatctccaaagaaaagatcagtgaaaatcgtgcaagaaacttgctttctctcttcttgtttgctgaactccctaagatgtggaatctgttttgtctatagagcatcttgcaggtagactgttctccaaataacatttgagaaatgctggcttaaattattcttgggttttcattagtaagtagaagtaccataaagtatctaaaactccagtggtgattactggaatgggtgaagagtgaatagggcagggtggtgaagtaggaggaagacaatccttggcattagactctcctggctcctcacttcttagccgtgcatcctttggaggttacttcatttctctaaaggtggctttctcaactgcaaaatagcactgcttacgcctaccccgtgaggtgctgtagatcctcagcctgttgaagggttgatatgggcctggcacagagtgagccctgtggatgctctgtatccctgtctctcttcacctgcacatgtaggcttatccaaaatgaggactagaggtaataaaattgcaccatgttgggattcctgctcaatgagtaaattttagccgctcttgtcccaaaaacagcaaaatgggtaattatgtgagataatggatatgttaatttgctttttcatagtaactattttactatctatatgtatcccataacgtcatattgtgtaccttaatatacacaatacactttatttaaaaaaaaaaaaaaaaggaatgattctaaggcagcttgaatgtattcttttattcatgtgagggtcaacttcttgcaaagcactgaattttaagcactttgtgatttagttaaattctccttaacagaattaaagtgatttcagtgattcccaaaggcattctgtctagactgaagaaaggagaattcttcactggggaaggaagaaataattgtccttgtctttgtccttctaaggaagctatttgtggaaaagggaagttctccaactgagttgctctctgaagctatcccggtgaccagcaagcactcatcctgcttctagaagtcaacaaggatacactgaacctgcttctgatttctttagggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagtaagtggccccttcccctcaaagaaaacagtggcattattcaatcagcaggtgttatgtcggacaccagacaacatgaggcgaaaatatggcacatcatgaagcctgttctgttctgcagaaatttcatggtgggattacgaggccgtgcttttctaaacgcttttattcaatgcctgtgcttcctgtatggtaagatatggatcataagaaaggagagagggcaaccttggtctctaaacctccacatgagcataagcagttcatggtactgcaggggctttttgacatatctcattgtatttaaaagactgaaaacacacgtgtgtcatcatagtatggatgaaagtacagtgaggtttaatagaactccatgtgctttcataaggagcttcattttagttatttatttatttaactagaagttcatgaagaccaaggcagccagtttttctattataccctaagagtaagacaaagatggaatttgagctgttatgacttgaagccatgggaaaagtaaccccaaatcctgtatgaatcttcatgttctaacaggtcagagaatgctttgtccagaactgtgaagaagcaatgaatgttgttccctttctatgaacttttcaacattgctgccttcccaccatccagagcttttaacaacccaggtcttggtggtagtggagagttctaatagcttttgattctttggtcaccgagttaagtaatcagagtaagacattcacaataagtattactaattctctcaagattttttttttttgtaaaataagccttcaagtaggcaatgcttgatataaataaataaataagatggtggcatcgtaggcctcaatgggtgaagaacaggttctttaccattatagcccatctgtggtgagaatctgcccacgtctccttagtgctcttccacaggatgagatcaaatctgataaagcatcctctgatgacagtaactgacatttacacacacacacacacacacacacacacatatacacacatatatatacgtgtgtgtgtgtgtgtgtgtgtgcatatatctccatatatccccaaggccaagtaggtcacaaatattcaagaaacctatattatacccaaatataataccgtgtcacctatgcctaatctttgctcctgttttaatagtaaaatactttcagaatctcaaaaggggctgggcgtggtggctcacacctgtaatcccaacactttgggaggccgaggtgggcggatcacgaggtcaggagttccagactagcctggccaacatggaaaaaccccgtctctactaaaaatataaaaaattagccaggcatggtcgtgggtgcttgtaatcccaactacttgggaggctgaggcgggagaattgcttgaacccaggaggcagaggttgcagtgagccaagattgcaccattgtcctctggcctgggccacagagcaagactctgtctcaaaaaaaagaatcccaaaatgaactatcaggaatgtttctcctctcttttgaccatctccaatcccaataaggatggcaggtcttagagcagccaagatggatatggagaactttagttggatatggggaagaataatagatattccagagtactaggaacttgttaacactcaacctccacgtcagtataaaagaaagtatgtttgtagatcttcctaagtattggaacagggggcccattacacctgagggtgggagcgcctattcttgccgttagtacatatgactcattttgccagctaagtgtttgagagaggagttgtcctttacttatctggtatttaaatttggaattcaaatttaagatgcaattcagatcggtattcagatattaactttaaaagaatcagtttgtaaacatgcaccgactctatcatgtagcatttatagcctcgtgattttttttctccatttctgctttcatgctaggttcacagctgtagcacaaacagatttgaaggagccgctgaaagttcttggcattactgacatgtttgattcatcaaaggcaaattttgcaaaaataacaagtatgttcaatttaaaatgtatttgtatacttgaagaaagtgttacaaactgagactgatttgtgcagagaaaaaggatcagaattaggaatgtgttgccctgaaactgtacaaggtttcatttgatacattgccaaattatgctattggccttcgtttatttattgaccttcatttatttattttttccttttatctttttatttcaatagtttttgggatacaagtggtttttggttacatggatcagtttatatagcgatgaagtctgagattttagtacacccctcccccgagtagtatacgttgtactcaatatgtattaatagatttttagctcctcaccaacccaccctcctccttctgagtctccataatccattataccactccgtatgcctttgcatacccgtagcttatctcccacttacaagcgagaacatacagtatttggttttccattcttgagttacttcatttagaataatggcctccagctccattcaagttgctgcaaaagatattatttcattctttttatgactgagtagtattccatgatgtgtacatacctcattttctttatctagtcattgctcttgaccttcatttaaatcagcgtccccacattttgcacgtacatttcatgggaagccccagtgactacctaaaggagtatttcatgtattgcttttatgaatattggctctgacttaggtgttgtcgctctgttttcaaatgccaactttttccttttgcttgaaaaaaagtcaagactgcagtcattcactgtacccagatatgtattttggcatttcatgctcattaatatgaaacgatataaattcaaatgaatctgattaaaactttcctttgccaaagcaattaaggcatgcttttcatttgccagcagtatatgtacctttttctagagttatgtttgaatggtcagtcctttgttctttaaatttagaacatagcaatctttccaaggaaaagccatggcttgaacattatttgcactccagtttgcaaataactttgagtggtaagaaattagctcattaccagcttcagttgcatgctagtaaacacctagtacctgttctggggacaaacatgactcccctggtgaacctgcagctccatggatattctgatagccgttcatccctcatgactcaaactcaggcctccagcccagcagcattagcatcacccaggagcttgtttgaaatgcacaatcttgggtgtaacccagacccactgaaccagaatccattttaacacagtccctcagcccagcaaagactgagaagcaccattttcatctgcacttttcccttcaaggttgttcatggtagctgaaatactaaatggggggtgttcacaggaagaaccaggtgccccagattctcctggaaagtcctctttaacactgcatgtgacttgggccctataaatgtgcatctcagtcacaatttggtcatattagagctgggcattggtgcagatagttcacaagcagatgacacaaaaagcacattttccctttgcatccagacctatgtcccatccagactaatatcaacttaagtttttcattctctgtgaaagctacacccagtgggtgttgctggaatggtcagaatttgctgagaagtaaagtgagttcaccagaatgtccctgaggcacaactgcatttacacatcggcccttccaggaaaatctaaactcttctcttgttcgacactcttctcttactagcatgcccatgagatgagtggctgttgtgaagagccaggacttactctgccactaactagccgtatgattgcagggaacattacttaacgttctaggcctcagtttccccatctgtaaatgctgtctgaaatcccttctgcatctgcattctgtaactgaaaaataatcttgttgccttgctgcttccagaaaaccgggcttcctttttaaagctctgctcttttcatttttaaaaaacaattctagtgatcagaattgaattgatagaggcactaaatcatttgagggcctgggcccttctccagaagtgagtatcacagttcacttagcagggactgaaattcacaagtaacagctgtctgcagccttcaacaccaggactgtcagaggtcatgtcttctgacactttaaaaattggaatttgccatggctttgagctttgaggttacttccccaaccaaccaatggcctgcctatcaaacaaatgctgatactgttttattttctggaagcagggtcagaaaacctccatgtttctcatatcttgcaaaaagcaaaaattgaagtcagtgaagatggaaccaaagcttcagcagcaacaagtaagcactgggtcacgtggcagggcttcctctagcaggggagcaaacacattcctgtatactcattggttgagcaaatatgtaatgcaccctctttccagccaggcagtgtgtgtgggttaaccctcaggagacagcagtgagtacagacagactgaagacctgtaaccacaaagctcagaatctgtttcattaaagaaaagcatttcagtgagagaaattcctctaggacaggagtcagcaaacttctataaagagccaggtagtatgtatttcagatttgtgtgtcataccatctccattacagcttcttagctctttcactgtagcatgaaaacagcaatcaacaatacaagtaaacagatgtggctgtgttccaataaaactttatttataaaaacaggatttgtcctggtagacttgccttgaggaaaatagtttgctgacccctgctctcaggaggataaaacatgttctggcttcttactggcaaaaaagaccaatcttcagatttgaacataaaataaacaacaagtacttaaaggaaaataggcaatcaggtctatccaggataaaccgaagaattcgccagcatctgttgaattgcggcaggattgctgtacagccttccttgataattagaacatccacatctgcttcctcctcagtggtttacataatgaaggagaaaacagaacaatcgtaagtcagttttttcacccctcattatccgtaggaaaatagatgaatagatttggccaactctgtgagcccataaagtgaaaatcttagctacacttgcagctgggtcaaatatctctggtcattgaaacataccagttatactcacaatagatgtgttattgcctttctcgaataaacgttttaaaaattcctttaaagaagcatttaaaacaaagaccctgaaataagagggttggaaattttaagatgctttttgtcttttctaggtaattttaagtaacatctaaaagttattgaccagttttgctgagtgtaactatcaggaccagctacatagtttgtggggtcctgtgccaaatgaaaatatggagccccttgttcaaaatgtataagaatttcaagatagcaacagcagagtattaaacccagtgcagggccccatgtaaccgcccaggtcctcctgtcttagtccgcctgggctgccatgacaaaataccgttgactgagtggtttaaacaacagaactcacacttctggaggctgcgagttcaagatcaaggtgttggtgttggcaggtttgtttctcctgagatctctggatctccggaggtcgccccctccctgtgtcctcacatggtcttttctccatgtgacacatccctggtgtctctcccacttcaaataagggcaacggtcctattagaatagaaccctacttaaccttcattacctcctcaaaggcattatctccaaatacagttacgttaggggtttggggcttcagcatatgaatttggggggagacacatttcagtccataacacctgctatttaatatttgtttttaataaccctgggtaaaagggcttgccccagcataactgcagctgtttcctttataacatcaagcccaagtgttcaatacttcatggggtttgagcaagaggactgagctattgcaacaggcatgtggtagtaatgccacacacctaccctcccgtgaggccctggttcaggcttattaaatggaaacaagcctggcagacgaggaatggccaagacccatgaggctaaagaagtttgctttccaagtcagatgcctacacctggtgagtggaacagcagtataaggtagtaggtcccggatgagtggtctacattccagtgcagaggaaacctaaataatgtgccaaaggagaaggcacagacacaaaagctaagaattggactgggcctttatatacagaaaagatttagagaagctaaacaggaccaggggtcgggcgcggtggctcatgcctgtaatgcccgcactttgggaggctgaggcaggtggatcacttgaggtcaggagttcaaaaccagcgtgaccaacatagtgaaaccctgtctctaaaaatacaaaaattagccaggcgtggtggtgcatgcctgtaatcccagctactcaggaggctgaggcaggagaatcgcttgaacccgggaggcaaaggttgcagtgagccaagatcgcgccactgcactccagcctgggtgacagagtgagactccatccccaaaaaaaaggactgggggctttatcagcaaagcagatggtgtgaataaaaaatagctaataacaataaatatgcattagatgtgtttagtggcaaacactgttctaagagctataatatatcttatgtcatttaattatgtcatttaattctcatcaaaactctatgaggagtaagtatgtttatcagagatggtgcttgtgtagaagacatgagagagtaatgtaaagggcctggcccaaggtaggcttagtaaatggtgaccattgagcctgttgtaacatggccagcctatggaacaagcatgaagtgtgtcttcagacaccagcctctgagggtccatgaagctagctaacttgctggccttatgcttacatggtctcatgtaatgtgcacaacacattttccttttcttcccgtagctgcaattctcattgcaagatcatcgcctccctggtttatagtagacagaccttttctgtttttcatccgacataatcctacaggtaagtgactctcctcttccatcatgccctctctgttagaatttcaaaaggtatattgcactcttcattatatccaacagtggtgcccatagtccatttccctaatgtcaatagttgcagacactttgaataatataaccacccatgttaaagagataggaaaataaaggctgtgtttacagatgtgatggaatcttttacacactgacaggattttaggttttgcggattgttgtttttaacagagaggctcagcatccctttggaacacttttgacatctattgacttttccatatttatataaatgtggtggttcaattttgctagaagctatataacttcaacttttgtgtattagtctgttctcaccctgctatgaagaaataccctagagtgggtaatttacaaggaaaaagaggtttaattgactcacagtttcacatggctagggaagcctcaggaacctcacaattacggtggaaggcatcacttcacagggcagcaggggagagaatgagagccgagtgaagtgggaaaccccttataaaaccatcagatctcatgagaactcactcactatcacaagaacagtatgggggaaactgctcctatgattcagttttctccacctggtcctgcccttgatatatggggattattaacaattcgaggcaagatttgagtggagacacagagccaaaccataccactttgtaagcccactctattgttataccttgggaattgttaatacagtagatttttgctctgtgagtcatggttcaaacttggctctggccttaagcctcatctttaaaatgaggacaacagtagtgctgactgcttattacaattatgaagtataagttcatctttgtagagaggttggcttcttgttggtacaagagtaggcactaatatattttagcttttactattttatttaatcagtaatatgagatagttccttattctcttatctcattgcatctgtgatgttctaattggcatgccccagaactgagccagccaatgaggagcttctggccacatgtggctatttaacattaactttaaaaattcaatttctggttgggtgcggtggcttatgcctgtaatcccagcactttgggaggccaaggcgggtggatcacctgaggtcaggagttcgagaccagcctggccaacatggcaaaaccccatctctgttagaaatacaaaaaattggctggcagtggtggtgggtgcctgtaatcccagctacttgggaggctgaggcaggagaattgcttgaacccaggaggcggaaattgcagtgagccgagatggcgccattgtactccagcctgggtgacagtgcaagactctgtctcaagaaataaaaaataaaattaaaattcaacttctaagtcacactagccacattttaagcactctctggccacatgtgactagtggctaccatgctagacaacaaagatatagaccatctctaccactgcagaaagttatactggacactactgagcaagaggtcaaacatgattgtttcccttcccttaaatagaataccttccatcttattttaaggattattaatttacagagtcatgcattgttttcttttaattctgtaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagt

SEQ ID NO: 37645 - DNA, 3860 bp, Homo sapiens; identical to SEQ ID NO: 37105

SEQ ID NO: 37646 - DNA, 6229 bp, Homo sapiens; identical to SEQ ID NO: 37643

SEQ ID NO: 37647 - DNA, 142781 bp, Homo sapiens
gccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggtgagcgactggggccggcccggacacctccgttctgggagccgcgggtcggcggccggggcgccgccaagggctgcagggaaaataaaaatggagcagggaaatgcgcgagtcctggggcatggggacggggacgggaagtgcattgacagagctgggacaaagggaaaatcctcgagtatgccgaaaaataacatcctttcccgttcccattgcccggctgtgtgattcatgctttttgggtgactcaaaagtgcctggtttcgcttagtaggaacaaagcgcttagggattgcatgccgcttgacgggacccccctgagattctggcttgggactggacttggatttgtccagccagagtggcccaggggtcggattgttggggaggactgtgggcttccgtctagtgggacgcagcctgccccgattctgaatcatcgtcactgtcaagcactggagagaggtgaaggggtgtccaaatctggcgaggagggtcttgttcttgaacttagtttggcaggccgtagtttagcggggagctgggaccagttccctggtcactggccgaggggtgaggagacctgtgggtcctcgggaaagttgatttctgtctcccagccttaactgtcaaacagggctttgaactagttatgactcccaaacgtgcattagagtcatagccattaaacacagagttctggggcccccgccctggagtgactggggagatggggaatttgtattgatgaaaggctccaagaggcttggctgcagcccccatggcccttgggaacccctgcagtgattgctgtttgaactcctagtgttccaggattccgagccttgtgtgcacctccttgggatgtgcctcggtaccctccccacggccatcatctccatcctcttcagagctttctctcagcctcctgaatgaagccaggggaagtcccttcacattccagtccagtgtgacctagttgtagccactcctgtcgcagaagaaccccttagactgaaaacgagtgaacgggcctggttgtttttaatgccacttcagtgcacccagggtttgacttgtttacatggccgactggagtagggtggtggggcaggggttacggcctggggcacggggcctttctctgaggtcaggtttccaactgccaggaaaagattcctttcatctaaaccccaaaagcttaacgaaacactcaaggctgcaaagtcatagatggttaagataccaagggttttaaggacggtcagcttgggacggatagaactcatttacctcggagggtgttttggagtgtaaaggagaacttgattccttcttctcatctggatgcttttttggatgaaacagtttatgcgatgaggagttgttaggagactttgcttcaggtcttggctgtcacttccagctgtgtgaccttgaacaaatccctttacttctgtatcttttaatttccttatctgtaaattgggaatcctggtccctggcttacctccttcactgagcatttgtgaaaagcaagaaatgatattttatgaaacttttttctcttacaatttaacaaaccaaaaaaacctgccactttaagaagtttctgggcaagggttgttctgagagaggtttgtaagtttcctggttattctaagcaactgtcaaaattggtaaatttacacctcataggggctgttttcgaattcttaagcttagataaactaggatggaatctgcatgtttgagtccaatctgctaagattttttttaatctgttgattattaattggattcacggggagaggcaaacttaaaatactgtactctcactgtattcaaagttgaattgtgggttttgaaacaggcctgagaccttcagggcacaactggaatggtagtttctgaaataatgagtggggttatttgtgctgggagaggttagcccagcattctacctcctgggatctttcaggaagaaactgctcttgaaaagagaggagggagactcagggctgttgccaacagccttctctgctgctctctgcatccggccctccctctcactctcatccttatggctccattagaaaacctcaaccaatcggttcccatcagtctcccccaagcccctgcttcctgctgcccctcccagcctggagcttattttagaccgtcaaagctggaagatacatcagccaccatcgaggccactccctccttaagaggagaggatactgggcccagggaggtggtgggcagccttggccggcttttgctctggagatgtcatcttcccaggagcagacatttctctgagccttttggtttgaggtttatttcctcagctgtgggttttgtttgtttgtttttcccctagagaggcacagaaacctcttgcagggactgtattatggcatcagacctggaagggacttggagatcagctaatgtaaccacttcctcttaccggtgagaagattgaaacccagagaagggaagtgacttgcccagttcagggatggagccaggattctgaagccaatgttagttcccctactcctgttcagggtctacagtggccacaccatgagcacatgatgaggacaataatgtcagggatagttatgttgcaggaggtgccttgagaatgctggcttggagcagtggagttctttgccttttcctcctcacggaaatttggagtaatctgggataagtgataagtgaccgtcctttattacttgttccaggcccctgttcacagagtgtcatttatcctccagttttcctgtgcatttctcagcgacatacggacccaaatatacagttttttttttttttttgaggcggagtctcgctctgttgcccaggctggtgtgcagtggcgcgatctgagctcactgcaagctacgcctcccaggttcatgccattcttctgcctcagcctcccgagtagctgggactacaggcacccgccaccatgcctggctaattttttgtatttttagtagagacgaggtttcactgtgttagccaggatggtcttgatctcctgacctcgtgatccgcctgcctcggcctcccaaagtgccgggattacaggcgtgagtcactgtgcccagctcaaatatacagttaaacctttttatcctgaactgtgtgcatgtatttgctctgcgacatattttttgttttctgcttatcagcatatctttacgttcttttcatggtgttgcatataaagatgccagaaccattttgcatattaggcctttaggagtgtactataatttaacccgtttccttattgatagacatcaaggttgcttatgggttttgctgttacatacagtgaatgtttcggcaaagagtcttataaatacttctgggtgtgtgtgcgtgcatgcatgaatgcaagtatttctctgggggcagatacctataaatagaatggctgggttgacatcaagcgcataaattttttttttcagataccacgaaattgccttccaaaaaaggctgtgtgataacatttccaggactggatattatcaaatgatttaattctctaataattttcctaattactcatgaagttgagccttttttatagtatttactgagtatttttgtttcttttgtggattgcctgttcgtattgcttgcccatttttctgtaaggttagtttttcccccagttgatttgtaggagctttctataagtgctttaggtcaggggtctgcaaacttttttggtaaaaggccaaatagtaaatataatttagtgtctgtgggctatatggtctctgtcacaactgtgcagactttgccgtctcatcacaaaggcagccgtagacaacacattaacgaatgagttcgaatgagttactgtgttccagtaaaactttatttaccggcagggcgcagtggctcatgcctgtaatcccagcacttagggaggctgaggtgggtggatgatctgaggtcaggagttcaagaccagcctggccaacatggtgaaactctgtctctactaaaaatacaaaaactagctgggtgtggtggcacatgcctgtaatcccagctactccttgggaggctgaggcacgagaattgcttgaacccaggaggcagaggttgcattgagccaagatcgtgccacagcactgcagcctgggcaacaaagtgagactccttctcaaaaaagtaataataataataaatttaaaaaactttatttacaaaaacaggcagctggcatgatgtgtggcctgtgagccatagtttgctgaccctgaactagatattaatccgatgcttgccacgtattgcaggtattttttcccagaatgccacttgtcttttttgtgtggttatttttctttttcataatataaatgcagttggtctttttttttaatagtttgtagttttaatgtcatgtttaaggcctactttccaagatttgtaaaataatttctcatattcttttatagctatttttatacttagctttttaatctatcagacttgttttttaggaaaataattctggttaaaggcagaagatctactggaggctattaaactgggtaaattacaatcaaggcattctctccagatcagtgctggtgaggatggaaggaatcagactctagggacaggatgttgttggttgatcagaggtgggtgttgaggaacctggggtagttagaagtacctttaacagagattgagaagaacagatttggagtaaacttgggggatggggaggggtaaaaaataatatggtaagtttgacccttatggacgtagagggaggctgggttggaattcttaagtcttggatgtggaggtggttgctgaaatcatgggagtgagtgtgagcactcaggaggctgcatagagtgaaaggagaggaaccagcctaggaagcccccatgtagtgggcaggcaaaaggggagcaggtgcagaggctgggaggtgaatcagaggggtgggcattagtgggagaagcaggtctggaacccagggtgctcagcttctacatccgcgtgttgatctgggggtgatgtctctttctcctgctgactgtgtaacttcaggcattgcctctgtggaaggagcctgcaagcctgtttctacttctttgtctagccctgtttttttgtgggaccttggctgggtcattttcattgctcaggcctgttttcccatctggaaatgagctcggtcttgatctctcccagggttcttagtcttcctggtgtgattctgcccttgctgtgcccataccccactgccaaggctccaaagctgcgggggcctcaggtgggaatttcagacatagagggtgtgggccaggacgaggtctcagggaagcatttcatcaggtttccctttgttcctgtagacattcgtagaagttctaaggcataggacttcctgatttgacttaatgtgtatctcagaaacaacggggagatttcgcatcccccccttgtagaagatctgtaacaggagttggtgtgttgcttggcagggagcgtgtcaaaaatctcagacacacaaaatcccatttcagacggccaagcaccatgacaaatgctcagcgttgtcatcagcgaaacccaaattgaaaccacagtgagatatcacttcatacctgtcaggatggctagaattaaaaaaataagaatataacatgttggcgaggatgtgaagaagttataactcttgcacgttgctggtgggaatgaaatggtgtagctgctgtggaaacagtttgggggtttctcaaaaagttcagcataaaacctaccacgtgagccagcattcccacttctaggtatatgccaagaagaattgaggacaggtgtattcaaacagatacttgtatacaaatgttcataacagcactactcacaatagccaaacggcagcaacaatccaagtgtccatccactaatgcgtagataagcaaatcatagtgtatccataccatggaatatcattcagttctaagaaggagcgaagtactgagacatgccacaacatggacgaacctagaaaacattgcgctaagaggcagacatgaaaggtcatgtgtcacatactgtgtgattccatttatgtaaaatgtccaaaacaggtaaatctgtagaaacagaaagcagatcggttgttgccagagcctgagggttgggtgggcaatgtggaatgactgctaatgagactggggttctattttgggggtgatgaaatgttttggaactagataaaagtgctggttgcacagccttgtgaaatgtactaaatgcccctgaattgttcacttccaaatgcttcttgacttatgatgggacttatggtgggggtacatccaggtaaaacccatcagacctatcacaaagtcaaaattataagtcagggactgtctgtacaagaatcgctctctcacacacacacacctgccttctgctccttgtgtcacctggagtgaatatctgattgtttctagagtctagaccaaggcttggcaattttttttataaaggactcttcttttatcctggggaactccttccccaagccactctttcccacctgaatgacacagttggaccaggtcggtggttttcaagctttcatcaaatcccggagccttttactcaaaagaaatcttgtatattttaggttttgcaggccaacaggcaaaatcgaggaggttgtgtaggatatagccacttaaaaatgtaaaagccattcttggttttggggtcttagaaaagcagctggtgggccaatttggcacaggggcacagtgtgccacccctcagaccagccctgtcctctagaactgtaatggaagccacataggaaattttaaattttccagcggctacgttaaaaaagtaaaaagaggggccgggtgcagtggctcacgcctgtaatttcagcactttgggaggccgagacgggcggatcacgaggtcaggagatcaagaccatcctggctaacacagtgaaacccgtctctactaaaaatacaataaattagtcggggccgggcacagtggctcacgcctgcaatcccagcactttgggaggccgaggcgggtggatcacgaggtcaggagatcgagaccacggtgaaaccctgtctctactaaaaatacaaaaaattaatcgggcgtggtggtgggcgcctgtagtcccagctactcaggaggctgaggcaggagaatggtgtgaacccgggaggcggagcttgcagtgagctgagattgcgccactgcactccagcctgggcaatagagtgagactccgtctcaaaaaaaaaaaaaaaaaaaaagaggtgaaattaattttaattatgttttatttaaccagatatatccaaaatactgtcattacaccatgcaaaaaagttatgacgtgcgcattttacgttacagcacatttcagctcagacgagccactttcccactgcttagtagcctggtggtgtggccgctgcccgcagtcctggtggcagccctggggtgccacaggtggtggtgagtttcctccgtccctcccttgggccttgggttggaaggttcctggagtgctgcttctctgggacttgttactcctgtttgtgtccccactcctccttggcccttggtgtctattgccaacttttgaagtttctttctttgactatcacatctttgatggcttcttttggtgtgttagaagttctcttctgggctctgatccccactccctgcccagaggcagagtttaggggcagaagggaggaaggtccttgccagggcctcaggcctgtcctgtggggagccggtgagggccgtggtgggcaggctggcgtatccccctctaaactggacgtgcaatgttccagtattatgtaattgcaccctagcttttttccctgggttctagcctgttacctgatcttttcctctgatttctctttcccttgccacacagaaggactatagtccaaggcctatgttctcttcctgacacaaatgtgcagggtgacccaggaaggtgacttatgtctcccacctgtaaagcgggtgcctgccttctctttgcagagtagtgtgctgatggaatggggagttcctgagccccccatgtggtgagggatgttccaggaagcacgctggctgccgcctctgggggaagtagcctttctttgggcaacctcatgttctttagcagaaataaagaaatttaactcagaatgtttaaattgttcccaagctgccacttagtcttgaaagagggagagagtgtggcagcgaggcacaggggaagacatcctactactggacatggaggatcattgggtgctaatttggaagcatctgacctaagaaaacgggctcttctcttatcctgggaaactcattccccaagccactctttctcagctgaatgacaccgttggaccaggtggatggttttcaagctttcatcaaaagcagtgcagctctgggcaaggcagccaaagcctggagcttggcctcccatcctggggcggggtggcgggggagggccttgggtcatctctggggccatttggggcaggttcgaaaactctgccctagattttgtgctttttccagttttagcaattgaggcagtcttacagctgctctggaatggagcccccatgccctacccagagctctcaaggcattgtcacttccgttgggggcaagagcacctagggggttgattcactgacattttgtctctggaagctggaactgaaatcttccaaaccactcactggttttctcagtcagggtcatcctagttcacatgaaaccacagcctggtttttgcctggagcctgtaacccttctggctccttccccttgggcgcagcttggcggttgcatgctgtgccagaggtggccctggtgtcagagctgctttgcagcgagactctgagtggatgggcctgccggatcctttgaacctctacctactatattgtgtcatagcccgtgatttcacacagacctcagcaggcaagggtggccagcagggctggtggcagcaaggcctccctcggaggaggggaccctgagttttcagagtggttgagcggcctgcccaaggtcactgagctgctcagcaatggggccgtgatacagatttcagctccatgaggctcccgtgccagagtccaccctggctccagactccaccctggctccagactcatcctccctgtccttgggaaggccactttgctttgtaaactccttagtgtttttgtttggccccggggcagatgggtagtagggagattggtatattgcagtgctgcagaataaatcacagctgtttcctggacttctagttcctagccctgggaagagggacctgctggggctgtctgcacctgccctccctgcctttcccccacattatgcaggtgagggattgtcttcaattagcagatggagccgccgagacctggagaggttcagcagaggttcagcgacctgcctaggtcacaggaagtccagcacgattttttccaaagtcctgtttggccaccttgtctctaataagtgttaacctttgctatcaggaacagggccttgccccaacttggactccttagttcttgagtgtgtggtggggcgtgtgtgtgaacggtgcaggctgttgtgcagggcatcgcccagatcttcacctctcctcagcctcggggtgccccacatccccaacatgggctactggcctaggcagcagccacacctttggcacagctctgaacaggaagcacaattttttcctctgaaagaggaattcagaatcaggaaatagctttgtccttgatctctgtaggttctgaggcactggatttaacagacccacaagcaaccgtggcgcactttccacacaaggtttctgacctcctcgtggtccttcccatagataaaggggccaagggaagggggagcagctgcagggagccccagctgagccagagaaaggggccatgtctcctgggtctcctgatgccatacccagagcctcactatcaggactgggtgagccacttgaggctcaggagcctcagggccgcgggaggggtgggtcagggcatttgcatggcttctgcttggggacctgctctgacctagaaatctgacacagtcccacttttcatttcagtgcgcccaggcaagggaattggaatggtggcgagcccagatttgagtttccattctagctccattttccatgctaatggagcaagttacttagagctgaagcatctatgcccctcatctgaaaactggggggttataataatagtacccatggctttgggtcctgatgaggatgcaggaagatgcttccaaagtcctcagcaaccgcaggatctgtggcaagggcagagtttgtaaatactgggttatatggtgggtgcttagtaaatggggtccgttttatcagcaataaaccatgtagtatggagctgtgtgtgggacacggatcttgcccttgggaagctctcacttagcatgctggcccatctgctcttgaatgtccaccatgggccaggccatgggcgagatggggcaggggcagtgcggggagcaccaggtccccatccctcttaggttactgcagagaaaacagcccagggaggggaccttccactgtgattttgtgggcaagctggccctcaaacctgtttctgtctgtcccatgcccattaaacagaagctcaggcccatgcccattaaacagatgctcaggctgtctcctctcccactgagctgctctgcaccaccctagcagctttcttatgtcagccccttgaggactggaaggaagtagtcagtttgccttgtgtgtgtttgatttttcagaatgtgtaagtacagtaagtcctcaccgtcattgatgggctcttggaaactgctactgtaagcataacaacacacaaccaaaccaattttatcataagctaattgatataaacaggatttaagtttctacggcatatttcaggttataaaaattaaccaaacttctaaataaagatccaaagtatttctaatattaaacatggaaatacatgtgagctattatatacatttcaggaagatgaataaaaacaagtaagatcattatctatacaagttttggtgagtgatgacagtgagtgatgacagtcatggtggtaggttaaatcaaggaataaatgtctgcaaagtgaaaattgtaaggcatacctcctaccaccaggaagttcaaaaacaaggacaaaagcggtgggctggctgagtgcttcttactgcatagtttattgtcatgtgtttgtgtgattatcgtagacttgatgactttttagtaggcagttacctgtattcattcatgcgttttccagcttgcttattccagttcaatgtcaccggtagctggagcctctcccagggcacaaagcctggacaggacgccgttccatcacaggacacacttgcacccacacctgctcagactgggaccacttagatgtccagttcactgaatgtgcacatctctgagatgtgaaagaaagcagagtacagagaaaacccacggagtcgtgagagcacacaaactccacacaggcagtgggtgcaggaattcttttttttttttcctcaacattgttataacaaatcaatgttgaatgaaatggcattatttgaggacctgctgtgtaaggactgaactgattttaagaatttttaggtcaggtgctgcggctcacacctgttatcccggaactttgggaggccaaggtgggcagattgcttgagcccaggagttcgagatcagcctgggcaagacagggaaaccctgtctctacaaaaaagtaaaaaacatagccaagcttggtggcacatgcctgtggtcccagctacttgggaggctgaggtagaaggattgcctgaggcaggaggtggaggttgcagtgtgctgagatcacgccactgcactccaacctgggtaatagaacgagaccctgtatcaaaaaaaaaaaaaaatttcttttttttttagagggtaggaagtgaaggggccaggcttcatcagcttaggatttaatgttagaggccacttctgtgcccctgtcaagcccagagaagtcatgcaggtcccatgaagggcagagcagatcccaattttaggaatttctttgatgggtgtatgagttgccatgggcagtgtgggagaagattaagagaagccatgcttatcccactcgtatccatggagcaactgccttgcagttgtctgggaaggaaaatccttgtgccgggcctggttgaaatgcccaaggaaggtagagaggatcccagagctggggagccgggtctagtcccaaatcactgggtgggtgggagatctggccaggacgtttcgtggccccctggtcaccagtgttgagtgggtcccctcagctggcaggcaggtccttccagcctctctgtccaccctacccccagcctttacaagtcattcacccttgcagggaaaggcacctctgctgaggggacccttctatgagatctaaacaggaggagtctcttcttttgagcctgagaacgagctcttctaataggcagatgtcacctcggcagacagcccactacttctcaattccacatctcccttcccgcctggaaaccccgtgagcctgggagcttaggagtcctcttcctagggggcccggccagctagcacctggccttctatggtgtggaggttttcctatacggaaattgctgaagggtggcctgccctggcattgttttgtggcgctgttggtggtattcatagctgacaggaattgccatgtgccaggccactattagctcatttatatttccagcagtctcagaaggcggagttaagagaagggtagagagaggtagtataatatgcctagagcagctcctctggtggcaaagccgggaggaaacccagctgtgggactccaggccttccctgtctccacatgactcgagaggactgagcttggccttgagaccatcaatgtctggctgtgtgtggcccccttggcccctagtgtccaggagcggggctgaccaccttggcatgtgcggggaagggtggggctgacctcatttagctttcctgccctttttttgctcctccttccaccgtgcttctgtcctacctgtttctgaatgggaaggacggctttttgaggaacagggtgtgactcttccctgcgaagacgttgccccagaaatttgtccccacgcattctccagccctcttccctttgccatgaatggcgtcatgttccaaaaatcctgtggccacgggctgtttgtcaagaccaaacagggaagaggcttttaaaatgtcactttccccctccagcttgaatacagtggggagcaggggcaggggccggggctgggcttgcaggacctgtgtgtgggcagagggaggccaggagcccagtgggagttgggggtagtttacagccagccagcagctgtgggccctgctgtccccgtgctatgatggggtgaactgtgtgtgtggttccttggttttgaggggttttttttttgaggtgaaattcacgcaacataaaattaaccattttagcatgtacaattccattgcatttagcctacagtattgtacaactgccacccctcttcagttgaaaacatttccattgctccaaaagaaccccccaccttaactattaagcagtcacccccgcctttagtccccagcaactacaaatctgctttgtgcctcaatggatttacctattctggaaatttcatcaaaacagaatcataccataccatatgtgaccttttgtctgtggtgtcttgcacttggcctaatgctttcaaggttcatccaccttgcagcacaggtcagaattcattccttgtatggatggtagacagtgggattgcttcacccttttggccgttgtggatagtgctgctgtgaacacaggtgtgcgggcatttgtctgaacacctcctttcagcggaccccaggagaggacttgctggcctgtggccattctgtcagtgagctgtttggcatcagcacctggagccacatgtcagccctgcagactgctgggtgggagggctatgggtgggtcccaaataaggcctgcccagagcctggggctcttcacagaggagtctgggatggaaactgggttcctggaccatccctcaagagtcgcacacatgaaatgccgccatgaggcagtgtcacggggcggtgcaggggtggctcagctgctcggaggtacacgccttctttcttccctttttgtctgacctgaagatcatctgactgccaagaaagaggcaagttaatccttaaacattgttggaaggagggctgtggggcatgggagctgaaggctggagaccccagggagacgcggtgccttcccagtgctaggtgctgggagctgctggcagagggcccacagagccccacagtggtccccagaggaccttggggtcagctagagggaaaaggcctttgctacgctgttcatcactgttaccagttttcaacctttatttctttggcagcaaaacacccacccccttgaaatgaaacgtggagctcacatatatgatgcacgaatgttctcatgttgaaggacaggaagaggaatggcatcagctatgagaccaccctgacccccacccgctgccccatcctacacccgaggtggcccctgaagcatgacctccagggatcttcacagtttgaagagccgctgatatactctaatacttgcagtaatattttttaatagaatgcaatattggatgtacacaaaaggatacaagcagcatacatttacaatataaatctaaataataaaaatgaatgctcgtgaacctgccacccaacttaagaaagagaacactgacatccattcaaagcatccttcacgcccctccccagtggtatccctttcacagaggtgacctgagatgatttaggggtgggagccgaggcccagatgggtagctcaggcattgcccttcacaccagtgctggtcgagctgttctagggaacacggacagaagcacattccagtggagtcccctgcttttctgactcctctccacaggctcagggacgttagtcctgtggcacagtaaaggtgcttatgtttgtggtccttcaagcccctctttgcaagcagggacctggggagaggattctaggggccagggggagcagggacccagggaggggatctaagactatggggaatggggacccagggaggagagctccaggactattaggagtagggaccccgggaggggagctccagggccgtggggaatggggacctggggaggagagctctaggactgttaggagtggggacccggggagtggagctccagggccgtggggagtggggacccggggaggagagccccaggggccatggagagtggggacccagggaggagagctccagggactgtggggagtggggacccagggagggctccaggtccattgagaaacaggtgttgcctctgtcacagcccctcctcctggcctcctcaccaaggcagaggtccgcattgttgagagaaaggttttcctgtctgcctgtgccttggagtctgtttcatttccagatggaccatatgtaacacagccaccaggagcaagtctggggttagatgtcgccttttaaggcagtgctgttggatagaaaggactcttgagtagaaaccaggagatagacttaaaggcaagtttgtgtttgggcacatggcaactgagaagtgggatcagcagggctgctccccaagcaaaggtgcagaaggggtggggacgtgctaggggagtgggtggctaggtcagcagttctcaaactttttgggttccagacccctttatgctcttgattattgaggccctcagaacgctttagtttacctgggttatgtccattggtatttcttgtattagaagttaaaactgaaaaagtttattcatgaattcacttaaaagtaacaataagcctattatgtagtcacgtaacatatattctgaaaaataacttttctaagacaaaaatttgctgaaaagcctcacatttttaactctttgcagagctctttacggtctgccataatgaaagacagctgggttctcagagcttctacagtctgtggccatagcatgtcctgtgtagcctttgggcagctctactgtacactcatgaaagagtgagagaggaggcaaaggatgttttagtatttttattaaaatggttttgactcagggaccccaaaaagggcctcagggactcccacctttgcagaccactggtcgagcttaagttgggccatgggcttgaggagcatgccggcctctataggaggggcagtgcagttcactgttccaggctgcgccgctgccttggggcctgctcggctgtggctgtgtcagcttcccacagacggtgtcccctgacttccatttctgaagtctgtcatttgccccctcccagggaagtctcccacactcctcccctttgctccctggcatggtgctgagttcctttccctttgcaccacctttcgtgtcttcgtctccttgttggtattcccagaggctttgcgaactttgcatcagtggccttgcagaggctggtagacatcaggggcatccctgacctgcctccatagagagcagcagaatgtggggatggggagtggcccagttgggaggtgagccaattgcagtctgcagggtcccgggtgggcatggctgttctgagttctgggaccagcagtcctggcataattagcagaatcccttttccttccccaagtactcccaattaagacaataaattacgttgagcaccttactgatgaggctctgaagtaggtggcttattggcccagcttttcctggggtgggtggaggtggtagcctgcacccagccttgatgtctttgcacaggtaggaaagagtccttctggaggacagcccccaatctccgccagcttcctgacctcctgcgcagatggccaggctgggtgtgtgctgcaggagggtggtctgtggctggctcatctggaagtaaaggctgtagggctcttccttccatgtgtgcctcatgggcaatgtgctttggggccccaccgggtccctaagcccccacttgcagcctcccagggccgtggccccagctgcatggatgtggggcagaactgagtgctgtgctggtgaggaccagacccctacccctgggagcacatctcacttgggaacatgcccttcacctgtgtcaccctttaccttctggaatggcctgctaaactggggaggagtgtcccatgggccagggccagtgtggaaccaggtggccttggtgcctgttttgcttccactgcttcctggctctatttacttggacagaccactgagtctctgtgtgcctcggtttcctggggtataaaatggaggtcatgagagctcatatgccctaagccctggggtcagctccactgccagcggggaggagtgcagacctgccctcgtgctcccatagctgggatgtatgtcctccctgcagaatgcattcctggcagctggtgagcaggtgttctccctcggaggcttggcttcctcccgggacagggctctgggtcctgatgatgttgaaacacttgcgggggctgtagctccatctttagtatctgcacagtggctggctgtttgtggaagcctatattgaggaaggtagtttgggtccacaactgtgtggctgtagagcaatagaacagtattctccaggactcaaggccccatggacaacttttagtagttctagcacagtttggtcaacacaggacaagcctgtggcctcttgaggggtctgcagtggtgaccagtgttcgtcggccctggcaggcttgttctgaaagagaagcccccattctgagcatggtcagaggtgtgtgctgagaacccactgtgggtgaggcaggtgggcacagctccgccaagaagcttccctccccaagtgctgagattcagagccactgatcctcttgcagtccatctgggtggccacaggacacacaaggtcttggcaggggtgaggcttgagactggactttgctgtgtgctcacccctgacttttactgacttacatcagaatgtcccagaaaagacggacaaccttgaagtctcccatgatttacaagcttagaaagagggccagacggctgctacccaggtatcctttctctttggaattgaaatgcagagaacattattaaacagcctatttgctgtgagtgtggaagtgtttccacagacacctttttgggaaaaagaaaagggcaagaatcaacctgaaaactacagaggatatattagccacggtttgcacgcattctgcttatggatctttcagtgactccagtgaggggccatctgtcccatccagtgcctgagtgcagcccccacccccacctttggtccagagaagtctttgccccaagaatctgcccagagttggggcatcagcccctacaggtgtgggtccttcttcaggactgtgtggaacttttccttttgaagaactttcctggggatgaccactctgcttggagtctggggtggagcctggtgtgagggagccagcgtagggtttgggtgcctgccccaccctcagaagcaggagcccagcagcccttggactgaccggtgctgttctggggctcccactggctccttccactgtggagcactcccgtgaacactgctttggtttgagtaccagtacaagtgttgggtgtatgttcctgaccttgaggcattcttgattgtgcagttacctagggtatgcttgtgtctgacatgatcattttttttttttaataaaaaatggcatggaaggagtatgtgtatttttctactgtagattatgaaactgagaatcacagagatactgccttgccctgggccacacatcgagtaggtggtggagccaagacttgaattggccttctcgttcccaggccagtgtacattaaatacctggagctgtgaggtcctgttggtggacagtagagtgtaggggttccctaactacacctacttcttgttctgccaggaatgaccaagatctcccctattgaagccactctgccagggttatatcagaagtcctgcgtgctcggtcaggcaggcatcttcccctcccttaaataataactggtaagtgccatgtagtggcatttacattacaaaaatggtaaaatcaagcaaaagcccccaaacctgctgctgatcttggcagtccgcataatagctgttttctcatcaactctcaatctttgtccatccttacatgtgttataaacagaactgaccacgagccccttgggagatgtgtgtgcttcatgtttttatctgcagggccttgagtggtgccagcttcagggcagctgctggagaaattctgttgcacacttccagggggtgccgttcaccagcggacagagcagcggagccatgaaggcctgcgcaggacaggccagctgcgttgatagtgtgggcggtgccctggagggcatcttgaatccttgtcctcgctggtaattaatggccaggtagcgtgttagggagtagatgtatagtcactctcgaaactgtttctctgttgggtgttgagctcttcccacatcaggaatgagactgtttgcttctctctttgtgagttcttcaggcccaggctctggacatgggctcactgtatcaggagtgtggaagcatcgtggctcttgcatgtggccgtgtgctgctgtctgagtgccagctttgtccacaccctgtctcttgtccttggtggcatagtgcacacagtggcacaactggagacttggactcgagaaaggagaagtacaagttggattcagccatgtgcgggggcaggccctggcttgtgtctacttgcgcctcagtgctgatcgtccctcactcctgggtgctgaccagcgttgtcctagtgacctgggagctcaggtgtgggaggcagaggtgcagtgcagcctggcttgcccaggtcttggctgggagggccttccagcagcactcagagctgttagggagcagttaccttttcagctgggtgggggtgactaataagtgtacctgtagacttgtgtttatttatttggtcattggagcccaactttgtactgggtgcttcactggatgaggcaggattcttgtccccagcgaggagatgtggtgttgtgagagagaaggaatacatttggcctggagccggttagtgttcttgaaggaggtgtgggattttgaggggtctgtgtatgagacagtgaatctccttattccatggaatagaagatgtttgtgtatgggaggtgagggggcatgggaccatagagggccttctgggtggcaggatgtgatggggtgagaagagtgagacccacctgtctgcatcgactgtttgaggcctgccctctttggtgccggattgcgcaatatgtctgactacctttctccccacccactgcagtctaaggacaggtgagtccaaggggacaggaaacctgggttaaccaccgttagagatcttgtcaccgactgttcccttctcttggagccacaaacaggccacacggagtgagagccaagcatgttgtgtgggctggttgtgatggggtggctgtgtccagagacctgtgcacgtctgagacgcatcagtggtggcagcttgacaacactgggtatagtaggctgagatgtttctctgtcccttgcccctggccacccgcttggggcagttgggcaacccagagttgagacagctgggttcatcctggcatgcatcccagatttgcctggggagggtggtgaggggaagggacagaagaacccttgagagaagggatgtgggtggcctccagggaagtagttggagaggccagcagagcatacgcggtgcagctcagggccatggcaggcaggcgtcactgaagaaggcccgtggccataccctgtagacccctgaggactgactgcagaggccacagtggctgagttttgtttttcggttttttttgttttgtttttttttttttgagatggagtctatctctgttgcccaggctggggtgcagtggcgcaatctcggctcactgcaacctccgcttcctgggttgaagcgattctcctgcctcggcgtcccaagtagctgggactacaggtgcgtgccactgtttttccttttttattaaactacttacgttgagataatcgtgtttcccctgtggttgtaacaaataacagagatcccatgtacccctttgcccaggtcctccgatggtgaccttctgcaacactgtggtacggcaccacggctgggatactgactacaatgcagaaagcacccagtgtctccatcgccttctccctcccacatcaacccaaccccagccacccaggaatcctgctccatttccataaatctgacatttcaagaatgttatgtgaagaaaatcatacaacctggaacctttgagattggcttttttcacctagaattctctggctattcatccaggttgttgcttggatcagtagtttgctcctttttattgctgactcgcattccatggtaagaggggacacctaggctgtttccagttttggtctgctacgaacaaagctgctataaccattcacatgtagtttttgtgtgagtgtatgttttcattccctggaataaatatccaggagtgcagttcctaggttgtaggtagttgcatgtttagtttttttaaaaactgccaaactgtctcacaccagcagtgtatgagtgatagatatacttactttgtgacgttgccagcatttggtgttgtcaccatttgttttttttagccattataaaataagatgttcataaatagcatgaacacctcttcatgctatttatcttctgtagaaagtcttctcgtgtcttttgctcatattctaattggattgttttgtgttttcactattgagtttgagggtctttatatagtctaaatactagtatatagtctagatattagtcctttgcaaaaggacatttgcaaaatattttatcctacttcgtggcttatcttttcatcttccttaggactttgtgcagagcaaaagtttttaattttaatgaagtccagtttatccatttaaatatgtttcattttgtcttgttttttgtataacactactttctgtatcagcttgagatgatttttttttttttttttttgcctgtggacgaagggtcactctagcaccatttgttgaaagactgtatttcctccattgaattctttctgcacctttgtcaaaattgggcatatttgtgttggtttattactaactactgttccattgatccatgtgtctgactttccaccaataccacacagtcttcattactgtggatatataataagtcttgtgattgggtaaatagattataccctcttttttttttaaattaaaaatattctagttcatttgcctttccatgtaaattttagaataatcttgtccatatctataaaaagtcttgctgggattttgatgggaattgtgttaaactgaatatcagttgggtgagaatagacatcttagaatcttgcagtccacgaacacattatgtctctcttatttagatcttctttgatttctctcatcagtgttgtgtagtgttcagcatttcctgtacatattgtgtggtatatacacctaagtatttcttttttttgaagcaattttaagtggtattgtattttaattttgatgtccacgtgtccgttgctagcatatagagatacaattgatttttgtatgctgatcctgtatcctgaaactttgttgaactcactagttctaggagttttttgtagattctgggattttctatacagacagctatgtcatctgtgaatattttattttgtcagttttgatctatatgccttttatttccttttcctgccttactgcactagctagaaattcgcgcactatgttgaataagaattctgagatggccatcattgcctagttcctgatattagagggaaagcaatcagcatttccccattatgtgtaatgctagctggaggttatttagagatgcttttatgaaattgagcaagttcccctctattcctactttctgagaggtttttaaaaataattatgaatggatgttggattttgtcaaatgctttttctgcatcagttgataggaccatgtggcttttcttctgtagagcattaatttggtggattacattggttgatttttgaatattaaaccggcatccctggaataaacccccttggtcatggtttataattctataaatatattgctgaattctatttactaatattttgttgatttttgcatctatagcagtccccctttatttgcaagagatacattccaacagccccagtggattcctcaaaccacggatagtactgaacctgattgctttcagttggaactcatttttgattggaaacaacctagatatcccctcatgtcaaacccacagatacttttttcatcttttttttttttttttttttttttttttttttttttttttttttttgagacagtgtcttgccctgccctgttgcccaggccggagtgtagtggtaaaagcatagctcactgcaaccttgaattcctgggctcaagtgatcctcatgcctcagcctcccacgtagctgggcctctgccagcacttgccaccacacctagctattaataatttttttttggtagaaacagggtcttgtagttcccaggctggtctcaaactcctggcttcatgccatcctcctgcttcagcctcccaaatgctggaattacaggtgtgagccaccacacccagccataaatactttttctatcttacctgggcacttcatcacgcacaagggctgtaacatttgcagttcgaggtgtgatagaaaaattagcatgaatttctttttctttctcaatttcagcgatagaagatttattcttactgtacatcttagcaacctcagcatatgattttttttcttaaattgaaaacttttaccatttcccttaaaggaagcactttatggcttctctttggcatattcaaattgctgtcatcactactcttgtgctttggggccattatgtataatactagctggatgcacaagcactgcaacaccaccacagtccatctgataactgacagctactaagtgactaaggggcaggtagagtatacagcgtggatgcgctggacaaaggggaggctccacatcctgggaagatggagcaggacgatgcaagatttcatcacactactcagaatggcatgcagtttaaaacctgtaaattatttcaggaattttccatttaatattttaaggctgtggttgaccgtgggtaagggaaaccgtggaactgtggatggaggaggggggaactactgtgtattaatgaggaatattagtccatagttctttatttcatttttaaaaaattttggggttttgtcatgtaatttgtttggttttggtgtcagggtaacaccagcttcataaaatgaattggaaagtgtttcttcttcttcttcttcttccttttttttttttttttttttttttaacaattatatagaattagtgtcagttccttaaacacttgttagaaatctccagtaaaaccatctgggcttggagatttcttttttgtgagttatggaattacatattcaatttccttaatagttatataatcatttaaattatgtgttttttagagaagtgggtccatttcctatatgttgtcaaattagtgttggtagaattgtattagtattcctcattatccctttgatgtctgcagaatctgtgatgctatccctgttttatttctgataacaatttgtgccattatgtctttttttttcttttttggtcttgtcagcagtgtttttttgttttgttttttgttttttgagatgaagtttcgctcttgttgcccaggctggaatgcagtggagcgatctcggctcactgcaacctctgcctcccaggttcaagcgattctgctgcctcagcctccagagtagctgggattacaggcatgctccactacgcccggctaattttatatttttagtagagacggggtttcttcatgttggtcaggctggtctcgaactcctgacctcaggtgatctgcccacctcggcctcccaaagtgctggaattacaggcatgaaccaccgcgcctggctgaagttgatcagttttatcagtctgttcaaagaaccagctctttgtttcactgattttttcattgatttctacctttatctttttttttttttctttttgagacgaagtctcactctgttgcccatgctggagtgcagtgttacagtcttggctcactgcaacctccgcctcccggtttcaggcaattctcctgcctcagcctcctgagtagctgggactacaggtgtgtgccaccacacccagctaatttttgtatttttagtagagatggggtttcactgtgttggccaggctggtctcaaactcctgaccttgtgatctgcttgcctcggtctgtaatcccatagtgctgggattacaggtgtgagccactgcgcccagcccgatttctacttttatcttttattatttccttctttttcttgcttttgatatattttgtacttatttttctaggttcttgagatagaagcttagattatttatttgagacctttcctcttttctaatgtgagcatcatagttacgttagttccctcctaggactgctttaattgtgttattgagagggatgttgaagtctccaacaatatttgtggatttatttatttttccttttagttctattagttttaacttcacataattttgcagctctgatgtttaaaggtgcatgaacatttaggctcactatgtctcagtgaattgacccttttatcattatataatattcctctttgtctctggtcattttctttgtgctgaaatataatttatctgataacataacaactctgctctccttagattaatattttcaggatgtatcacttttagttttttcttttcaacctgcctgtcatcattatatttgcagtgaattttttgtagacagtgtacagttgaattattttaaaaatctactctatcaatcttttaattggtgtatttagatcatttacatttaaaatatttacggataacttagggcatagttaatgcgtctctggttattatttctgttttgttttgcttttttttttttcctgcttcctttgggttacttgaacattttctttagaattgtattttgatttatatatcaaaatatagttttttaagtgtatctctttgtatatattttttactggttataataagacgtgactttatatagacataacttgtcacagtctcttggtggtgtcattttaccagttcaagagagtacctgtctgttcactcctttaccttttccttgtataattgtcttaagtgtttacttcacatacgtttagaaccacattagacagtttttgctttagtcacgaaacagaaaactcaagagaaggaaagcctaattatttaccccctccctccctttattttactgtgttctttcttcctttcagatgttccaggattccttcttctatgatttcctttttgtttagaaaacttcctttggccattttgctaggggtaagtcagcaaaaaacttctcttagttttccttcatctgagaaggtctggatttccctttcattcctgaaggatatttttactggttataggattctaggttgacaggtgttttctttcagcaccagaaaagtagtgtgccacttccttctggtctccatggttcctgataagaaatctattgtcattctgcttagttttctcaaaactataaggtcttatttttctctggctgcttttgagattttttttctctggctttctttgtcttttaggtttttctttagtttagttattgtatgtcttggtctggatttctttgggtttatcctttgatgttcactaaacttcttgaatgtgtaggttgccacttttgccaaatttgggaggtttctagccattctttgagccctttttccgcttcacccttcctcctatcctgcagagactctgatgacatgaatgttagacttcttgttacagttccacagttcccttttatttattcattttttcctgtctgtttttcctctgttattagatgggatgatttctgttgttctgtgttccagttcactgattctttcattgcccccaatccttctgctcttaagcccacccgggagcttttatttcagttaccgtatttttcaatttcaggatttttgtttggttcttacagcttctatttctttgctgtctttccctttaattcaagtgtgctcataatttcttgttgaagcattttatcatgggtgctttaaaatctttaaatgtgggataattctagcatggctgtcatcttggtgttggcatttcttggttgtctttgttcattcagtttgtgaccttcctggttcttggtatgatgatgatttttggtggaaaccaagtgtttttgtattctgttgggtgactctgggtctcatttgaaccttctctttcagtggatttttctgacagtgcttccgtgggggaagggagtcaccatgaccacctggttacttagatggagacagaagtccatccctcggcctccactgatgcctgaactgggaggctcctcatcatgggttcccttcccactgggcaatggtaaaaaccctgaccctcctctgggcgccctctgacacaccctagcatggagcaagaagggtcctcgttgctgttggtgggatgtaaggcccttgtgtcttctgacaccaccctggccggggtgtggggcacctcacaagggtggaagtccaacctttgctcacttgggggtggggtgctgcctttcctgtgacttttggccagagtaaggcggttcttgtctaagagttttctgtcttgttgggctgctcctttctggttcttcagctatggaaagtagctttttgttgttgttttttttggttgtgtgcccattggcgttttcaggttgccagtttctccagtacccactctgggatagtgagacaaaaagaaagcctgggagagtcaccacggtgtccttccttggatcctgggtccctggcccacttacctttttttctccacctttcagagtcttctcatgtttgtcttatacatgatggccccaggtttttggttgtacttagcaggagaaatctacatctgccccatcgtccaggaagcagaagtttcaaggcactgtttttgaaagagcttcaggttgaaggcacacccagaccaccagcagcctcttcctagaggccagccagaagtggagcctccgacttgtgtgggtcatgagtgaaggccgagtttaattggagaggaggtagctcgggggagtctctcatgtggtcacttttatatgggatccggagccacatgcatcctctgggaggacctgcatagaaaggggccctgtgtgcagggctgcttgaaacaggactcgggccccatcctttgggtccttacagcccagctcagatcccccatgtcaacaacagatacctgcttctcctgcctccctccaaaatgcccagcagctcaaccagaaaacagcaaagctaagcctacccacgcagcatttccagagcacactccctcctgcctgctgccttttgggctgtctgttttagtgtcccagtttcagattattataggaccgtctggaagagaatactttagggccttttagaggtgctgccccaggaccaggtgggcgtgcgtgggagcctctgcccgtgggcattgctgcacttaaagacactgtggtctgctgtgcgggggaggatgcagcagttttagatagtctgagacatagagaagcagcagctcttcctgggaggcctttcccacgccttggggatgaggacaggttgtctgagtcaggacctaggttatgtaaggagaaggtaactcagagagggcaccacccacccactgctggcctaggccggtgggcactcacctccactccctctgcacacctgcctcaggatcaaggacacagccagggctaggcagaccccatccctgccttcctggagcgaaggttctggggtgggggtggggggcaagacatgtcatagcaatgtaattacgtacataatgaaatggtaggtagaaattagttctgtgatgtgcagtgacggtaatggcagaagtgagttgttagagactgagggggagggtcaggactgtccccttgaggaagggacatttcggggaagccctgagggatggtagagagggccaggttttggggagctgaggaggctgggggaggctgcgcagcccacgtggctggctgtgagaggcaagagtggtggtgatatagctggccagttcctgtccctggctccctggacttgaggagtgagttctcagtaattacagatggctcctcatggccccatggcgccatcattcctgcctctgcacctgtgcatcagctgcgcccctgcccagagagtcctctccaccccaggcctccccctgttatctatggggtccttaccttcagggcttttttttaatagctttattaagataaaattcacacgtcatacgtttaacccatttaaatgatacaattctatgatttttaggatattccaactgatgtgcagccatcatcacagtcacttttagaacattacatcatcgccaaaagaaaccctgcacctcttggctgtcaccaaccccttccgccgtcccagccccaggcagccactcctctgctctctatcactctggaattgctttgatgaacgctgggtggggtgtcacctgcatcccagcctgctcctccacccagaggccctacatctcgctctctgctctgtgtctgcgccgcccgcccacctgcatcagtcccctctgtggtgatccatatcaggaagtcacagccaagcaaagtggctgctgcaggctccctggtatacagcacccagggccatgcacacggggttcctgagcagaggtttgctgacgatgcctgggttgagaccagggctcgggttctgagggaacagatgctgatcccttggctccccacagttcctcctggagaaaggtcaggtaaatgtagctgattatgtgatgacaccccaagccctgcctccagaggccagggtggtggcgcatagtcaagatggagatagaggaatggcttggcaggctagcctctggcctcacaggtgggcacttgtggccggtgagaggccgagctgggagtcacagagtccagatacacacagggagttgtccagctccggctttcccatgcaaggcctctgggtggggtctgcttaggatgtgcactcctgggtggggtgtggagaggccgagcgtgtgtgcccaccttgaggtttgctgggcacagctggagttcgtagagagcacagacctctcctcgcctttgcttctgccttcccaggtgggatttccaccacatactccttggccctcctggactatgtctgcagccaacacccactcccctgttgcagcaaagcaagcctctcctgtccttgcagctttcccccgaccccaggcacacagctccacttgcaccattcatggggaaagccagtgctcctggggaccttgaggaccctgcaggcggaagccaagtaaaggggggttcttggttcagcctggaggctgtgtggcctctggcacgtggcctgccctctctgagtcacggtctgcagctaccaaatgaggtagtgtggtggggcctcctagtttggagagcactgaataaaaagcacatcaggaggacccatgaggggtcctgtgtgtgtaagcagcagtcagagaacttgggttttaatttgtgttaccgccctccgaaaggcactggataaatgggactggttgtaccttttccaatgcattctcgccagctgggtgtggctgaggaaggagattgagccagagtgtctgtctagattccccttgttgagctcctcccgtggtctggggagtggggactctgtggctggtaaaatatagcagtgcctcacatttgttgagacctcacaggccagacactgtgctcagtgttctttgtgcagctttttaagttgagctataattcacatatcttaagattcactctcttaaagtatacagtttggtgagttttagcatatttacaatgttgtgcaaccatctccactgtctaattctagaatattttagtcacccacgaaagaaaccccatacctgttagctgtctctccttatttcctttcctccagtccctggcgaccactaatctgctttctgtgctgtggatttgcctattctggaccatttgcataagtggaattctgtaatatgtgggcttttgtgcctggcttctttgacttagcatcatgttttcggggttcctcggtgttgtggtgtatgttagtgcttcattcctttttctggctgaataatgttcccttgtgtggacccatcacactttgttcatctattcatctgtccatggatatttgggctgttaccaccttttggcaggtgtgaataatactgctatgaacattcatgtgcaggtatttatttgagcccctgttttccgttttcttgggtgtgtatacataggggtgaaattgctgggccctagggtaactctgcctttaactttctgaggaactgccagacttttccaaggtggcagcaccgttttacatccctgtgctgggttttactgattgcattatctcatcagtcctcacatcagagtcatgaggtttaggtagaattgtcatcactctcacttttcaaatgggagagtttgaactcaaagagtttctgcacgcagtcacacagccagtcagttgatgattctttggccagagctggctttgatcacgaaagcagtctcttctccaggccctgttttgtatcttcaggatgaagctttttgactgtgttgttcatgtcctatttcctggcgcctggcacacactgacactcacatatttgttgaataacatgtcattttttcctgatcttggtggcttgatcagtaacttgcaggagacagcatgtcttaggggatcctgtactctccaggttctcacactcctgccagggcctgtatgctctccaccccggatgctgcagaatccccgccagcctctgactctcaagcagctgcagacgcaccgcagtggaaataggtgtcatgacctctgcagagcagaggcaacatctgtttccagcgagtgcttgctgttaacttgacctgttctctcttctgggttgaaggctgctggtgacctgccctcttttttctcctctaggcaaaacccatttatggcggttggctgctcctggctccagatgggaccgactttgacaacccagtgcaccggtctcgggtaagggcatcagagccaactctcagggaggaaccagagaagggacccatctaagggtgaactggcagagtggaagagggagatggagagttgaacagtggatcctgggatagcaggaccagcagggctcccccatttggtgcacttgtacgttgtacagaaaaggtctcaattatacatagttgtgtgtagtgctcccttcagaatgaggagctctcatgtgggtgttgcctgttttgtgggtcaggttgactctaggaacagtaaaatggaagaggcaaaagagcagttaaaggtttgcattataccgagcagctcccaattccttccatgccaaggcctgcccctgtagcacctcccttcttcctgagccaggggttcagcacactagcactagtgaagggttgggggcccagaggccttggcttacctcttactaaaatgtgcattgcccagggcagggccccgctagagctgggaccatcattggcctgacctgtggtttgtttctctgccaggaagcccctctggatttgactccggttacaaaactctccttcctcacaaactttcttacagtgctgccgcttgcaccctataaattgcttccactcagccccctccatccccgggagctccctttcctcttcttcttagtttctgctgctcatcctttccccaccctgaatattacactttggagtaggggccttgggctgtgtattctggtcccacaggccttgcattgtgtctctgttctttgggattgcttctagaatgggttttgatttcagaggctgcacataaggcccttggaaatgttcctgggaaacatgttcaggtggcctcctctacacacccagcatagaccagccctctacaaggcctctttgcaaggccctttgagtccctgttcatgccacccagacaggagaactcaggcatcactggtccagctgggctgcagtttccagggagtagttccctttcctattttatatcaaggttgtacaaaattgccatttccagcctctgacaggagtctttttataaatgataaccctggcccaaagcagagagatgtgcttttatagtcagttcacgtggcctcactgccagttaaactctgagtattgttgggctctttgctttttttttttttttttttttttgaaacagagtcttgctctgtcacccaggctggagtgcagtggcatgatctcgattcagtgcagtcttgacctcccaggttcatgtgatcctcttacctcagcctcctgagtagctggggctacaggcgtgcatcaccatgcctagctaatttttgtattttttgtagagacggggtttcaccatgctgcccaggctggattgggcttgttgaaatgttgaaaataggtcatggacccttgtgatgatttggggctgggagctgtgcctgtcattcatgacctgggccagcagactcgcattatggacaagtcccttctccccacacaaaggaagacatacaccgcatagtccatttcatttcagctcctgatggcatctgaccgccgtggacacttcccagtggtctggcttttggagggagagtagagcgggggatgatctgtgccagttggtcactccttggatattggagttatttccactggtcttgctgctcctctgttttgattttcattaactcatttcacctcagtgaattctggagcctggctgtttttgtgcctcctctttgccagtggatcatcagaacaaccccttttgtagcagtttcccaggttttttcagaagtggtgaatccatgccttggcattcctggattattccatgtcatgtcagatcattcatcaaataaatattgacacatgtcatgtgatgcattctatgctgagcaccatcaggaatacaaaaaggtaaccacacgttgtttctgctcctgaggagcttccaagtgttaaaaaaaaaaaaaaaaaaagacttcttattaagcctcaatcactcatgtgatttgggcctgtctcccagcccagtcctggctgatgaatcaacattcttgtgcctcgggtccctcttttcctgccacctgccccagaagtggaatctgtggagtgaccttccttagatatggacttgtcagacgtgggaactccagaagccaagctctggggccaggacccagatcctcctaaccacccaccttgtgctccgttgcagaaatggcagcgacggttcttcatcctttacgagcacggcctcttgcgctacgccctggatgagatggtaagtgttatccttgcccactccctgtccccagccttcaccaagtccctccattacagtgcccttgcgttgtcatgtgagagcacagcagccatgtgctcctgcttgtgtctgtttgggagtgtggaatgttttgaagaacttgtggcacctgctggagacagctttaaaaacccagacctttggtttgaaacatcatcttctgtggtcttgagtgagaggaagaagtgagggaggaagtcatttctgttgaaggctaatagtgtggacttcactggagcactcctggttaggggaaagcaagggcaaagtcctggatcacgtgtgcaggctgtggacctgtgggcgtggggcaggggctggccctggggctggcacatgtgctcacgcacctagtcctggggttgcctgtcaattctgcgactgtaattggttttgcttgtctcatttgagcttggcttagttttccgagctgacttcagaggcctcctggtcacaaggtcatcgttcttctggtcactaaaccaggcagacaggcttcttcctcctccccacctccctggttttccagttgcttcctgggctggatgagtgtttgctgctgttgccccagaggccaaacctgaaaatcaactaggtggaatttctggcttttctttttccacccattttatctcctgactttttctctaaaggagattagtctctcctaattaatctaaagtaggactgcattccaaactttgtaaagggttgaagatgcgagatttgatcgccttttccagttccacttggtgggtgaatgtttgtgtgcccatatgtgcagcattttaaaattgggactgtcctggaaagcctagtctcactatgtaaaataggcagcccctgcctatcctacccagagtttgtttctttgctgcaggggcgagacagactctggaagtatgagtggagataactgtccctagaggtaccttccagactgcggcagggggtggcgggggtgcctgggatttttgggtggtcattacagctcacatgtgcaaaggtcagaagtgggcgtgtttgtactcgagtcctaacctttgtgatgtgatatgttttctacttttgtttctggggtgaattaagaggatggtaccataatcctgtatcaactgtcacctcactggttcctacttaaaaagaattgtcttccttttcattctttccggtgagcatatttgtacatcatgattagagcatagggggtttttgctatgggaacgtctgtgctccagggtagtgtactggaggtgagcaccgattgtggacttggctggaagtaggagcagggagacaaagcatttggacactccgttcctttgaggcaagaaagcagacctggaggattagacttcacacttcgtgttctcctggcttagcccttacacagggagtagccctggggtcagagctgggctcctgcagctgtgaggtttatcttgcctccctgtggctgactgactggctgagtcctgcaattgacttaacagtatcagaggagcctcaagaggtcactggattacattcaggctgggctgggtcatgaaccatcccaaaaaaacaaagttccctgcactgtttccttggggactgataatttcagtcaggaaatctttctttaggtctaactaaagtccagcaaaatccattattccctctggctcagttgcacaagcacaaagagggtagcttctggggacgccttggtgctggcacaagtgcagagcacatgctgcctcccaggcacggcttctggataattgaggccgcttagccaggagcaccgacacttcacagtgcactgtggtctcccagcaacctggatatgagttgcgtattatttcatggagtgctcaggcagaggtgggactgtgccagggatgtggggaaagaaagaagtcccagggaaaacttggactgagagagggcatgggggcaggcccagagctgggagttttgggccacgggctgctttctggcagatgacctgggagctggagaaactgacccagtgagcccatcagtaaatactgctttgcccagccgaggctgtggaggggtttccctgttgtatcaggaaggtcacaggggaaggttgcaaggaggcacttagggtagaagccaggtgggaggaggcagaggctggagagatttctctagcacccagtgctctgcatcagggtttgctcctcagagccactccccagagtgagcagacagcctgtagcccaggagctccagcttaacggtcaaccgccctgagctgagagtcccaccccaaacaggctggcaggatcctgagacctggagcaggaaaactccatttcagataggcttatgtgtgggtaaactccagccaagctggaagcttcctttgtgagtgcctggaaatagaccagtggtcctcagcgtcatgcctcccagggccactggccatgtctggagtcatccttgattgtcacacctggggcaggaatgctgctggcatctagtgggtggaggccagggatgctactgaatctccttcacagaacagcccccagaacaaggaaggctccagcccaaaatgtcaacagtgccaaggccaagaaactgagcagtttcgacaggggtttatttaaattcttatttatttttaaaaatgaaaatgtaaatgtgatttgctattagctctgctcttaaacagcacgggactcacctgtcagatttcctggagtgagggggatgatggtgcagtgccagtcgtagaatggggtgggcctgtttctgatctagagaggtctacggggttcccctgcacaccaggcaaccacagggcctgcagaactgcttgtgtgtgtgtgtaccagggagcacataggtggcactccctacgtggtgccctcagaccgtgatgttgcaaagcaatccctacctgggcatttgtctccaaaagcagcagctctaagcagcccgtggctacctctgaccctcccaggctcatataataaactatagcattttatggctggtctgtgccctccacactcaatcagcatctatttcgaattgttactgacttatatgatgttaccatttgatttcatttgcttgagtgttatcttgccaactagactgacttcttgttgttgttgggcccgtgataattcttggtgtgtctccccattgtctagcatggggtttgggcggcacaaatctagccaggtgttctgtaaatatgtgtggagttgaactaccaactttgtaaatgccttgctgcgtaatttctgctcccagcttgaaaaccttaagacagggcgggtaggaaaagagagaagataggaaaaggggtgttcctcggagggagattagcaatgtagtgacctttagggattactcagcagaagggagaaaacctcccaagagctccagataactgggatggggaaaattcggttacctcagccccactgggttgggacctggagaggaaggtggacatcaggaggtcacagcgtgcaggagagggaggaaggcagcagcagtccctggatctggggacagtggcttcgggaagccctttctgctcggggacttctgctggggctggggctgctggacttcatccagttccggaagctgaccattgcctctccaggcagccctgagatggggctaactttggggaatctcttttccttttttgggaaatttctttctcgatacacccacgtaccctgtaactggtgggtgtggaggagaggcaaatttcccgaaaaaggaaaagaaatttctcaaatgcaggctgaggtgaggtggggtccgggcagcctcacagacaagtaaaagcctgagagatttggctgggcccctggtttttcaggagtggacaaagcaacaatctagaaacccagattgctgcctctgtcctctgcctttgtttctccacctgtaaagtgctgcccatgattttacctaattctgtcaccaagtttttggggactgatgtcgagctgaggtgtggatgtcaccagacatcactagaaggctcttgggaggagctccaggtctagaaggagagtgggagcgccaggagtttagggtggagcaggccaggccatgaggctttgggattctcaagggcctgctctccaaggcaaaaagctgatcaaatgctttttccaatttttttttttttttttttttttttttgagacggagtttcgctcttgttgcccaggctggagtgcaatggcgcagtctcggctcacagcaacctccgactcccaggttcaaaccattatcctgcctcagcctccggagtagctgggattacaggcatgggccaccatgcccagctaattttgtatttttagtagagatggggtttcttcatgctggacaggctggtcttgaactccagacctcaggtgatccgcccgcctcggcctcccaaagtgctgggattacaggcatgagccaccgtgcccggtctgttcgaatgtttttaactgtggtaagtacactggaaattcaccatcttaatcgtttttaagtgtgcagttcagtggcattaagtacattcacattgttgcacaaccaccaccaccggtctctctccaggacccttttcaacttgctaactgaactgtgcacccattgaactataactcccttccccagcccctggaaacccccatgctattctctgtctctatgaatttgactcctccagcacctcacataaatgggatcatgcagtgtttgtcctttgtgactggtgtatttcactcagcataaggtcctgaaagatcatcctggttggtgtcagaatttcctccctcctgattgtggtaggtctgatgatcttggaccatgtctgctgaccccaagcctctcacacatggaagccatggagagactgaggccaccttctgtggcaggcatggtgctgagggccggcctccatggtgtggagctctgctccatcctagcctggagagtccttgagcatcacgagagatgagagctgcctgactgtgtaggggctgtgctaaggactcataatctcagctcacatcctcggacatagtagagaaaacacttctagctcttggatatgtgcctttttcaggggcaacctgggagtttgtcagtcccgtaagatgtgaagttccagcctgagaaattaatttggggtgcctgtgtacttgtgtataaagtaaacaggcttggtccaaaggatcttcagagcactccaggtgcagacaggttaggattctggtttattttgagtttgcttcctataggagagtgtccaggaggttgccttgttcttgggacctctgctcacctcactcttgacaaatttctgcaatttttggtggtattaaagccatgagcagcccaacgttgcctaggcctgtgagagcctaggaggaggggcattaccgctgagccctgctgtctttaggatctatcatttgaggtttctctcccttttctgcagctgaccgcccagttcccattgctccctaagccatttttttgcagatgttgccctgcatcagaatctgcagggcgaggctgggaaaccagtttaaataaccactttgtgtgtttttttgttgttgtttttgtttttgtttgtttgtttgtttttgagatggagtctcactctgtcgccaggctggagtgcagtggcgtgatcttggctcactgcaacctccgtctcccgggttcaagtgattctcctgcttcagcctcccgagtagctggaactacaggcccgcgccaccatgcccggctaattttttgcatttttagtagaaacggtttcatcgtgttagccaggatggtctcgatctcctgacctcgtgatccgcccgcctcggcctcccagagtccatgtgatttctaaccactccatttgagaactgctgcttcaagctctgactttgtttcctctagctcggagctttcccaggcaggcgagaggaaccatctgctcctccttggtgctgaggcacctcccgggcatctgattctttgggaaccatagtggctgctgtgtccgtaacagagcggttgagaggacactaggccatggaaggcctcttctgtggtgaagctcatacctttcaggacccacatgaacatatgcagactaaatccctagcagaaccatgatgtgtaggctcttaaaggcggtgggtggttggggaggcagagaagtcttctgggaggagacaggtggcacttggctgccttttcgctcatcacagagattcgggaggagccatgtgcccggccggggctccttgctggcactttctgcccattctctatcctacttctcacaatggtagataccatgtccatttcacagttgaaaagactgaggcccagagagattgcgaggtggctcaactaatgagtgacagaccttgatgtgtaggcaaggcagactcctgctgagagagggatggtgtctttccttcaccaagtgatcttgtccttcacattcagagaggccgctccaccagcacctgctgcctcgtgcgggtggaaaatagggcttgctggaggccaggcagggctctcagtgtccttcctgaccctctggtttgtctgttgctgcagactgacccaactatagtagctgacctgtgtctttattaatgccattgaaccaagctagctgcaggcctgcaacgctgtagggtccacctgccttctttgctacatgggcatatgaatatatattcagagagatttacagaaatcagaacaataagaacatagagcctgtaactgtctgagaggcagagaagcttccttaggcctggaggcccttcatgtttaaaggacaggaaggggcaagacagggaaccggggaagatgttttatgggtcagtcttatactttcaggtttagctttaaatctgtcatgtttcagccttgccctggcctttgtgctgaggtcctggtcgcaagggaaaggaggcaggtcctgttgtgtggtgcgtggagcccaagtaccttagggagggcttgttggagtggggtcagtaactgtggggtcacccaggccctctctccctgtgtaggcacctcccgggctattcggaccacaggaagccctgtgttctttcctcctctgctcagctgctcatttctatttctgtgctgtgtgttttcagaatcagatcatttaaaaaaacaactttggactcgggtgtgttttcatctttacatgagccccacgagcaaggtatgaggggctgttaatgggggaggtagcccccgcaggccctccccatgcatcgcattcccgcggggtccctaggtgctttcagacttttggttgagagacttcggtctttaagtggaattctgcacggagtcttaatacaagttttaaaatgtatacagtcaggtgctgctttatttgaagttttggaatatttctgacccctccctcatcaacaacccctgcccctggcagctgcagaaaagaatacacactgacggctgggtgtggtggctcacgcctgtaatcccagcactttgggaggccgaggcgagcagatcacgaggtcaggagatcgagaccatctagctaacacggtgaaaccccatctctactaaaaatacaaaaaaattagccaggcatggtggcgggtgcctgtactcccagctactctggaggctgaggcaggagaatggcatgatcccgggaggcagagcttgcagtgagctgagatcacgccactgcactccagcctgggcagcagagtgagactctgtctcaaaacaaaaaggaatacacactgaccagaccggaccaacctccttctctgcggaattatccaggtgcccagaggcccagatcacagacctgttcaggaaaggcacctcttcttgtgcaatcatttgataatttttccaaatgaataaatttattttttaaagatttcccaaagtagtcaatgtcttcaagctctttgccagtggtgactggtgaatgagcagtgcccatgtttataggtgaactctcaggcacacggaggcttgtgttcacaaggagaagcggctgggtccggagcacagtccattggctttcagggctggcatggccacgagattccagaaattgaagacaagccaagggtgttgagaaggttcttccagggtgttgaggattttttacccctgccctccacccgacttgacttttcaggacacagagccttagatgagtccccatcccgtcttgatttggtcatgacaattgagatgttgcctatttgtaacaatgaattccttaatgaaggaaggtagattcttggctggaagatgaggtctgaaccagtgcggtggagtctgtgcgatgctcttttcagcagcagggagttggtgggataataagtggggcagggagggccctgctcgactgagcttcctgtaggccactttgccttagagcatctgtggccagatttaagttattttgaaacactaaaggtgagtgagccaggtctgggtgcaggtgaacccaggtaggatggaaacgcttcctaagtgctgtgaaagtagagggtaggggtcataagggaagctcagagctgtttgctgacaagtgacacccactttttttccctgaagtgtaatttacggtgactcatgaaagttcacccatttgagtggagcacgtagaggtcggagcattctctgtacctccgtgggagcttcaagatggatgttctctggaaactggaggctgagctttaagccccctcccttccttttgtcatagttgggaggttgggggagaagagctaatgacaggtccgggaagggcttgggacccagtcttataagtctcttggacccggaactgttaggcaggggcaggttctgcctttgggagctttcttgttgtttgcacctctgcccagaggcccaagtgacatttcccacactgaaagaatcagggaatggaagccagcaaaggttaatcatgggactgtgtggaccaaaaacagccaactcctgagggtgacagttgggggttcccactgtgacctgatccagaccttccattttgtagtgaggaagcttagctagggggagggggagggagtgactgaaccacagatgtggacaagcagccgggtccctggatctcctgtcccgacttagagcctgggagttgcccttcagggaaggaaagagggagagggaagtgtgtggggcagtttgaatgttctgtgcctccagtattagatgttctgtacctccagtgttggagtcatacgtggatggctgagccctgtagagggaagaagttggagcagaacgtgccagagtgagcaggcaaagaggatcagaggaagggacctctgcaggtactgagagggctctgcaggtcaccctgggtcattctggagagccaagagaagacacaggttggccctggccagacgcgagtcctccctgtgttcctaacccgaggacacctgtcagagcatgcggagcaccttgcccttaacttccacgaggatctccctctacaggacggtgagcgcctctaggcagcactggtgtctgcctgcgtagacagggcacatgttggttggctggcgaatcaggcagctgtcctccccagctctttcttgcttgagtttctgatgtaaagatttcaggtaggccactcccaaaagtcccccttctttgaatctcaggccgcactgagaggatttggtgacctcaggtgcccagtgagtgcctttctgtctcatcaggactgtcccgtgcgcttaccttcctgttacataagtggtgagtcaaggacacaaaatgggaattagctgccagcctgtgttcagggctataatgagatacccacattctctctctgccttccctgtgttgcctgagtggagtgactgctggccacccacaattgattatcaaggggctgaagaggggttccacctggttatccacttaggtgctctctgttcagacttttgccatgtgcacagctctttcagtgatggaaggtgatgggagcggcgagagctgtcgtgagggtaaaggggtttctgtggcccacaccccgcactggggaggcagccaggaagatgggctgtgattggcacccttgctggtctatcttcagagctgtgggtggacttctctgcagcagctgtgacggtaccctgcagcgtgaaggctcgtgataacgtactgggcgtctccctcccacacagagagaaatgactttagatattaagaaagtgaaaagcttggaatagttggttaggaaactaattaagtaagagcggggaaagaagtgtcaaaaaaagtcatttcatgggaggtgcaacagaaaatatttagggttgaaaaagcaaagccacatggctggtgctagtgtcttcacgtgtttgtgcagtgctcacacacttgcacaaacagggctggcagcatggagccagactgcaaagtcccccaggggcacatcccttccactctcaccttttaggcttcccttgctctgccccctgctgagatccccacctgcctggccatgtcttttgcctggggcattcctggaaaatatatcatgtccaaaaacagtctgatgagctgatccacgtagggcaccacttctggcaggcaatgtagtatgttagtgtcttagcctctcctggcctctgcaagactgtttttcagaaaaatcttttctttggccgggaaggaaatgttctttatggtggggaaaactctctgaacccggggagcagttgcactggtgggatctcagagatgcaggtcagcagcacagggaccttaggaaggaggtgtccttcaccttatgccatgtactggcctgagggctggtccagcccacacacaggcacggaccagtcacttgcaaacacctgccctcagtgtgtcagaatcgaactccagggtggcttcctttgtgggaggtgccagtcacagcacacaacatggcaggtgtgtttgtttcctgtggccactgtaacaagttgccacaaacttagtggcttaaaacaacacatctttgttctctgatggctctggaggttgagagtccaaaatgagtaccacttagctaaggtccagatgtgagcagggcagcttccttctgaggtcccgggggagaatcccctctccactgtttgcaggctccagtggccacctgccttccttggctcgtggcctcttcctgtcaccactacagtctcttgctcctgtcatcacatttccttatcctctttgtcacattttcctctgcctccctcttagatcagaatctggatgactttttctttcattttttattttttagagattgggtttttttttgtcacctatcctggagtgcagtggcgcagtcatagctcactgcagccttgagctcctgggcccaagtgatcttcctacctgagcctttcgagtatctgggattacagatgctccggtgttgagctctggggagttcagcagggctaagtaggacttgtgggggtgctgctaggtgtgaggtgtaggcgtgagaaacggggaaaggaagatggggccaccagagactgccctgatggatgacatagtcaccacctaggtatcagcatcaccccacttccagagcatttgtgttttcagtgtgaagcaggatcagggaatgtcattgctggaaaggacctggaagagccagccccgtcctcagttgggggcgatggagaagtggcttttgctccggttggggcagtgtggagcctggcactgcagagctttgaaggtttccctgactcaagtcagcgtggaagctgagcccctcaatgtgtagagcgcagcagacacgacgcctggcctcctgttcactgattcaaccccagggggaggtggggagacggaaaagactccttgtccttgagcagggtcgtcttgttggtgagactggttttgtgtttctcacgtgtgaggtgcagacaggcatggtgttgcagaccaagaccttggggcacgaaggtgaaggaacagggacagagcaggtggaggaggagagagactccctggagccacaaggctctgaaggactgtgcagtcccagctgtgacctacctccaaccagccgcactaaggcaggcttgtcccgcaggggcagaagggtcttacggccccaacccgtcccctgtcctcatgtagctaatgcttgcttttgggcttctgtctgttcctctgcctcgatggaagggtggtagatgggctgctccacaaagtctaataagcagtgagtcattgtcttcctctgagcccaccagggttgcacctggtggctggggaatgctttgtgatgcccagggcccagctgagaagcagtggtgttggggttcatcagtggtgttggccgtctgtctgcagggtgcagtggctgtcttggggcaaaagtccaaggctcacttcctctggacactgagtacagtttttggaaccagcaagcgtctgtgatcagtgtagaggtaaaaagaaatcacacacaaaccacagtgctagcgtcctcactgtgtttgcatttaatcctgaaaatggtcgcatgaggagagcagtaacttgcccaaaatcagggtttttctgggcgatctgggggttttgcgttgagccacaggttggagacctggtgggtggagctactctggctccattcccattctgtgagctggggcccagacacgccctagcctgaaggttttggagccttacctggttaatgtttgaagatctcggctatgccaggataaactggagcaggtatttacacctctgccaagtgatgggccctaacgctgtcaggtggccaatacctgtggagcgtgccggccacaggggaacacagggccaggagtcctcttggcttcatcccccaagacagctgaggtttgaagatctcgggggcggttggggagggggtggggtttgacttgcacctggatatggaggacatgcttgcctggccctgacttccagtgggttttcagcaagagacccaccgaggacgaccatatattctggtcccagcagcggacccagaggccgttctagctgtatctgaaggggccatgagaacggtaggtgtggggtggtctgggaaggagggtctttggggacatcatctagtccagccctcacctttgacagatgaggaaactgagacccagggggcaggcagggtccccactatcactcccagtaggcttcagagacagatgccgcttgctccgtgcagcatccctccctgcccggattggtgtgaacagggcagttgtcagcgagcagtgagcgaccaagagagacactcctcaaggctcagcccagcagatgctctcgtgcgtattaggtgctgggtgactgggggctgaatggaatgtgttgtccagggtcatgcggctggttgtcccagaaccatggctggacagccgacccttttccagtgcccttttcactacatcacatcccttgcggtcctcccggccctgcttaaagaggcagggttggtgcggctctccctcaggaaaaaccgagggtgcaaagaatggggagggtgagaggctgtgatgagagacatggacttgcagtgggagaggtgggatgtgtgttgcaagaacgccttgggtttcttgtttcttggggcctccattccgagatggagaagagaatactatttgtgctccacgagaaaagattaggaaaacagccccactccagtggacctggcagcattctatataaacatcgacatctgggagagaggtccagttgaatattgttgcaaatggacttgtgctctttttgggtgatgctatggcgacccacactagaggagggtgctggagcccagcgtcaggccagggccctctgtgggaacaaccccttaactccctgggccctgcctggcttgctttgtttgactgcctgtaccatcttgtcgcttcttccaccatattccccatggcatcctctccccactccaaagatgggtggtgtaagccctacaaagtggggcagatggctagagccacaggtgtcagcctcattcacatcatccatgtggccagacttcagcttcctctttctcatggtctgaggcgtgttatagtcgtgttaaatgtccagcgctagaattttagggaaggggagtggctgtgaatatatgtcaggtgcacactgtttggtcatctgcttgacttgtgctaggcactgtgatgtgcagaatatgtcattgtgacagctgcgtcctcgagggtcaggttaggtaggtggacacttctaatctttagcccctcccttcttagtagagtgggagtgggggacggagaggccagagcccagttggtgggaattcccgaaggcttccctcatccttttctttctccttgcttgcttctattcacgttttctgtctcctgcagcccatgggatcagaccctgcgctgagctccttcactgtgtgtctgttgctgaagtaaatgcaagccctgtcctttccagagcaggaaaggggagtaaagttttcctcctggggtcatttcacccttgttctctatctctctctctctctgtctcctacagagactctgcagggaaacacaggtgtaggtaatgtcaaaggacatccaacttgtgttctaggaccacagcctcgcccttctgtcgtggcccccactgggtgaggagagcgccccggccacaccaggggtcagttgtcgatggaaaggaatagacgtgcaagtgtgcatttactgtttgttctgtcacttaccagccatttgagaagtcctgggtgctgtgaggtggactgtgcagtaatttgaagggtggggaggggtaagagggctgttgcatagaagtctagccttagagtaacacatttgaattttggataaacgggtggcaacggccatgctggtttccttcatatattgttagccttttcctggctgggaaaaaagcatttgcctaattttagaacacatcagtcatttggttgaaacatcctatttcccccaaagtcaagtgtttgaattgtaacaactttggaggcttggaaaggatcttcgcatagtccctgcatgaactctcctgcattggatgccctgtctgaggagtttgacctaggagttagggaaacaatctttatttccaatgaagaattttatgtataaacacacctaaagagaagtgtaaaatgcttgacctgaggaccttgggagcagtctctcagacccttaaaacttattctgtattctcattggtgtgatagtggggcagtagtttgttgttgttattttttccggggcagggggattacataagatttacccatttctctccctatcatgcaatagttacccttggatcttactgtgctccctgatatatgtgaaggttgaaaatgggccagatgggaattttaaaggcaatgaggggctttaattgttttttcaaaatagtgtatgtacagtagttcaaaaagtcagatatgtaaccacaaagcttatactaaaagagttttctgctccatttcttcttactcctgagtcctgttcccagaggaagccatttcagctcttctagccagaatactccggtgcctacctctgtgtttgtaaataactggtttttactgctacttcttgagttttagaagatattatctattggttttatacaccacagataggatttagctctttcatcggcctggctccttgctcctacccagctacccttgtttttcctggtaatgttactcacagagctggccgtcctcacgttccagactgactctggctgtcctctggacctgctgcatagctctccatctgggcttgaccttccccatcatcctgggaagcctctctctctttctctctctctcttccaccttctcccccacctgtttttttgtttgttcgtttttgtttttgtggggttttttttggtttgttttttggtttttggtttacttcacttggtgaaacctcttgagaaatgcacagggaggaaaggttttgtggccttgcctgtctcaggatgcctgtcctgtgcacactcttgaccaggagctggactggctgtagaatgttagatgggacctaattttccttggaattttgaaggtggtgttcattttttaactttatcattggtattgagaagttcatatgcaagggtctgattcctgatcctttgcaaataaactgaattttccttccgaaaactttcaggagcttctctttatcccttgagttctaaaatttcatgaagatatgccttggtgtggatttgttttgttttattaagctagaggcttgtgtatatttcagtgtgggaagttctgaccttctagtccagagtgtgtcttatattttcttcctctggtaatttctttcttttttaactcatccctctcctctcttcactgtctttttttttttttttaatggagtctcgctctgtcacccaggtacagtagcacaatgttggctcactgcaacctccgcctcccaggttcaaatgattctcctgcttcagcctcccaggtagctgggactacaggtatgtgccaccatgcctggctaattttggtatttttggtagagatgggggtatcgccatgtttcccaggccagcctcaagctcctggactcaagcaatctgcccaccttggcctcccaaagtgctgtgattacaggagtgagccactgtgcccatcctggtaatttttttttaaaatttttcctggtctttacttctgaaactcctgttatttggctattactccttctgactcgattctctaagtttattgtctttttctgtggcttcgttttgcctgagatcacattaaccttgccttctaacccttctgttggggtctgattccacctattgaattgttaatttcttagagcttgttttttgttttccgtgtgtcctcttttgtagcatcctgtttgtgtttcatgggtgcagtactttctctaatcatttcagttattttgaagttgtattctgtctctggtctgactttcattctcctagttccctttctgtttgttatggtcttgggctttctcgaatgagtggcgacccttcagaaggaggctgtgtgtgtatatggggtgcgtgtaggaatatcgactggcaggctttgccttagaaggacaggcaggcagggcaccagtttgttttgggagagaccctagaatgtccgcacgtacgagccctctcgtctccattacatggagaatgacagttttaggaggtctttctcttgggcttgttggtttcccctgataggaattctctcatctccaatctaggaagacctgtgggcagcagaagggcttgggatgagggactcaacttttaggatgcagactttcttggacttttcctgctgttagtccttcacccctacttcccctgccccctcagctgtgcctgctgcccctgactctaggggccctcctagggcaaccctccgtgctggtcagtatataggattctctggccagagccaagccctgggatctgcctgcccttgtacgggtgctgatcagttctcctgctctcagccctgcccctgctgttggagtcccctctgcccccaggccctgagctttctggtgtctgcagcagtgccagcctgcctcctcctagctgtcctcaggaagcttcttccatgccaccaggccactttccatgtatccagccacttcccactcaaagtttacttgatatcttatatctgctcttgtctcctctccagcttttcatccttgagagtttatacctcccccccacacacactttatggtcatattaattagggttttagcaggcaattgaacattctggtgtgttaagtcacctgtgtttaactggaggcccctctgtgtgtcaggaactggcccgcagcctgtcgacacgtgttggtgtccatcatgggcatatcgtgcctgccttgtacccacctgtttccatgccactgttccctgtcctttcccacactgtcccctgtgtgggtcatattgttggtctgggcctgtgtagctctttgtgcttggcagggtgtgtgtgtgtgcagggtgtgtgtgtgtgtgtgtgtgtgtgtgtgtgtgtgtgtgtgtgtgtgtgtgtgtctcagagtcaatgcacatgcctgccaggggacctgtgtgtgttggcatcctgcattaaatgtaccatctataatttgctccagtaccttggagaaaattttatgaggaaaagatactttcataaatagttgaaattccagattcttctggttggaaacccaagggttaatgatgactgttgttccagaaaggttggagggagaggagacagtttatctcatttccctctggtgaataaggccatttactgatggggcccaatcacctacctgggactaacaataagacccttgttgttgactgggcaggttccacagctgatactccggctgccttgagcaataccatcaggcagatctggggctcagccctgtccttacccagggcctcagagcactaatatattttccttttcctcactccagatgtcttcccagtgactctccttggggcctggggaaaccacaagggagcttggattcattcacccattgctgccttgctgtgtgcctcagaggggctcagaggtggaaaataaatatgaaaaagcatccttgtcttctagaatctcgtcggctgctgggaagaccaaggggccagccatcgcagggagcataagcactgagacaggcacacgtgcctgcccggctatcgtagccaggctggcagccttgcaactccctggggaagaacaatctaggaacattctggggtgtggagcaggaagggagtgtcacatgcaaaaggcaggatcagccaaagcagaggggctgaagaagcagtgattcccccacctaatgtcagaagtaaaatcagttcatggtgaaaatttggggaaacaaaatcatgcagcaaaattgcctattaaaccccacacggaggtaaaaatcggttcatattgtggttatgtatctattctcttatgatgtgtatttatgtgcttatgtaagacctaaaaacaataatttttaaataaaccagttatttttaataagaatattctggccaggcatggtggttcatgcctgtaatcccaacactgtggtaggccaaggtgggcggatcgcttgaagccaggggttccaggctgcggtgagctaggattgcactactgcactccagcctgagtgacagagggagaccctgtctcttaaaaaaacaaaacaaattctatctcacaattcctttcctatccttctatgcatggtctttaatagctacaccccattccattgggtggctgtatttgattcctttattctgtactttcggacatccaagttgttttcagatttttacttttttaatatgatgcttcagagaacattcctggaagtaatgttgccagtgcagaggtgcaagcatgtttgagacagctgatagttacctctgtccagaactggctcactcccaacagcagcaggaggcacccagggtctctcactttcctttcaattttcctttctccacatcctacccccagatttgtctgacttttccagaggctattgagagaagctttttgagtgaggcaccacacagatgtttaagactaagtttgtggtctttgagaaccgaggtagcctgacccattggaagcctgcagataattgaaaaaatcttattttagatcctgtgtcattcttctgctatcaaaccagagccagcagcaaaggaagctgggggtgatgggccttcatccacctgccatgttgcctccctgcgctgcttctgccaagagtgggctgctgggggtgtcctgctggggccaggcaccagggttccaatgccaagtagtggcattcacgcaccttttgataagcgaggaaaccgctggcagcaggaagaaaggtaaagcagctccagggagctcagcgctcagcctcaacctctttccccagaacctgcgcctgcccactccacctccaaggcccctcactctccaccacccatttggccttttggaattgggactggaattgtttccagctccagaaggcccctgcctgcctaattcccatgtctctaaaaatatctgcaagcctcttcccacccaggcctgtccccacagagcccacttctctcccccgaccctcggctaggggaggaaatgagatctccctctcttgacaggattagaacggaataaatacgaaaggctgagtttccagagttgaaagggtagggctgcctttgtcgggtccggagggctggcgtggcatcggtgcaggcccacactcggaggagggaatccaggagaaagaaggaaggggaaaagagcaagaacccctttctcccctctgcatatgggatggccaagagaagccaggccctgctgtgggtccccggtgggaaagaagctggctcccagggctcccaagccccagccacgcctggtcagcacaggcaaaaggagtctgtgggaagcctccaacctccaggctgcctgaggcccctggagctttctcaggcattcctagattgggacagagcctcagacccctccctgccccaccccccagcattggatgcctgcctaatagaggctttatttatctccacattttcccagctctgtataaagagacaagcacgtgggtgaggcctacagatattccaaaagcagggggtagtggggtgggggatgaagaatacgcaaggatctgcttccaccatcccctagaggggctttggagggaggagggtgggctagggcaaagggtcgatgtgcaaaaggcttcttttctttcattttcccctactcagaaacccaaaaatagccatgtcaaaggcacatacattgcaaatagcagccgagaagagccagctgaaagccatttgcttctccctccctcctccctggacacactccccgtcctctgcagtccccttctttccaggctcttgctgggccaaccagtcctgcagccttgtagggtccagcacctccctatagggttactgagttgcatctaaattcacttaataggcggtcacagctttttgtgaaaacccatgaggaaatgtgaaaagtcctcctttggttcacttttcttgcaactttgaattttcctactaagagtccttaaagtgaagcaaacctgtagctaaaatgtagacaagagccaggcacagtgactcaggaggccaaagtgggagagtcagttgaggccaggagttcaagaccagcctgggcaacatagcaagaccgctgtctctacaaaaattttgaaaattagctggatgtggtggtgcatacctatagtcctagctacttgggaggctgaggccagaggatcgcttgagcctgggagttggaggctgcagtgagccttgattgcaccactgcagtctagcctgggagacagacagggagaccccatctcttttttaaaaaaaatgtagacaataaaaaatatataaagattggatttgatctcaagtcaagaggagtggtcatatgcaagagagtagatgccatgaaaatggtctgctgtcccaagtgtttttcccaattataaaactaacatatgtcttgtacaaattttgtaaaaattatacattttgtgaaaataggtaagcacaaagatcaaaagatgttttccaggaagaatcagatgggacatctccacctgatgtcactcgtggcaggcaaggggacacttatccttgtgtggtggtctcctcctgggatggcgctgggtggggaggcccaccttttggaggtcctttggtggctctgaccaggctccaccctgcactatagctgtcctggacggcgggttgaatagaagggtacagatttagaattgacttggaaacacgttaatttggaagcctaccttccccattccaaagagattctgacttgagatccaaggtttccagagcgcctcaatgcccttcctgaatcaccaagttcagtctggcttggagagcatggcacggctgacccagtgagtccagggtacagaggccagactcacagctcatttcaagctgggctttttcccccttgtcgaaccagtcaaaacaaacgaaattggattagtctgtcttcaagcactttgtcagaaaatacatgaattggtgtgtgtgtgtgtgtatttcagttctgccatctgttggctcaggggtccccagtgcccaggcaggtccatggcttattaggaactgggctgcacagcaggaggtgagtggcaggcgagctagcattactgcctgagctccacctctttcagcattagattttcataggagcgtgaagccagttctgaactgcacatgcaaggggtctaggttgtgtgctccttatgagagtctaatgcctgatgatctgttactgtctcccatcaccctcagatggcaccatctagttgcaggaaaacaagctcagggctcccactgattgattctacattatggtgagtatgtaataataatagaaataaagtgcacagtaaatgtaatgcgcttaaataatcctgaaaccatccatccattccctgtggccctggaaaaactgccttccacaaaagtggtccttggtaccaaaaagtttggggaccactgcattagctaaccttgaacagttttgcaatctcactaaacctaaatttcctcatctgtagaatggggagaataagaacagttttttaggatgactgtggatttaaaccagaactcagtggagcgctatatcctgtcttctctgccacccttctgcttcactcagggaatttatcttaagagttggggagaaggcaggggaaccttctgccatgtcctgctatgcttgtgtggccctctgagcaagggagagccttgcttcaccctcaataaagtatcttcctggtctcaggcccagtgacacctgccaactggttaagaagcagagtttaacatttcagtaatgttatatccggatattaagaaagaaaaggccgggcctggtggcccacacctgtaatcccagcactttgggatgccaaggcaggtggatcacctgaggtcaggagttcgagaccagcctggccaacaggatgaaaccccatctctactaaaaaatacaaaaattagccagacatggtggcaggcgcctgtaatcccagccactcaggctgaggctgaggcaggagaatcgcttgaactcgggaggcagaggttgcagtgagctgagattgcaccactgcactccagcctgggcaacaagagtgaaactccatctcaaaaaaaattttttttaaacaacaacaacaaaaaaaatatatatatagttacttcaaagaaaaaccttcagcaacattaaacagtagtgtagacagcagtgaggacttcagttgtgtatatattttcctgcctggggaattgtttcctgagggtagagttctagaaatagaatggaaaaggcccgtagggtaggtactgctatggctcctgtggcaggtttgcagactgctcaggcagctgcagttcaagtgccctttccaggccatgggctgccttcaagccatgcccagaaagcctgcctgccttggctctacatcctgatgtccaggaggtcaggcttggcctaaaagagggctggcttacccttggctcaaatgtcacccgcagggagctgggggctgaggaagaggaaacgtccaggtgggtgtagtcctctggcttctaggctttcctttcctatcttcatttttttttttaattttttttattttttaaaaatagagacaggatctccctatgttgcccaggctggtcccaaactcctggactcaagcaatcctcctgcctcggcctcccaaaacgctggaattacaggcatgagccaccgcacccagcctcccttcctgtctttatgggccactcctgtctgcgttacccatagtcaaggccaggccttgggccaggaagggggctataccatcagctccccaagtgtacaaggcccttgcctctcctttggcctacatgagcacctgccttgtactctatgttgtgccaggcattgtgggagatgccaagaaagccaatccctctgctgccccttcagtgctgagacacctgggcctccaaagggctggtgcagtgcggagctgtcaggctttcttctctgccaggtcattgtgatggggcaggtgatcgtcagggcacgtgtggagtgtgcgagcaggtccacccatgactagtggagcagccttggctaagccactttctcacctgtgcagtggtgacagccccctcctcagggtcattaaggaggtagtgagatggccatgtctcatgtcccatgcgcttggtatacacacccccaagagaggccaggcctgggctgacacaggtacccctcactctgtggcccaggtggcatctgctggcagcacacccaccctccctgtcttctgcagttccagcccagctagtggacacctgtccacagaggactctgaaggaaacatctgaaaggttagggccctgctgggcaacgttgaggtcgacactgtggacaggcagctccatgtaattcttcttcctgcccttacccagccaaacctgcacccttctgggggtggacctctgtttgtcccgtttgtaaccacttctgtctggcatgggctccaagagttgatgctgcatgcaggcctcatgtactttgacacaagtgtgagagtgctgggggttggaagactcatgtgtgccagcctccaggtacagctagcctgtttcctccatgccaaggccttgtctcccttgaggcagagtggtgtggtggagcgagtactggactaagtcagaaggcccaggcagttcaggcagccacagattaagtcacttccactctggccatggggtctttgtaagatgaggaggttatgtcagatgcgctctggtgaaagtatggaaaaaagcattggtgacgtgtggagctaaggaggtcaggcttgtcaccaggagctggccctgtccccagccatgtgtccccatcagcactgctgggaaagcagctcagaccccagggccggcagccgtgagggtatcttgcagtggctctttgggagcagcggctgctatttttagtaagctgcctaattggaggtcctggtggagcttaaccagctcaccttgtgctttgatccttctgtttggccttctctttttacgtggaaagagctgaagttcatgccctgaccaaagcagatttgtttttgcaggagacggaggcttttgctgttaaaaaaaactgccccttcccaggcccctgctctgtctcttaagtaatttccagtgggttgtcagcattgatgttggttccttcctaataagatctcccccttttatctgctatatcaggacatcaggggtgggggctgaaaagagtattgaaaaagatggaagcattactctctgcaggaaaacagattggttttaaaaatgctgtcctacatcctgcctcagatgatggcccttcgcacatgatttctctcacttttgatgccctcactttattttaagccgaagaaccaaaccttcgagtaaagcctctttgttcctttttagcagtgagatatctcctaggatgggagaccaggtgttttctcgggaacagtcatcatttagctttttcccaaaggaaaggaactctgtgtgtccctggtggctctgggaatggcgtgtgagcccatttcctcaggataaaactaagatggtaatgaataatgtctgtttgatttgtgtcagatattcatgtgacacagacactaagtgctcgtaaacactctcagttaattcttgtgacagcctttagggaataggcctcatgcttacctccattatacagatgaggaaaactgaggcctagagagtctgagtcgtcccactgctatgtgaccatgtgcctgcaccatctaacatggtgccagcgctcctgatgtgtggacgtgagtgtctgttttctggatgtgcatacagcagtgtaccaggctgcatgaccgtggggtgctgctgcatagaacctttggccatgagcgagtttttggtgaactaacagaattcattgtccccttcctggtagagaattgcttctgtgtcctgaggagatgtggcatgaagggtgggcaaggattgttcctgccagctgggtggccgtgtctttcatccttccttcctcccgaccagtccacggctgtgttcaagcctggtggggagccgtgaaggcagaaccgtttctccgtccttccttttgtccctgtcaccttcccctggctgctagcagagtacctgtcctgtgtcacagagagacagagccccaattgttttctttccgctgcgtctgctccttgcctccccctcagccacccacgaggtctcagtgctgtgccagctagcttgctgcagggagccgctgcctcccttcggagcacccacgcttccagtctcccttccatctttcataaaagcatgggcctgtggctcagtggtatgggccaccagctttgtccttaagacccctcttcattatttccctgagcccactctggggcccagtgtgggcacttgttcaggtttctctgttgggattcttcttggtttagggagggtggttggcatgtggtggagttgagaggggccttgttgcttccaggtgctttggtagagtggtcccaggtatccactgggcgtgtttgctgctttctcctgtcttccctgtcacagtccactttagggttatataaaccacacacagaagcctacaaatagacttttgttgttcatcctcaagtaggcactaattccattcgatggaacctgggatgggcatcgctttctcccagggcagggagcactgcctgctgtcccacagcatgtctcacccaccctcgtggtggggcaggtcgagggcccaacagggatgctcttgggctttttcactgcaggcctcagccagcacccccaggcagcccctgttgctgctctctggccaacagtctcctaagagtccagggttgcccattgctattgtggggtcacatatctttctacatccatactcctagggaggcggagtcggtcttgaaactgggtggggacccctccattcccccgtgctcctcttgactggggcagtactgttctcgccccctaagaaggaggtagaggtgaggtccctgttcaccttgtcttggagaccagtcaagacaggaaagctctcacctcagagatggatgggtcccttggccactgagtcaggccactgaggcagaggagggcaggcagtcactcactggtggtggtgtgagagacgctgtctctgattatccgacgtcctgtaatgagatacttttcagtgagggctgttccctggaaacagtgtgactccaggactatgggaagggggtctgatttgggccctaattccagctcagccattaccagcctggtggcctaggcagggccttcctttcaaggatttgatctttataatagttttgatctttatttagggttaggattaggttaaggttttgatctttaaaatagtttttcctaccccatataggacatctgccactcaaagggaggcatgttaaagaaaccttttattgtggcaagccgtaagacaaaaaaacatgtgcatcccaggttcagcttgatgaagtttcacagattaagcacacctgtgtagccagtaccatgatcaggatcttcctgagtccctcagtggctttgagggatctcagagcacggcatctccaggtgggtgtgggagcttgtccagggcgaagtgtctgcagtgttgcagtgaggcacggggtggcctcaccaccatgtctttctcagccctgccggcgtccaacacagcagaggtgctcagtaccccgttttctactgagtgactgaatgggtgaaaggcaactggattcctacactcttggtcttttccagggagtctgtgtcttggtgtttctgctgcttcactctttgtggtcgacttgtagaagcccctctgcccagaggacttgatcctgggcaggcagcagcaggaacacaccatgcctggcgtgggcagaacctgtgatcttgaaagagttgagcctccaccacttcagagagagggcagcaagagcgctctggagcctgccctccacagagcttggtgctttgagacctggacagtgcccaccagacagaatccacatagtgtttcctctcctccttccagaaccggatcttcctgagtccctcagtggctttgactggtgaaggctggccaggcctgctggagagatccgggatgcagagctgtttagtctgggaggcaggtcagtctcagaggatgggtgggtcagggctgaacacaaggaaaaaagacgccacacatggaaggaaatcaccactatgccatcataactgaccaactacattttcccaaccttggaaggacaaggtaggagtggcaggctagaaggataggtcttcaaacatcactgttgatgcaaagctcccataacaagttggatttctgagaagcagattgggaattcccagtgggagagaggcagatgagagcatccaagataacgacttctttcccagatgctggccttcctggaatgctggcagaggatctcagttcttaataattattttattgggtggggaagtctttggaagcagaaaataagccaaagaggaacttaatgtcatacccctttctcaaggaaagttttatctacaacacatttggtctattcttagcttctgctcctgtcctttggaaacgtagcctggagggtgtcgggatttaatgggctctagccccctgcccctccctttagagtgagggggtggattggtgtttgtgggttttctctgtgaatcagttctgagaacaccagagagcttctttcagggttctggacttactgccaggaggcccaattcctcccagtgacaaagtcactgaagacaagagtcttcaggaaggagcctcagagcctgggcagggcggggacttcaaggctgctgccaggtttgggtagatgtggggagcaggagccagacagaggctgggtgctattcaggttgctccggcatctggcatttgggcacaagacctgtccttagaaggcttggggctggcaggtgccttgtgagcctgacactgttggtgcagggagacacctgcatcatctcacgcagcagcttcctctggagttcagtgtcctggggcgcaacagggagggctgtggcctggcctgtattcaggtggatttggcacacaggcccaggctggtcctgcacatcccctgctagagagcaatccctaccctcctttgtccccttcgtgtctgagactctgatggcgggggaaacccagagattcctgttgtgcattgagctcgttcttgagttcccatctctctagctggtttggaatcttaagtttctccccagcaggtgatttgaagtcctttgggcttccagcttgcatgggttcctctgtgcctgcctgctgccctctgtgtctgtaagtggttggcaggaaggtgcatgtgtgagaacctatggtatgcccgcttagggccagggctgcagaggttgctcgctgctcaggggcctgcccggagccctggccacatgtcccgcctcacatacctgcaagggccatttccctgtagatagagcagttgcctgacacagccaccacctctccctttttcccaggcctgctggagaaggatggccctccctcctgccttgtccctcaggctgcctgagggtttcgttttcttgtggctggcatggcctttcagggtactgtccccaagcactttatgaatcataatcgcagctccagcatgtccattcacccccactgccagcaggctctttacagctgcattttgtctccacactcttctgtctttctttgctttcatcaggccctctttggcccagcaaaaagctgtaagtgacttaatacagctgggtggccagcctgggacagacagccatcggagccaagcctctggcatcaaatatagatcaaggtctccctttgaggcagtggttcccagccttggctgaacattagaatcactagagaagcttttaagaattcctatgcctcagccctacatctgagaatttaaatctgagtctctctctgggcatagaacctctattttgaaatcttcccaggtgattacattattcagcaaaagtttggaaccattgctttaagctctaaaaccttccattttaagccagctggcctttgtctctagcctctagagaggtctgggccccctgaagctgcttctccctgctgtagatccctcaggggtgaccgggagggtgctgggggtggggccgggtgaatgttatgggcctcacagctgcattgctttcagtctcactgcagcaaacagcagcttgttttctctagatctgcctggcaggcctttgggcagaaaaggcagttacaccatgtggcatggcagcgccctctccctctcaggctcaggcagacttggagaccaggcaagctgggacacaggaagctccatctgaagccaccagtggcagcactccgcccacctgtatgctagcactgcctcttctccagtgcaacttctcccgccggctgtggtgcgcagatttctgaaagcgctcaaacaggctgaagggcccttagcccccttctctccctttccttctgtgtcctctccttaccctcgccactttgttcccctcccttcttatccaaacatgccttggaaaggtctcaaaaactcatgctgaaggtataaaatattcaatcagtatccgttctgcccactgctgagctcgtgggtatatggggcaccgttgcaggttcttctctgagaattcaccagagggacttccagacagtggtgtaaaagggagtgtgcacttttgcagtagagtggagtctgcaagccaagaggccagaggagccatacataggctctgtgtgcaagggaaagcagttctctcacacgagtactgacacttttgagaccacaatgcctgtgtactgggattcaacagttaagtaaatggacggcaggtggcaggagccactgttgcacacagtgacaaggaacaggcaggcaagggaaggaggctagactgatccacggaggtgctagtgtgtttagttgatagagactttaataaagatacataaggatacagagagaagtgtttatagatatgtggtatgcccaggttatatacacctctatttccttgttccattagcggagagggcctagaagctgtgagacccgcgaaacaatgagcacacctgccatccagatcttgatttttaatggcactttccaataaaagtaaaccagggcttctggaggaaatgatcaattctagggctggggcgggaaatataccctaaaggtacatgaagcaccttgcaatgccaggaagtgctttgaggctgcacaggtgcacatgcggatgggggtgtgtcagggggacatgggagccggctgaaaagctcccagtgtccaaagctggaacactttgagcaacaaaataaatactgtaatgttggattatggtgtagtgtggatgtttgtcccctccaaacctcacgttgaaatgtgttccccagtgttggaggtggggcctagttgggaggcgtttgggtcatgagggcagatccctcatgagtagatcagtgccctgccctgggcggggcagcaagtgggttcttgctctgttagtttcctggagaccttgttgttaaaaagtgcctggcagcttccttctcactcccgccctcctctctgaccatgtgatctctgcacacaccagcgcccatttgccttccaccctgagtagagcagcacaaggccctccccagatgagatccccaatcttgaactttccagccatccagaattgtgagccaaataaccctctttttctttatagatgacccagcttcaggtattcccttatagcggcacaaaacagactaagacaagatataaaatccacaagtccgtattggcataaggaaatcatttagtaaagaaataaataaatgggagagaagaaacaaaatgtcctgtgcagaattccaggttatttatgcagctactccttacttaaggagatggccatagctccccactccgtgttgagtggtgacttccttccagagagcacaggggtggggagcagctctgcagcagagaaactgacaggcacgaccccagccaggcacttaaggtcatcatcaacagtgatcagtcgtgaagccttggaaggatgggaagagaaggggtatcacctctatggttgtcctcccttaaacacataaccacagtctagtcgtgagaacaacgtcagacaaacccaaattgaggtgcagtctacaacacacctgatcagcactcctcaaaaccatcaaggtcacccaaaacacagaaggtctgagaaactgttgcagccaaaaggagcctcaggggacaggacacttaatgtgatgtggggtcctgagtgggatcttggagcaggagaacagtagatgcaagctgaggccacctgaatcaagttgtgctgaatgaggtgtgagctttagttaataacaggtcagtattggtttattcattgtagcaaatgcactgcactgatgtattaataacagggtaaactgggtgagaggtgtaggagaactcttcacacactcttgtcttcttttctgtaaatgtgaatctattctgaaattaaaaggttattttaaaagtttaaaaaaaaaaaccaaaaaaaaaagaaaaaacctctaggcacagtgtcgtgggagagccctgtttcacaaggggtagtcccaaaaaaaaaaaaaaaaaaaaaaaaaagtaccatagagactcgaagagagaggaagccactgtaggccaggctgctaagaaggacctggaaagcaggtgccagtggccttgcccttgaaggacagggaagaccagcaccctggccatgaaggccccagcaggtgtcctgaggcaggaccagggccccaggtcatgagaggaaagctaggaagtgggggctcagcagggagcctcaccaggggctttttcccatctcccctgcagcctgggcacctgcctgctggcctgtgtgtccaggggggtctctgttttctgcttctgctgaggagggagacctggcaacgggtggcccctgagagaccatgctggggaacagctgtggagagtgaagccagcgtccctcttgggaccgcatgttctgttgtaggacttgttcagactcttctgcctgttaaaccgaggcagcaggaccaagtgggaactgcggactgactcagctgttacgggcggtaccaacagcaggcagtctcctaccttcctgagtgtgatgtctggtcagacctgtgcccagtctccctcaagcgggccgccttccccagcactgcccactcactctctgttcccaggaggcctttcccaccatatctgctggcttctcaccgaggcccttccccacatgctacccaccctggcatttgtttagcttgcccgactgcttggaagggcaaccgtccaggccaggtttcatcagttctgttcattgtcgcatgacagtcgtcggcaccccacagagcaggtgttgggtaaatattaatatttacgaggtgtgcgggtgctgtgggcagcgtggtccaccttgggcatgctgctgcgcttttccaactggtgtccctgtgtatgcgatggcagtgatacacctcatacttgcgggacagaacatgcctgtgtgaaaggcctgggtaacggcgctttcttatctccagctgagctctgtctctgccctcccactccttgggcctagctctctctgtcgggatctcccaggacaagtctcgagccttgtgcctggggccacctttaagacatctgaatcctccaaacccggcctccttgcccctgcatcccacaagtgcccatctcacagcagctatgtatgccctctcttccccccgtatcatgaagtctgtggcaggcaccatgtcttcctcatcactgtgaccccaagcctgatgtccagtagatgccatggagttaaaggatttgggggatggtggccctgccccgcagccccagcccctccccagctgcccctgtcctctgtacgtggaacagtcctggctcctgccgtctgctcctgcagggctcactcaggaccgtcatctgcatggttcatcgctcccatgaactgagttccacttactcccagcctcctcccctctgcccctttaaggggagcccagctctgcgggaggaggacagcctcctgaggacagggctgcaactgggctgtgggttggtgccactggacaaaggtgtttcagcgcagccggtggcgttgagggggagggagggaggatgaggcggccctcaggctgtgcctgtactgcgttccatccccactgagtagcacgcgggccttgggagaggctaggcatttctgctggtgacacagccaactcactctgtcctttctccctggccacaggaggccagtgaggcatcctcagccctgggctgtttcccagcggtcctccgagctcagacagctgggatggaacttggggtctcactagctcccatgagctttgggagctgtccacttggggactccccagggttggggctggaactgtttcatgccctggggggtggcaacttgaggctgcccttgcagacggctcctggccctgccctgcagtctcttcttccactgattggtatccctgcctgccctccccagctgagtccatcactagtggtatagctctcaagggtctgttttctatgaagacagggacagaaatgccagagaaaggtagctggggtataggtcaggtacagaatttttgaaaagaaatttgccagtagctgttctcaccctggcaaccaccattctactctctatgaatttgagtactttgggtgcttcacataagtggaatcatacagtatctatccttttgtgactggcttattgcacttagcatagtgttttcaagattcatccatagtatagcacataccagaatttctttcctttttatggctgaattatatggcagtgtatatacatactacattttgtttattcatctatctattggtggacactggagctgcttccatctgttggctattgtgaataatgctgccatggtacgtgggtgtacaaatatctgttcgagtccctgtgttcagttcctctgggtatatacctacaagtggaattgctggatgaaacagcaaatctataaagtccagtttaattttttgaagaagctccatactgctttccagagtggctgcaccacggttccagttactccatgacctcaccaacactgacagttttctgttttttaacttacctctaccctagtgaatgtgaactagcatctcattgtggctgatgtgatttgcattttcttttcttttcttttctttttttttttttttttttacttaagagacagggtctcactctgttgcccagactggagtgcagtggtgccatcacagctcactgcaacctcgaactcctgggctcaagggatcctccctgctcccaagtaactgggactataagagtacaccaccacatctggctatttattttttaatttttatttttagagatgaggtctcactatcttgcccaggttggtctcaaacttctggccccaagcaatcctcctgctttggccttctgaagtgctaggtgactttcattttctaatgactaatgacgtcaggcacctttttatgtgtgtcttggccatttgtatatcttctttgtatattcacatcctttgtctatttttaattgttttttgttgttgagttttaggagctgtttattctagatactaatactttgtcagatatatgatttgcaagtattcccttcccttccctaggttgccttttcgctctcttggtccttagatgtacaaaggtttttaattttgatgaagtctagtttatcttttttttttcttttgttgcttgtgcttttggcgtcatatccaagaaatggttgctaaatccagtgttacagggcttttttccttggtcttctgtgcattttatagcctttgttcttgcattgaggtatctgctccatttcaagttcattgttgcatatggtgtagtgtcacccttggttggtggatcctgctagctgaccattgtggtgggtgagggggatgaaaagctgttcttccccagttcccatgcctctcctaccttcttcccatctaccccccgcccacccaccaccagttttaggaggaaggtgggccttaactgggtgagggctcccaagggaagctcctctggcagagggcccttggccatttggcgggggccctggtatctcgctgcccaggcagcggccgaagccagcaggccagcctggcgtagcaggtgtgaggaggaacttcctggtcttggcagcaagtgaaaaaggtccttgttttcttattttctccgttaaaaaaaaagtagtttagtggttctaactatgcccctgggaaagccctgaacgggtcatttcctcagcatcccacaaagtcacttgtagcagaaggcccagcccacgcactgcagcaccaaggctggggcgaggcccacactgcattgttgctgctggcattagcagatgctgcacatcttggaggccccctcctgctaatccacgaatgcctcagaaagcatgcactgtctctggggccagagctgaatcttagaagagggcctacttgggatgggagcggtagctctgcgtctgtggtgacacccactgtcacattccagtagagggaaggaaaggtagggcctcgggattttggccctgactgcatggttcctgcttcttctgtgatggaggcggcatgctgtggtgggctaggagttaggaagcctgggcctgagtttccacgtccagacgttagggagaggtggggtgtagagggccttccaggcctgggttggcagggaggcgagctctttctcgtgatggagccatgaaggcctgttggaaggcctggcctgcttgctgctgagcctgtggtttctccctgttatctgtgcagtgttctgttttgttttgtttgaagtgtacaggtcattgtctttgaggatattcacgtggttatacaaccaccaacacaatctaatttcagagcatttttcatcaacccccaaacaaaccctgcatcccttagctgccaccgccactcctcccctcctgcttcccatctttatcgattggcctgtcctggacgcttgatgtaaatggagtcatgcagcatcatctcacaactttaccatctgctggttgcagcagagtcattggcccaaggctggggtggtggcttcagaccaacaccatggacttggtggcctaggtgctgatcatgcaaaggccattcctcaggggcctgcatctctttccagacagcttctctacctcatgccctgcagagcctgccactgtctggtctttgcacacgtgtcatcctgttaacccttaatgaatatgggattttggttaaaatgatggtttctattttataaataaaacgtatctattacatatataagtaaatcaaatatttatattataattaaatctataatataaatctagcagggttggcttgttccatcattcagaaatgtttactgaagcacatattggaaggtgctgacctaggtgtatagagtaaatacaaggagttttatcaggcaccttgtggcttagtatgcagagcagttgggcagacctgtggatgggccatggcctctgcacaggggctcccttcagggagcacaggacaatgatccaggaggggagatgtgccaggcaggcctctccggcaggacagtgataaaggaggctgctctgtgcagcgggtaaccgtgggtctcccaggccagcaagtaggtccaggaggcaaggtggggcaattggtgcagggagcagagcttgggctgggagctgttggagcagttgagttgtgggttggcttggccggatctatgttcatgaagaatggttctggggctgttcctgttgaatcattctgaggctcccagcactgctgtgcctaggagggtagaacccatgggcctcttcactgtgtaccaggtgttcccagctggcctcatctagccaagcctcccacggaactcccagaatcacaggtctgaggcctccgtcctgccagtccccagtctgtattggtgggcagtgggaaagggcctgccccgcatgcatctgcagctggggagaggggtcagaaatgttttgcaggtagtgtctggggccaggtgctgtcagcctggggctcagcagaggggcagaccctgctctcccctggaatgtggcctgggaaaccagcctctggtgctccccagggccccaaggcaagggccagagaggcacagggagaatctgcacggtactcagctgcctttggattgacccttcggcttggtccattgttttcaagagcccttatcagccatcttagcacaagtagatggccatggtctctgagtagaggatgtgccccctccccttgcagaagacggtggcccatgatgcccagagctcctcagtccactgagccctgcctctctgccacagggtagaagacggaacatgcccgacactgtcctccctccttcccaaacattcgaggaaagttgttgaacccatcgtcttctgaccaccacccttgcttggtaggagagtggtgatgtgcactgagaagcagcaggcggcacgggtgtgccatcccgagcctgagctcgagtcccgcttcagctgtgcagtatcgtttgtagtcttgtgacagaagggggtagattatcaccccaaagggaaatctctaggccaaaacattaggccacttctcattcccctcccctagcccctggcaaccactcctctgctttttctctatgggttggccttttctgaacatttcaccaagatggagtcacacagtgtgtgtccttttgtgactggcttcattcacttagcgtgatgtttccaaggtttgctcatgttggagcatgtgtcaggatttcattctttttatggctgaataaaataatattccattgtatgaatattgcattttgtctatccatttgtccactgatggacatttgggctgtttccaccttttggctatcgcgaattatgctgctacgatatgatttgtgtatatgttcgagtacctgtcttctgttcttttgggtatatatccagtaatcaacttgttgggtcatatggaaactgtctgtaattttttgaggaactgctaaagttttccacaatagctacaccactttacaatcaaaacgaggcctatatttactaccattttacattagggaaactgaggctcacaatttgcgacttgcccagaatcacagagctagtgagtgcagagctaggacttgactccaagggtaggctcttcttggctagagagctctgaaaacagattgcttagagtctaccttagatctcagaacttctgcagagggaaacagctgggagagcagtggtttgtggctccagctcttcctcctgtcctgggctgatggaagccccatgagctggtctccctggcctgtgctgtaggtccagcctaggtagccctggctggccaaagctgcctaaggtcctgggagtctcacgggggctgtgtggctagcccaggtcatggggtggtctcccggcccttctttctgcagccaaactacttctaggagcctgatctaacaaatcacaagcctctcttttgaggatgtgctggggaccaccccaaaagccatcgggtgtagaatgggcatccaactcttggcccaaagtccctctggggttgcaggaccctctctggggtctgccaggttgtagcatgcaggtttcatgtgggacacctgaagggtggggaagagtgcagaatcatggctcccttcccaaggaggtgataggacctggaatcagacctgacacctgaggacaggcattgggatgagggctcagcccagcctaggggctgttccatgcagcttcaggaggctacagtgtggaggatgattgtggaactgccctttgaaccatgaggactgtggagtacaccaggactggcggtgacgactgggaagggggaagggagttctgcctggtgggtacctgctaggcccattgtcagtccctaggcgtggttggcctaacacttctctgagttgtggcacagaggccaggcagaggctttgcttactctgggcctgcatgggatcatgaccccttttctgcggctctttccagtttcctcagaggacttgggctttggggatatctgtctgtggagagtgctgctccctggggaggtctgcagccccagagggactttgggccaagagttaagtgccctttctacacttgatggcctttggggtagtcaccagcacctcctcaaaagagaggggcttgtgatttgttagatcgggctcctagaagcagtttggctgcagcaagaagagccgggagaccacctttgacctgagccagccacacagcccccatgagccctgctcctgtgttgtgcctcccaggatgtgggttccaggggcgcctaggaactcagctggtgctccccaagggctgtgttccttcctgagaaaactctggagccaatgtcctgaattccaaagaaaggaaggacctctccttagacctggctcgagcagccagaccatgtctgcagcacagcccaccagcccaagggaggagggaggtggtgttcctgcctgggcgctgcctaatcaggccatagctcagtgaagtgccaggctgaaggcaggggccgtgctgggcaagtctccacgtggtccaggctgggtagccctgcctacagtttctctgataaacttaggcatgaccttgtgcaaacaattgttaagtccagggaggaaagatgccaaggagagaggggcaagggtgccagtcagagaggaccacacttgttctgggtggcccacagagtgccacgtcccataatcacttggagccccagcttgtacatttgaaagtcagaacaatgatgtgcctgcctcctgaagctgtcatcagtacctgtagctactcagggcctggccacagtgagcacccaggaagtggtgaatacacttcctgcttctactgcaaggcaattccctgtgtcctccctagaacgtgccgagctgcctgtccctgccagagtgcagatgagcaaggcgaccgctcagccccaaagtttgcagacaaagcttttcatactccttaagtgggtcacagtgcatatgaaaaaataataaatacagtgcacatggtagaaatactgactcaccgttttccatttcatgtgcatgtgtgcacttgtgtgtgtgctcatcatggtgtgaatgtggtgttccatgtgggccttggttggatgagtttgtgaaacatgctgtctcaggacctcaggtgtggggggaagtcaggtttcaccttgaaatcccctttctgaccttgagattttgggagtaattctttgccctaggggaaagcctttgtttcttgggtctctgttttctggtctgaatgagggattgggggataaagggaagactcccacccaggtctcacgtgcgactggttctgtaacagcagctgcctggaaggaaggtcctcctgatgataacgccaaacagcctctcaccatatttctgcttactttcctcttgtttccctctggctcttagaagcttgccttcccacactcatggggtcaacaagaaacaaaggcctgttttcccaaaagtgcttctgcttgggccaggggtgtggtggagagtccccggttggagaggctgctatagcagtattatcctaacccaggaaggtcactctggcctctgacaagatgccctggctgcagtgcacagagcttccagcctcccatgggcctgtggacagaggaccggcaggaggagcagggtgtgctcatctctttggagagaagcctgagtcctgtgtcctcctgcctaaacaatctgcagcctgtagcaactctgccccttagctggggtagggtggagcccagaagaggaccagaggctccagatagctggagggctatgtgggggctgaacccataacttggtgacatagcagagtcgatggcctacagagggccgtctctttttttggaaaatgaatcaaacaaaactaggtgaagctcagcctcctaggaaacctggattcctgacctctggaggtatagaattagggcaggaagctcatcagagttgctttgctgacagcgttagagctgaggcgttccttctggctggatttgggttacagcctagatatttgcccttactctcgcagcacaagattcaggcctacccagacacagatggttgtatcctgccccctaggcagaggcaggggaggggagaggtgctggctgaggggctccctggagccattggttgagtctgttcagtctggaaatgctgctgagtgcagagcagcagggggaccagctctggaaccagagtgcctgggtttgaatcctgacatggctacttcctagcattgtgaccttaaatcaaaattacagttctgcgttgtttaatgacaggcacacatcctgagaaatgtgttttctcaggcagtttggtccttgtgtaaatattctagagtgcacttacacaaagttagacagtacagcttattgcacacctaggctttgtggtagagcctattgctgcgaagccataaacctgtacagcatatactgcaatatcacaagcagttataacacagtggcaagtattgatgtatccaaacctagcaaaacatagagggagctgttgactaacatcgttgtgcggtgcatgactgcacctagcttcttagcagtctgcttccttgtctgcgggatgagagtgacagtagtgcctgcctcatagtgtgttcggaatgttcagtgagaggacacgggaagagtttgcagcagtgcgtggtattcaagggcatgggcgcaaacatgagcaccattgtgccctgcgcctgtgctggtgctgttgttgctgcttccccatcggcagcaggggaagggggaacactgcactactgagacttggagggagctattttctttttctttttctttttttaagttcaggggtgcaagtgcaggtttgtcacataggtaaagttgtgtcatggaagtttgttgtacaggttatttcatcacccagatattaagcctaatgcccattagttacttttcctgatcttctccctcttcccaccctccccactctgaaaggccccagtgtgtgttgtttctctccatgtgtctatatgttctcatcatttagctcccacttacaagtgagagcatgtgctgtgtggttttctgttcctgtgttcgtttgctaaagatagtggcctccagctccatccatgtccctgcaaagggtattatctcattcttttttatgactacataatattccatggtgtatatatatcacattttctttctctggtctgtatcattgatgggcattccgtgtctttgctattgtgaatagtgctacagtgaacatacatatgcatgtgtctttataatagaatgacttatattcctttgggtatatacccagtaatgagattgctgcatcaaatggtatttctatctttaggtctttgaggaattgccacactgtcttccacaatggctgaactaatttacactcccaccaacagtgtataagtgttcctttctctccacaatcgaagggagctgttttttgttttcattttgttgtttttttgtttatttgttttgttttgttttgtttttgagatggaatctcgctccatcacccaggctggagtgcagtggcgcaatctcggctcactgcaagctccgcctcccgggttcacgccattctcctgcctcagcctcccgagtagctgggactatagacgactgccaccacgcccagctaattttttgtatttttagtagagacagggtttcaccgtgttagccaggatgatctcgatctcctgacctcgtgatccgcccgtcttggcctcccaaagtgctgggattacaggcatgagccactgcgcctggccaaagggagctattttatagcaggtcctcagtacgtacctggacctgtcttccaagagtgctggttagaagcagtacataaatacaatttaaaaagttagtcccaaaccctcacgcagtgctagtgggaatgtgagatggcacagccactttgggaaatagtctggcagctcctcagagttaaacatatagtttccatatgacccagcacttctgctcctaggtacacacccaagagaaatgagagcacaggagcactgtacaggaatgtgcacagcagcactatacacagtagccaaaaaatggaaacagtccaaatgtccatcaacagatgaatggataaacaaaatgcggtatagccgcacaatggaacgttattcagctgtaaaaagtattgaaagactgacacatgctgcaatgcggaggaaccttgaaaatatgctaaatccttgaaaatatgctaaatggaagccagatttttccatttatgcaaggtatccagaagagatgcatccacagaggcaggaagcaggttagcagttgttgaggtggggacaggtgtcaaagggaagtgactgcgaatggcttttcagggggagatggaaatgttctgcacttgattgcagaacagctctgtgaacatgatgctaaaagccattgaactgtacactttaggtaaattgtatgtaaattatatctcaataaagctgttgttaaaaagaaaagttaggccaggggcggtggcttcgcgcctgtaatgccagcactgtgggaggctgaagcaggcggatcagttgatgtcaggagttcgagaccagcctggccaacatggtgaaaccccgtctctactaaaaatacaaaaattactataaaatacaaaaatataatactaaaaatacaaaaattagctgggtgtggtagcatgcatctgtagtcccagctagttgggaggctgagacaggagaatcccttgaacccaggggatggaggttgcagtgagctgagatcacaccactgcactccagcctgggcaacagagcgagacttcgtctcaaaaaaaaaaaaaaaaaaaaagaaagaaaaaacgaaaagttaataccaggattaaataaaaatgagatcatctgattaagagcaggaagttttttttccctcctccatggaaatagattgggctctggagttaaaatattcccttctttgataacgtatttacccccatttgctctcctttctctgtgtgtgatagggttaggtgatgcccgcctcacagtaagtaatattgaagagggcataaaagggagtgtaactgtgaaatcttgacacacaggtagttaatacatgctaatttccttcagtcctggctcagcttggtatgtttttgccttttattaatgcttctgaaatcctttttggaaggagatagaaccctcactttgcacatgaggaaactgaggcccagagaggtggagaggtggaaggcattgcttcatactcatttggtgaggctgagacacaaccacgttcagcagcagagcaggggctttgttcagctgggggccaagtgcccaaacaattactgcgtaagagggaagagtgggcttcagggacagtgagcaatttggtgacactgaaccctggaacagtggcctcaaagtggggtctgtgcctccagggggccggtggatgatcccttgagaagaaaactttggaatttctgttgatatattccatctaacatatgtctctgtgtgtgtgtgtgcacacgcatgcacactcataatagactggcaccatggtatggatacacagctcatccagggcctgtactgtcagcagtttgagaccacggtcccaaggaccagggtgggagtcaaagaccagagaggaagggccaccttaggaaagcccctctgcctccacagtggttccttcaggatggcttctgacactctagtaacgagtgcactggccactttaccatttcatgtcatccagtcctcactgtggtccatggagtttcctcagcaaacaagagagtccacctcagagagacaagatgccttgtctagggaggtggaggtggggtgcgcttttgcatgggggtgttgggctcaagagggaagtcagagcaacccttcatttgcccagagggttcagacaggcacctgcactatgccaggatgcccaggatgagaatttctgtcaaatagagtaaaggggctggagctggagagaggagattaggaaagccaggacccccaccttgggcaggaaggcccacctgtcctgtggctgtggccatagcactcagtgtgggtctccccaaccagaaggtggcaggggcttggatccaggcttcctggactaacataaagatggggtctgaggctgcctcctgtaccctctccttctcaagaaacacccactgcttggttgcagagcaaccctacccatctccctttcctggctccttctcaaggaccctccaagagtgtctggaagagacacctgcgggccactccactgatggagagcactgagctgggcttgaatgtggctcctcctcgtgtccccccagggtcagtgttgaggcaggatgccaatggtgtatgctgaaagggtgaagccactgaaggaggcttccctgtgagcccagcctccatcccacctgctgtgccacctcccttctgagctggacccacgggggatggctgagtccagagaccccacaaggaaaggcttcttggacctggacatttaaccatggagaaaagagccagcagccatgtaggcaagggctctgcaaagccagcagccctccggtctgactcctgcaggcaggcatcaaggggtgtagaaagaggtggcaagtaggtcagaggaagtaacaggaagatcacaggagcttgaggtggagggacaaggaggttgcacctaacctgtttctgaaaggaagaaggtcggggtgtggagagtggttggtctgagctcagcatgggcaccagacccagcatcctgctcttgagaccaagcccccattgactgtcagcaaggagcttgaggctggatggcctctgggtggaaggcagcccaactgcaggccacccctcagatggatcagaagcatcttctgcttcttcaagaatgagaacaaggaaatggtgggctgttgggggtgctcagtggagaagccagcagctgtccattagtggggtggagtcagtgtggagtgtgttaaggacaggggcacccctggtgtggtggtaaccatggcaacccatctgctctcccaaagcatccttacgttgggagagtaagaaagaggccagagggtacagggctaaacaagtcatctccataaaggtcctcttgcctagccctttgcctcagtagggatttcttaaaggcatcctttcctgcttttggttttctgtccctaatttcagtgtgtaacagtttttgctgtaagaaaaaaagttactgtttgccatgccagagctggtgtggcagcctttgctgggctctgctatggccctgggaaggtgccgtgggccaggctgccgggcgtgctccttggccgcctctaaagaaggcacagtgcacccaccccacagcctgctctcaaggatgtggcttctctctggccccctccttgcctctaaaaataaccctgctattttgaaactgcctcctctggagctttttcttgcttctctgtgggatcagcagcccttctgagaccaggatctcagctgcccctgtcaccgcagctgtccccatcctgtcctcccctgcatatcccctccagtgcaagtgggatgtcgctctccacgtaggagggatgtttagctgggtgtcctctggagaaggccaggcctgtccctgtcctccctgggatgggcacaaaggaagaggagctggggctggagtgagggagagcactcctagaggccccacaggctgggagggtcaggaatggcctggggctgtacgacatctgtggccccattggctggcctctgggtgactctctgccgccttcttccagcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtgagtatgctggcactgtggaacaaggcaccaccacctgccacagggccaacaccagatgggccgcctgcccctgtggcagtgtcgatgttgtctacttccccgtgtgcctctattcttgggctctgtctctgttctcaacaccgctgtgtgctgagcacagcagaaatcaggacattcaccattccacctgcagcctctggggcccctctttgctctggccaccttaccctcctcgggcctccccaccattgcactcaccacacccccaactcacctgcccctccacctggaaggggatcagtccctgaatcatatgacctgggcacgccctcccccagtctgggatggctgctcctccttccagggctggtgctgggctccaccacctatgaaagcgccaggttatctgctgtgtccacgtgtgtctctgtcagtggtggtgggggtgggaggtgtctcagtcacatccccagcacctcacacccgagccactctgctgccactgcacagattggtttctgtgagtggagagaatgggtaagtgtctcactcacccaggtcccctgagagtggcgaactggctcaggttgagagagcccacagtccaggggcctgagcgcagtgctgagcccagggcagcatctgccttcccagagctcccagtctagcagggaattctttgctacccacatggcctgggccatggtgaaaagccgtacatagtccgtgcaggtgaacaggctcattgggcctgacaggagctcacaaactggatctccgagaatccctgtcttgcttaaggctgagaaggaggcacatgagtctaagaagctctgggagaaagtaaacctggggcttgctgggccaggctgactgtagcagtacagagtagagggaatcaggaatacgaagcccttgagtttgaacacacagatgactcggagcaccagcctttctttagcctctcagctgcagcctggccaagcctggtgagtgagcacagctggaagtccagggccacatggcaaggcgtccaggagccagtgctgggtcccgggggcgctctctgcgggggtgtgctctcccctagagtcctcccctggagagaggcaggtttgcatttctgagcacctggagccgagctggaggagcacttctgtctcccacaatcttaatccagaaccatatgatcaagaatgtcaagggcctctgaagaaccctcgtggtacagtcgaggagacccagggcctagagacaggagcctggccaggggcaccttctgcactttctggctcacacctgtttctgctgttggccgggcagcacacagccgaggcttcctctgcccaggtggcttccctaggaaaccctcaccctttccacaggagctgggtcccagggagggtgtgggtaacaggtgggatggatgggagtcctgggtctccagggcaagctggggagtgtctggagcagggttggttctaggaccagcacatagaggtatgtgttgtaccatgtggtattaggagagggtgatgtttagcatttggactgcctccagcaggcagcttaagtcctgccagaagtcctcactccatcccaagcccctctcctgggtcacttctctgctctcttctgttgcatattcaggcttgccatacccatgcagcttgggtagacaagatcgttaatggaccaaggtaccgggtgcacatgccatctgggccctacgtgtgtggtggctcagtggcgtatccaaagccagaataagctgcctgacgctcttccccttcccctcgccctggttgtgggccacgttagttcgtgtccaacaggcaggttctcacgtggcataacctcgtgatccgccctcaccttcccacaagctgggatgctcagctgcgtgagggagtcaggtgtggcctatgcaccctggggacaagtgcttttgcctccttctcccattcctctgtctcctgccctcgctgacagcccccttcctctgctccctctcttgcctccctctgtttcccattataactcctcttcccagtaacctcatccctaggctctggagcgccattctgggtctgagctctctggtcacatcaaagctggtccctaagaaggtgcagacacttccaccaggcagctgggagctgggtgggttggggacagtcccacccagtcttcttcccaggtcttctctgcatagccctgacagctgcgtgggctgccgggtctctcctgggcctgggtagaggaagttggcagctctttccagttcccacttccaggattctgggccacactttacatagctcttttagacgaggtgggtttgggtaggagttggcaagggagctcttctgtgctctcagctgggtgaagtctggacttcccttctccctgccctgccttttaaccttacccactcccctgttctcactcatccgggctctgccgtccctatccggggagccccagcacctaccagtcccatattcacacccctctcctctcttcttggggtttgttttgttaacatttataacacatctggatgatgttagacgcttcctattgggcttccttgagaaatccaagtgcagaggacacattccatcatctattcctggaccctgcatctctgcgactccagccacagactgcagtctgaacagagattaagttgcataatgggactgaggccacatgagacacctgctgtcctgactcctcccgagtcctaggcttgctggagccagcccaggagagctcagcagctccacgtagtcagcagagcacctgcggtgcagccttctcccctcccctccaggttccatcctgcaaggccattagtcattgctgactgatggaacctgggccagtctgcaggggcctggggtacctggcagggttctgcacctccagcatgctccacaccttggtgaagttttaagtgcagccttctgcaggcacagtccctcagagtggtcagaagaagtggcagctgccatggcagactggaaaggcaaacctctttaatcccatagggcttgtgaacatcccaggttgtatgagcgaggccctctcctgggacctctgctcccagccagccttgatgagaagtgtgaccagggaggagaggggctcaggaccctcagaaggcctgcctgtctgctggctttgcagatagtcacagcctcctttcttgttttggggccgtggaggaatgacccacaggacctgtggcttggatctctggcattgcaggtgtttattcattctctcagcaaatcgagcatcactggctgtgggctgagctgggctgagggtggcccctcagctctgttgctgtggttccgtgcattaagcctggcctctgccgccaccacctgtcaacagcacacccatcctgaggctgtctcagaagccagtgattgtgactgacccttcctttgtctgtttgtccctccttccctcctttcttcattttctccttccctctcttcctgtcctcctcccctccctccctcctccccatgctcttcctctcttcgctcctctatcccttttccccctcccctcctctcctctccacctcaaattaaagaaatacctctgggcacagaagactcgagcccttctcctgccccaggctcagtgtgctgctgggtgctgcacccgtgtgatctctagcaggatacagcagtacagacccccccatccccaaccctgggcccaggctgccagcaggcccagcgtggaccctggtgctgaaagaagacctggagcggtgtcttctgaggctccttccactctggagaggacactagggctgcccttgcacaaccaggcccagggctggagctggggcttcagaggcaggacctacactgccctccgctcctcccacccccgtcgtctagcccccacaggactgacaggcagctctggcaaggcaactgctgttggttcctttgtctgttgtaaaattctatatggtggaagtagttgtgccatgatctgatctagctcctgatttcagaaatgagaagattgaagctcctaaggggccaggagccacccaagattgtgctgggatagtggcagaaccagatccagagtcgtcctgctggcagcgcctgcttttgctgtgttcccttgctgcacccctggtgtctatccagagtgaacttgccacacacaatccctgatgggtccctgggcagctctgcccagccttcctcaaagccagggtgcccagcaccctccctctgcagggactgtgggagttcagcaaccccccacaccctagtccctcaagagtacccattgtgggaacttgaccagcacagctcctagattctggcctcagggccagcacctgcctctgttgccctaaatgggcacagctcgtctgtactctcaccaagcccactctgggagagcagtgttagggcaattccaggccctggagacagggtcagtaatggaagttacacatcctatgctctgaggccatggccaggccaggcctctctgccagcacggagtctgtgtcgtgtcctgagcctgctgtgggtgtggcagggtcattgtccaggcttgctctgtggcacttctggccccagcgtagcagtctgtcactggggacaatgccctgctctactcctggaccacccggcaagggccagggctcctagtccccgagtgccagggtcttacctggtacttgtctccttttctcttcccaggtggctggagatgctcatggtctatccccggaccaacaagcagaatcagaagaagaaacggaaagtggagccccccacaccacaggtaggcagtgggtttgccagatggcatcccctcagtggagccagggcttgggaagaagtgagggctccctgaggttagagggtgaggacacagtcaggccagggctgaggcagtcaccaactctgcacatccttgctttgggctgcaatctgcaagatcctcactgagccacaggggaaccacaacagggacagggtggcctgctagtgtgctctggggctgcccaagggaagtttccagccagctagcagtacacagctgtgacccctcccctcgctatcctgctggcagctggggaggggcagcacgggcagcctgcagccacagtcaaaaggactctgcacccacagatggccctgcaggcagccggatgcagtaggatggggaggagaattctggagtggtatggcccataaggagctcacaggggcccttgctgcaactcccatgtgacctgagcagggcgtggctgactggggtggtccctcaaggcccagtccttccccacaggccatgatcctccttccctccctggccagtgtgcaaggcttagggcatagaagggtcctacaccgccttaccacactccccacgttcctggggccatgggggaatgaggtaaccttttttgagcctcagttaatcaacttgcaaagcaggcctgttgctgcctaatcgccaagattgttgtgagcatgaaaggaagttttggacctattataggttctcagtaaatgtaattcctttccctctgtaccatacgctactcttcccaagtcctgagcctcatagtcacccgagagggagcagggtggggatgggggtcccttgggcatcacaaggccagaggcccacagaagtgaagagagccagcccacgggctacagaggtcagggagcatgcactggtctgggtccctttctctcctcagccccttgggctgcccttggatatacctgccctgggctgctgtattggccctcctgctgatggagtcagcctgggccactctcagcccatggtcatccaccctccatcctggggtcagggaggcaggtgggggacacccaagccaacatccgctggaaaggagatgtcgctagcaagaagtcagcgaaaaatacagagtggttcctgggactgaaaatggagcttcctgctggggaacagcagttaatacgtaaatcccccaaagcttcccagttggagagaaacaaaaaaatcacaggcagaataacagcgtttagggttacactgcgtttccatggtgatgccttggaaacagtgcagaagcggagctcctgcctctaataaggtaactccaagtgcagaagccgctctcagcccagtccagggaacttgcttgctctccctccctcatgacacccagctccccaaaacagctacccatgaccaagtttcaacttttttgttggtagaaggagccacatgatcccagggtgggtaggttacccacttcactgagggtctcttagagtctggagcacagggttcctagccttctgcactcaggcccctcctaagacaaccttgcggggtctctcctttctaccctttggtcccgagagcatcccatttgaggctgcttgtttccagaagctttgaattgtaatcagaggccatctctttgtcaagtcagtcttgtggggtgacgtgggggcactgcagaggagcagcagggtccatggttgagatgggatctttggtcaggcctcccctctgcatgcagcctgatgctaaaggcattctcatggcctagggtggggctgggggtaaacctcacaccttcagagcacctggagaggcgagaacccaagaccctatatttctttctccatggcccagtgttggcccgggagagtttcagattgaaccagtggagagcttgaagcgttggctgcctgttgtgcccagtaagaatcagcttctccccttaaggaactcaggtgggaccttctggaaggttctgcttccagaagttggggccaaggatcgcactgcgggagcagcagacagcctttcagctgagggcgggagtctcaatagagtctaggcctgggagaagagaagggcttggccctgacaagagtttccaaagcctgtggcctgagaggcgtgggctccaggcaataaaggaaaaagcctggagcagaaggaaacgatgacccatgtaggtgtgaagggcggaaggatggagatggttgggaagcccagagctgtgtttccagccaggtgtgcaggccccgggtctccactcctctggtggagctgaaggaggcccgctcctccatctcccagccccccaggttcttctgcttttctctggctttcttctgagttcagtgtgagcccagccagcaccaccaggcccacatgtgtgtctccttccttaagaatcctgttttttactgggatgtctactgtcacccccactccaagttagaattcttccttcccgttggttgccatgctccgtgttcctgctagggaagtggggagccttctgaaactgctgcagagagaggccctgcttggcaagcaaggctctagagcaacttgtgctttggggaagcgctgctgccggggtgggcagttagggtggttctgccctgggtcttcttcccagggcagcacagctgctggtttcccatgggtaagcagcccaggatgctgtgcttggtgcagggacaggtcgtcctggggcggcatccccttgggtcattggagcccttgggaaacttgtcaggagaaaccttcactgtttgcttccgagaagctggcttcttctgaggggagccttcagcctgggagtctgtctgctggcagccctaagctgagtaggtggtcaggtgtgcgtcctgggtctgtgggaagagcctccctgcttttatcctgtccgtgaggcctggaatccttgcaaaagtgccaacagctttggacccagagccccacccaaggcagtgccccaccaccccatggccttcctgcttctggagcacgtggtggaaacactcagacccccatgctgcccctcactggctgtgtgcgtgtgggcctgctgcctcttctgtcagcgcctgcggcctcccttgggaggtgggtgggtgagactggatgtatggatcccagccaggctattgataaatagtctggtggtgatgctgcatctgcaagtgtgcgcacatacatgcatataaagaacctgtgtcatctgcaagcctctccaagggcccaagccagagagagactaaggtggttttctaaaaatgaggcttggccatcaggatgggagtgggaagtgggcacttgtatatcatgctcttgtcttttgcgagagagctgagatgtgcttcacttttggagaggggccaaagccatcctgttggcagccctctgggcagggttgttggggcccaggatgtgacctggcactgcggagcagctgaggatcacagccctgctgttgcctggattctgtgtttgcagagtcaagttagggttctctgcccagggactgcctctgcatctgcctaaatgcctgccccacaaacacttctccctcggagctaccacttccagaaccatggagagattggggattgacaccttttccatctgggctactggcttgtatctagctttgtgtgtgagcttgtgagtgtgagagagcaagcatgtgcacatgaatgtgtatatgcatttgtgagtgtgtgcctgtgtgcagattcaagtggggtatttggtgtctttgtgtgttctgtctgctataataaaataccacaggctagtcagcttataaataatagaaatttttctcacagcaggctggttagtccaagattaaagtgctagtattttgggtgtctggtgagggcccccttgctggtcctcacatgttagaaggggcaaggcagctctctgaggcctcttctatgaaggcactaatcctgtacatgagggctccactctcatgacctaatcacctcctaaaggccccacctcctgataccatcaccttgggggttaggatttcaacacatgagttgtggggagacacagacattgaaaccatagcatttaatttgcatctgacgactctttccttcacatagcgtctgggcactccattttagcttcttaggggcaaaaagcagagggtgggtaaggccacagggctggcccagacttgggcgctgtgaacttgttcttgcattcactgtaaggagctacagatgatgctggacctgtctcgagggtgtgttctctttccttactctgttctgtctcaccttatttgagtcttggatgtctaggaatgacagactccaaagcaactactgtggtctcactgttttggggcagtatctgaagattccaggcccctgacattgtgtagctggcccgggtgccccctatagctaggcagccaggacctgtgacccaacctgagctgtgtgctcctgcaccttcacagacaccactttctcctcctccaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaaggtgagcggaggccaggctggcttgtatgcacgggaatggccctccctcccatcagagctggccctggggattcagccaaggcctgtagagcccagtcgcaagcctggacctcgattccctttgtccatcagccctgggggtagcacctggcctggtatgttctgagattcccgggctccagtcttggccttgccccttctagctcttaaatcccatctttaaaggaggaagacagctcctgttctgtcagccccagttgcttgtcaggagaatcaaaaacgttttgcagcagggtctgtggatgggaaggcctctgtcactgcaccatcgtgtttctttctgtgtgcatcctgccccaagaagctgcagtcagtctcatccctctcaccatccgcattctgcctgggcccctggcagaaggaggggaaggggtgctggggaggcagcagttggcatcctcgtgccctgtcttttagcactttggaattacctgagcaggagcaggtcttccatctttgtctgtcttgttcccaggctctagagggctctgtaagacacaggctgggttttcccatctgtattttgtctagattgttaaaaataagtgagcagcaggggccagcccagctcgctctgtctgcatcttctacatgcactctgggtggaaggtgtctgaatcttcctctcaggcctatccattcaaaaatctattcactctgtctcacttctgtagaagtcccctgccccttcccaccaccagaatgcattaaaagactgaaggggccgggcatggtggctcacgcctataatcccagcactttgggaggctgaggcaggtggaacacctgaggtcaggagtttgagaccagcctggccaacatagtgaaatcccatctctgctaaaaatacaaaaattagccagatgtgggggtgcacacctgtagtcctagctacttgggaggctgaggcaggagaatcacttgagcccaggaggcagaggttgcagtgagctgagatcacaccactgcactctagcctggcgacagagcgagattgcatctcaaaaaaaaaaaaaaaaatactgaagggcttgttggctgtcagcttcccccttgatgttggtgagaagcggttggtggtgggggtcttgcgtcctgaggtacagatctgatcttccagccaagcccccagactagaactgcagggcctgcctgccagtctggctgagaggcagccagctgcaggggagagatggatgagagaaaaaagcatgcacgaaatatttcattcccatccatggttctttccgtctcactctgcccttgagtggggtgtgctggatgttagagacgggaggtggagaaggcccctgcttggatcctacatgggctttaaaaaaaaaagtcctcaaagcaaagctgccagcaggctgagtgcgtctcctccctcccactgtctcttccagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggtacagttgccccgagtcgccctcccaggagctcggtggtcctcttccttccccaggtcctcgactcccccaccaaatggtctgcagcatctccctcagctccctggatgtggccagccagccacctgcctacgtggactctggcagcactagggggcgggggacagagagactggggagcgcctttgcctttaaagccagcaggcaatatgccaccctggccgacgtccctaaggccatcaggatcagccaccgagaagccttccaggtggagagaaggcggctggagcgtagaactcgggcccggagccctggcagggaggaggtggcccgtctgtttggcaacgagcggaggtaaggagcaggttagagggttgaacacccaggcccacacacatgcacttccacccacgcacatacactcatactctctgtttctctcacatacagtccccaagcctcccttggcggagcatgctttctgttcagagcataggggtattttccctctgggcccagaactcagctctagtagccagaatgcagaatttctgagcatcagaggtcgacgccaagaatagcagttttcacatcagtgcctcctaggactgggaccttaaggttccctgatgggttctcagctgcctggtccttgtggggctggatcttttcctcctgggccatttctattctctgaagtggcatggaggcagggagtccctagagctacatgtggtgacagaggcgctcctcaccctggcagtcccagggtgggcaaagggcactgagaggttcagaggcagacaggcatgcccaggaaggtgggggcagcacaggttcctctctcaaggacatgctccctggggagccacagccccaggaaacctgaggcaacctgtgaagcagctgagcaccaaatagcattgcttttgccctccaggggagcattgctttttgccctctaagactttgactggctggagagagagaaagtttggacatccgggcctagggcagggaccaggggcacaggtgcagaacttgactgctgccgaagaagatgagggcccatgccctgccctgcccttgttctccagagtttcctggagaactagagaaagagttggatgtcctctgaggcctccaagcccaaatccagacgcaagtgcccaagcacgccttcaatcaggcttgcacccctgcatctgtatactgaggctttgccttgacagcagggttcctcagccaggtttatggatagacttacagacttctggaggtccatgatgacctgccccctcaataaaacaatttcacagtattcttcccagaagagagttagggttaggcactcttctgggaagaagacccatagttttcattaggttcccaaggttcactgtccagaaaagaggttcaaaccatagttctggaagtcttctcagagtgtcctcccttccccagccacaacctggagctcagagttagagacgctaccaggagggacaggtgaaggcagccatgggctcccgtgcctcgaagggcaggtggagggaagtgtctttacatcctgcccccttttcttctgagcacccaccattggctgacagcccacccactcttccaaacgtcccagatgaaaaggcctgtgagcctgcaggttagtctccaggataaggaagcatctcccagagatactgctggtgagaggaaaatgacacgttgacttcctagggaaaggaagggcagccaagtggttcccagcccctgcctagtgccccagggtgctctgctaagcacttggctgccttaatgtttcatagtagcctgatgaggatctgttactaccgcccccagttatagatgtgaaaactgaggctcaggagtaggtgacttctcaacaatggatagctggtgcagatcccagtggggccttagccaggaagtccctgctcccatcctgtgatccaggactgatgccaaggatgctcttttaagcaattaagaaaatatataagtaaagggttttgctagagagaggaggaggccagtgggtgggcaggggaggcttcatgctggctggcaagcaggctgtgtgtcgtggtggctccagagcaggatcagctatgtcctggtttagcgccagaccacagaattagcattcagcacacctgcttggcttggcttcttctcggagagactccttttgaactcgttcttgtctcctgtcgcctgggacaggtgcagtctctggggctttgtactctgcatgcactgccacacggggatgggttttcacctggtgctggccccaccccccaccagttctgcatactaatactgcagcatccctttctcctgaccctggtgacatctgattggctgctgtcgctttctgaggcctgctcactggatccctagtagcccaccctgtgcttggttggattcctgtcccctggttgattagagcagaatctccaaattggcaagagattcttggccacacctacctgaaatggcagccacaataggtgtgcccaggagccagactgctgggaccacagggttggttttttgacaagccacagtcatctaggcaagcctatctgaacctgaccggttctgggcttcgatgtgtccgttcctcagacttccagagtgtttcttggatagtgagtcacctctggctgctgagtgggggaagttgttttcctggttggcctgctggtgactggcagcaaggacagctccccatgtagccctaacccccctgccctcagcacagcggttagtgccctgggaaccctggagctgcagggtgcaggccccgttttctgtgctgaccagtaaggtgcttgctgtcccacctgcagcttccagggcaccaagtaataactttccacctcgcccagtagatcagggcagccagtgtgcgagcctgtggtcttacaggatctccccaggcccccatgcagagtgactgtagcaagtgcctttcctcttctccaccacgactcctctgtctggatccccacagtaccacggcatgcgatttgcatgaggttaaagcccagcagttcctcactgctttcctggggctttctaggccccagtgttgggcagaggagccctcatcctggaagtggcctgttggtgagccttgaatctcaccaagatcccaccacaatcgctcaagtgtggtggacgcctggcttgcacttaccaagctttccctgggtgtcctggaactccagcagcttccttagcttcctgctctcacaatgccgcggcctctgctgctcccctaccccagcgcctgcctccgctgctggttctagcaggctggcccggcacaagcttctttcctgaggaagacactttgtgtctaagcacagggaggaagctgagctgaggaagacactttgtgtctaagcgcagggaggaagcagagcccggggccctcgccctcctctctccgggggtgaagacgccttaggcagccagttttccctcgcactccctgagaagcagctggcctcttgggggaggtggggtctcaggaattgatcttgtttcctctcttccttgtggagataattaggcttccaggcttgggagcccttcacccacttcctctgggttcttatcctcttgtccagagcagcagtgacaccctccccgccaggtaacttaggtgcccctgggagaacaggcccggccctgtgagctgagcctcagctggtgcgtcccccacctctgaccccaccagggtgacttcttgcagctggaggacaatcatggtctctctccctcttcagtgattaccttgggtttttgcttctttaattctttggataattttggttcaccattatttgatttgaaaaagcagcgctcttccatgtattcatttcccagccttgttttctttcaggtcttgcctctgcgctctcctgctgtgccgctgggtggcgctgcgcctcctccacccgcttcgcccccatctaagctccgtctccggccgtagacagcctgaggaggccgccagccctttcacatgaaatcagcctgctttgtttttgttttaatttggtctttgattccttttactgttggcagaaacaatgttaattcctgggcctcttccttgctaaattttggggtggggggtgcactgtgatccatgagggatgcaatgagaatggaggctgccttccgtggtggtggttgccttttgatcatgtctgtggctcaggagaggctgccgggtgccaagctgtgtgaatgccgagtgggtcagcaccacagagcctgcagggcctctagcgcgggggcagagggtaggggcaagcgcaggcctgatgggagggagggccgtggaggggtgcaggcagagctcgggtcagctgagcacgtgtctagacaacctcggtgctgtgcaagcctgaggggaatcaggcccgggccaggccgggcatgggaggagtcggctcactgccacctcacagctcacctcactgccacctcagggcctcgtgtcctctcttgcaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggtgagctcctggggctgggcagcacctcaggggtggctcgggggcgggtcagcatgcaccccatgcgccaagtcccctccacacaggcctgggatgtgctcctgccaggcttctctccaaccacctcctctgcatagtgacttcttgagagcaggcctgtctcctgcagcttcatatcagagccttctccgtctctgctgaaggatattctcatgcattttagatcccagatttaattaggatcactctcttcctatctgagacagcccagcaacaaggctgaatgtcacaccttcctaactctttctttcagtacaactacacccctcgtttctccactcagcccaaggtagactcggcttctgaaatcctcctgggcacccgcctgctgcttttgtagccggccaagtctaagctcatcttctcctggcttctctcttgttcacaaggtgcctagtgcctactgtctggcccacagcttgccacctgccaccacagagcccagggctcttccttctgtgacccagagaagctggaggatggggtggggccaggaaagtgacagtgactgggaatccaaaagaaaaggctgctctatcaaccagggcatctcaggacccgggtcctgtcctggccctgctgcagacttgctatggtggctaggcagatcactgcccctcgccaggagcaaggccctggcggctcttggaggggtggacagcaccagctcgtccctcacatgcccacattgccctgggctgcactgaccagcggctgctctctgccacaggacttcaccaatgaagcccccccagctcctctcccagacgcctcggcttcccccctgtctccacaccgaagagccaagtcactggacaggaggtccacggagccctccgtgacggtgagcccaggcgccgcgtcctccggaggccgtgctcctctgcttctggtcactctgaggcgctgtctgtttctgtctatgcgtccatgccagctgtccctctgtgcacaggccctcgtgtccgtgagcacccccacccaccgacccacaggccgtcgaacacagattctgtttcttcccttttctggtcccagcagaaccaagggctccatggcatcctgagctctgggaggaggccctgcggaggaggccacctcgggctaggcagactcccgactctaggcggcagggctgcagcagggaccctccgctcctctggctttgggcattgctttttgtggcacttcggaggcagaggccacgtcttgctggagcttgtctcgttctccgtgtcatgcctcaagtggaagagcaggccttgcaccaggttctccatgggcctcagagctatgacaacagaggtgcggaaggagtggtcagggtacaggagcaaggccaactcagcatgctgacccagctcctacccgctctgtcttcagcctccaggggagcctggggcctgctcactgcctcttgtctcctccttgctgcctgcacagcagctcaccatgggcctccggcctgccccagggcttgggggctgccaaccacagattgatgtgtaacatggagtgtgaggaggagtaaggtttgggtttttccttcagtctgggttttgcttcaggtgtcttgaacaaaactccttgtttctctgttaacttagctgggagcgccttccccaacagagaacaccagcagggaacccacctgcataggccttgccattggggtcagattgcaggcttggcttcaatggcacaaccatgatatggaaattacgagtttttgttaaagatctgcaagctaggccgggcacggtggctcacgtctgtaatccaagcactttgggaggccgaggtgggcagatcacgaggtcaagagatcgagaccatcctgaccaacatggtgaaacactgactctactaaaaatacaaaaattagctgggtgtggtgtcgcgctcctgtagtcccagctatttgagaggctgaggcaggagaatcgcttgaacccgggaggcggaggttgcagtgagctgagatcgcgccactgcactccggcctggcgacagagcgagactccgtctcaaaaaaaagaaagatctgcaagctaagcaggctgtcagagagggggcaggtggcagtcccacgtctcaggtcctgtgccgcaatggcaactacaagcttgcaggagaggacctccctatttaagggctacttggggtagggtgtcctaatttcacagtgttgcttttgattgggtgcttcaaataactctggcggcaaggacagttgcacagcttggcaggacgttggggttgaaacagggctctgtagagggacttcttatctatctgggtcagtcttggccagacctaggcagcagcggactgtggttccttcctcactcctcagagacagggttctgagcagaggctcccagagcgctttgttctggtagttatcctgacaattcttgcctgttctcactctcactccttggaataatacaaacagacatcaaagctagcttctgctcagatggctgtagaaaagagagcacctcggaccagagataaggtgacccatgtctctgtggggccagccaggtgggctgtagatggcagtgctgtctcaggctgttcctcagggcccaggtgtgtctgggcggcacaggtggaggaaggacaagagcgctgtgcctgggcgctgcccccctgtctgccatcctgcttcttgtgggggaatacaggtcaagcctattcctggtggagaaatggcctgagggtctcagcggggctgcagctgctgcttcctcaacaccgcacgtctctgtttcccaggcttcctgtggcttctgcaagaacttttgaatcaattctcctttcagccttccctgcagatgtttcccttcaaataaaatgttctgtgactcttcatctgggcttgttttctgcctcccagataggccctgtgcagtgggccctgtacaggccggagcccacactgctcacagggcaatgagaccataccttctctcctgccagcctgccaagcccagcatctccttcctcaaggtcgcgtgtgcctacagaaggctggttgcaggcagcacccaccagggtgagggggctgcacaggcttgtctggcaggtggagaaacccctttcctggtacccgcctcatctggacagaaatactggccccatcagacactcatgacactagaagagtttcctctgagctgttcttttttctccctttctcagcccgacctgctgaatttcaagaaaggctggctgactaagcagtatgaggacggccaggtgagtgtgcagggttgccgtggcccctgagggatctggggacagggtgagggtgagctgtccttgtccccagccagtctgcaagtgctggctccatgccttcctcctccatgccccttgtcttcatgaccagggctgtggctgagactcccatctgctcctagaagtgcaggcacacagccttcatttctgcagtggggggtgctctggaggggcactcggtaggcctgtctgctgatggcaagcgggtgttggcccggccttagggatgccttgtaacactagcccccacctggtgatctttcctaaaagttgtttaggggcctggcttccccagggacaaagaaactctctggctgtgggattggcttgtgtttccatgcaagccagccaagtagacagtagcctagcactgcaagactctcatgccagagacccctcagctgcagtggcagtgttagccctggaaggagcaaacatggtacattcttgccatcagactcaagcaggaagagccatctgaggctggacctgccagcccaccttgaccctgtgccatgggctggaaggccaggcctcccaaggaggcatgaagaaaagcctgctgggtccttacctaagaggccctgatgcctagcccatcctcactcccttcctgcttcctgagctgctatcccaagacatcctctttatttctcctccatatcaaatgcccttggcctggcatgaagactcaagttcccttccttactgctcacagtgaagacttggtctctagctggttagttacccctgctggttaggaggccacatggccatggcttgcgggctgccacctgcaggtggagatgccatttcacagccacctttccgttctgatgggcccagcctgttgtctgcagcctctgtagttactgaggaccgcacggcctggccaccagccacaccattggtcatagagcccacagccaaggcctgctcagctgtctgtgctgcctcttcactggagggtcacagcttagtgagcgtcctgagggtgtgagcgcatggctgcctgcagtccgagcagagtcctctgtatgctgtcaagggaggggccagcctgtcccctgctttccctgtgctctgggagggccccacaggctctggctgcgcaccgccgtggcgtggcaggcatgctgtataggagttggtagtcgagtcatttttcttttcttcccctttagtggaagaaacactggtttgtcctcgccgatcaaagcctgagatactacagggattcagtggctgaggaggtgagtgtctgggctttgcctctgctgtggagacagctggaggggtccaggcggcatctggggctagtagatctgcttccccctgggctaatgtccccacttctgaggacagcgcccttcggtggtgttaccttgccgaaggtatgtccatgttgccctcttgggtttcccagtcccgacctggtgggaaggtgagcacaagaccagcctttgtccttgtgatcattttcctggctgtgatgctgggcttcgtcaaggccttgaattaagtgcccagtgcagtgggtttgggcagcttttcttttctctgttctttgaaaaacactgaaatttgaaaactcaggatgaacaattttgttttttccacaaagagatttcatggtaaatggagttggaagaattgaactacatcttgtgccctgccttctggacaaggacaggataggatagatgagcttttttgggcccctggacagtcctgattctgtggtcaaggaccaaatagaaggggttctttttttcttcacctacaaataaaataacctcttctaaacagtttggcaagtctcctttgccttttccccagtagtttcactccaggaatccctcagataactcccacatgtggaaaaacgtctgtttcaggttagtcattcccacacgtttgtaacagccagatgattggaaagagcctaaatacccatcattaagggccgggatatgtattaaatactctgagccagtctttacagactgaaggagaaaaggtggtagtgataagaagtaggggtaggagagtgtgggcggtgggcctctggtggtgtccagcgttggggaagtaaggagcctatgtaagtgtttggttgcatgtgcatagaagagcacttccgagtgtggtctgtagacctctgggggtccctgaggccctttcaggagagcagtggtggttaaaataatttgtaatattaagatgtcattgacttttttttgcgtgtgaccatctgcactgatggtgcaaaagcaatgggaggtaaagccactagcacttggcacagccccatctgtagcaacaggctggaccagtggtcactggattcttcactgccatacattttaaataattaatcgttttaaaataaataaggtccttgaaagagcagcagaagttactaattttatgaagcctcaatctttaaatgcccatctttttaatattctgtgatttgaaatgggaagtaagcatcgcctggctgcatactagagtgtgcaggctttctcatggaaaggacttgtgtgattgagttgccagctgaactagcagcttcttttggagcaccacgtttacttgaaaaacaactgataggcaaaactgtggtcattaattttgggtgtttggcatatattttcatgaaaatgaaccaagttggctcattcctctaaggaaaacaactgacagaatttgttgccagtgatataatttgagcttccaagcaaaaattagaacttgggaaaatttgtattcaccatcatgaacttccctttacttacactctcctgatgaaataggtggtggtattagcaaaggcgatattttaatattacataatgaaatgtgtagacaattggaagctgtgcataacaatattttccatgtgaccagtacctaatgttacaaaagcatgcctgggttttaatgtaacacagtacagagagttcatgggcatgatttcagataccacattgcagttaacctttaagagcctactgcttgtcaaagaacagccacaactacctgaaaaagctattaaaaatacttcctttgttgtccgggggcggtggctcatgcctgtaatcccagcactttggaggccaaggcaggcggatcacctgaggtcaggagtttgagaccagcctagccaacatggtgaaaccctgtctctactaaaaatacaaaaattagctgggcttggtggtggtcatctgtagtcccagctactcgggagactgaggcaagagaatcacttgaacccgggaggcagaggttgcagtgagctgaaatcgtgtcactgcacttcagcctgagtgacagagcaagaccccatctcaaaaaaaaaaaaaacttccgtattgaacagatggaatgcagaaacaagaatccagctgtcctttctgaagacagatgttagagagatttgcaaaaattcaaagcaatgtgactcttatcactgattgttaaatcagatttttattttaaaatgaatttattttattctcaaatgaacaaatatatttaaattttacatttatattaatatatattttcatatatatttaaatgtataaaatatattttataatatattttaaaatatatttaaatatttttaaattaaaatttttaaaatatttacattttaatttctaacatagtaaataccatcaatagatgaaatccacctaacagaagctcttctagggccaccagtttttaagagtgtgaagggatttcaacagcagcatgtttgaggaccactggcgtggactatctttggctggatacagggacagatggtggtgtgattgcacccagtgaggggcctgggtcatgcagtagtaggatagacggtgtcctcacttgtcagtgtgtatactattaaaagtaaagtcagtgcagaaaatcacttacggaaatttgctcatctaggcattggttctacttcctaaaaatctcaagacattctcacttccctcggcaggcagccgacttggatggagaaattgacttgtccgcatgttacgatgtcacagagtatccagttcagagaaactatggcttccagatacatgtgagtccagggatggaagtggggccacaggcttgacaggcagggatgcatgtcagagtgcctaatgtctgggctgggggcacttctggacaggcctgatgcagcgtgtatggtcagcacttagtctttcccactacccttgacacctctgtcctgtggcacctgaccctattccccaatttgtgatgtgaacagtacattagacgttagtatcttttttctgaagactgcttaaagcttttttgtttctgaaggttccttttttcttttgttttttgtaatgctggagttggggcaattggaaggatgtggggtatggggaataagaatgaaagtgttagtcaattatttacatccgctttttactcacttattcatgtgtttgttcattcatttacttacaaggctattttttcccaaaatcttgtgaggtactcagatgagcaaggcattgcactgttctcaaaaaaaaaaaaaaaaaaaaaatcttattggtaggacaaaatggttcttattggctgtttcttcaaaactgtgtggatcaaggactgcctgcagtcagccagactccaggttaagagcacagtcctcctgactgccacatctgcctccatttctttttttttcccccaagacagggtctcactctctgtccaggcttgagtgtagtggcacaatcatggctcactgcaggctcgaaatcctagactctaacgatccttctacctcagcctccagagtaactgggactacaggtgcatgccaccatgcccagcttattattattattattattattattattattatcattatttagagagacagggtttcaccatgttgcccaggagggttttgaacccctgggctccagcgatccacttgccttggcttcccaaagtgctgggattataggcatgaatcactgtgcccagtcctgcccccacttctgacaccagttgtgagtccggaggtttccaaaaccaccttcagtttcaaaaattcactagaatgactcacaggattcaggaaagtactgtctttacaatgagttttattatagagaaagtatgtaagtcagaaccagccaagggagagccatgtggagtagaatctgggactgggggagtcacagatgccaaaagtttctgcatccttggggacacggtgtcctcttagccctgatgtggggcagtgcgcagagcattgcccggaagcccacctgagccccggtgttgagttttaggaggctctgtagctgctgtggttgatggagttgttgtcctcatagttgaactccacctaaagcccttcccgccatggttggctactttcacatggcccaaaccccaaccctctgatttaatgggtttcctctaatttcctgcttctggccaggccagcctctaccctgagttgtcttgtcagcatgaagtgttaggtggggtcccagggtaccaccatgagtaacaaagactctagtcattcaggaaattccaaggtttggaagttacctcccaggagctaggacagaggccaggcctctctttgggtaaagttagttcgtcactcgcaagggctttaagatgggtggagagtgtgatgagtagagagctgcccccatggggctgggccctggccctgggacttggttctcacacaaggctagactctggtgggctcacctgtagcagggtcataccttcaaattttggggcccagaaactcaattttattgctgtgttgagagttgatccagtatttggggctcactcagtttggcccaacttagaggagactgaagtatagacccaaaggccagtgtgttcatttactaagaaaatcctggccgccagcccactgggctgctggctgtggcttcctgcgtgcaggcatctgcgagaggagctgagtcacagttggaggctacactgacagcctggcaccagggccgggtgtgagttgtctgctcttagtggcctgcactgcccaagtttcaaggctcctctgtcctcatccgctgtgggaggggtaggcgggcatagtgcccggtgagcctcctctcctgccgtccacctcccatcttcatgagcagctttctccaggcagggcacacctgaagtctgagaactcaccccgctctcctagtgacaaatgagggcatcagccactctcacccactgatcaacccctcctcacttcaccctggtagggcttatcctgatgactttcggtgatccccaactactgagagttctaaggaatgaggagatgcttccagtgtggagaaggcttcctgggggaggcttcctggagaaggatccctcaaggctcagcaggagggatgagtgtgaaagcatgtcccagactggactccagacctggtggcacagagagcacagagccagtctggggctagagtgctgggtggagagtcaggttggcgctggtccagcctttgtggagagcactgaagggtgttagaagatgccagtcagttgtgcgttcatgatacatgtctggcgggacatgcaggtccattagaaaggaaccaggctggcacggtaaagctgggcaagaaaggaaggagcagcacctgggaggaagaggtgagggcagggccaggacctggcaagaaggccccgcccactgagaagccagcagaagagctgacttcacagaagcagggggatcccctggaattccggctgtgatccatttgaggcatgatgggctctcagagaacattaggcagccgctgggaaagaaaattcagctggagaaaacagctgtatgtggagtgctgaggccaaactccagcaacgcccacacctgggggtggagaaggatggacccaggagaaggtggtacccccccaactcagctcacatggatatgagaactgatgaaggaggaccgagctgggcagtggtggtgtcttgatcgggcatgtggaggggcaggtcaggtccctcccagctgtgctttgtggcacgtcaggccggtgcgtgatctcctgttttggcttctggccaggccactagcacccatccgaaaaccatcctcatgattgcatcctgccgtcagcttccctactgacctggctgctgagtctgcttgtgagcagctctcggttcaaggctgcagccctcgcttctgttgggcaggtgcctgtaggtgcagaagcaggcctccagctccatgcaggccactggccctcccctgcctggtacccaggcaggtctgctcaggggcgcagtggtcatgtcccagagccatgtgctctttgctgctttgtcctacctgctgccccgttcctcgcccaaaacaggctcctcccctgctaccttgcacaagcaccgaggacaagccctagactccacctcatccaagcaggagtctagggcttgtctaggtgctccccaacccaaccagccagacgctgttcataccccttttgttacttctgagctgccctgtcccctgccatcaccttaattctcatcacttggacagctgcagtaaccacccagcaggtctccctgccttttctcagtgccaccaacaagaccctgataccccttgttcttaaccactccctgggcccatcatgccatgtgcctgtgtgagtgcagactgcaggtgccactccccacgcccaacacacacgcccttccggattccccacctccaccactgctcagcacatgctgattctgcccttcccccgaggctgggaactccttaaagaggggtgcagcatcctcctctgtctgagtggacaggctgctggtgcgtagtgggtgctcagtaactgtgagcttgttactgagagaagataccggatttaccattgccacaaatacacgtccctcccacagctttgacgtctcctgctctccagctccctcatgtcccagtagtgggcacatgtggcactcctagaagggtcacccagtcacagcctttctccctgtgggactttacccagtgcagggagcttctttggagatggagggcagcaggcaccctaggggacagtcactgatggtgcctcatcttttctctgtagacaaaggagggcgagtttaccctgtcggccatgacatctgggattcggcggaactggatccagaccatcatgaagcacgtgcacccgaccactgccccggatgtgaccaggtaggatggtgaagacaccagggagccctttgtgcctcttgtgggtgccactcccgccagggcagtgtcagactcaggtctgaagtctgagacctgagctcagtgcatcccagtctgctgctccttccttcctgtgtccttctgttgctcaggttcctgtcccaagtaatcagaacaaacatttctggttcttttctcttgtaagcccaagcgtttcatcttgcaggtagcatgtgtgctggtcattagaactgggctttggtggagaatcttccatctgtgtcagcaggcacttggccagaccagcctgagccccgcagtcggtgctctcaggccttgggctctgctgctctaagggtggccccatgtgcggcatccataggccacccagtgcttctttgtcttggccttcttttcacctcactcctacgtctgtttgatttctgtgcagccaatttgaaaaaccctctcctgtttttgcattctgtggttcatgtgtctcagattttgctttgggcttttttcctcctgccctgaaggttaaagacctagttctcattttaaaagatggagaatcagaagactcagacatatctaaaacaaaacaaaacaaaaaaagcagagaagattccagtgtgggggctggtcctttgatggccagaactctgctgtccccaccttcagagcctccacgcatctgagcacctctggtgccatttctcaggtcatgtgatgtagattacatctcgaatgtgtttcttgtgctgtgggttaggctgcttgggtgtggcaatgtcacagcgggggctgtccatggaagctttgacctaaaagcgtgttcttttttttttttttgagatggagtcttgttctgttgcctaggctagagtgcaataacgtgatctcggctcgctgcaacctccacctcgtgggttcaagcagttctcctgcctcagcctcccaagtagctgggattacccaccacacccggctaatttttgtatttttagtagagacgggatttcaccttgttggccaggctggtcttgaactcgtgacctcaggtgatccactcgccttggcctcccaaagtgctgaaattgcaggcatgagccaccacagccggcctaaaggcacattctgtatccaaacctttgccttcttcctgcggactccacacctctttacataagaaggaaagaactcctaaattgatttctttatagtcctcttttctgtgtctgtcatttgttcatgacttcatttattaaacaaacactgtctagtaaggccaagaggccgtgaccgggacaggttgccctctgtctctcaggatcctatgcagagagctggcttgttgtctagtgacaagtcctctttgtgcacagccagcaggaggcacccagagctgcagcaagctctcccaccctccaggggccacatcctgtggtggcctcagctactgcttccatggctctcccatcaggagcagacacccaagcttgacaagctaagtgctcttttccaagcacctttaggaagccaccagagcaaagtgagaaaggcctcagcttctttgcccaagctattggcagcagacagagcttatcacgggggtccaggatggggagtggtgggcagtgcatatgggtagctggcctgaggtcctctcctgcccctcttcccagccaggcctgggctcggtgctgtagattggcaatcctgtctggaagaagtcagctttgggatgtcccagggcagatgtcaggaatgcacctgtgcacatgcctgtgcctgcacacagctcaggagaggcgcctccacgcttgagtgcctgcttccctgcgtgcaggggctatgggcccaggggaatgaatgaggagacaagggtttggctctcacatgaaagttgacctggcagttggcctcctgactaagaattacttcataacctagcatatctgcatagtctggtagagtgctcaccctccaccagtttgttttcagcatttattcttcctctgtgtaggcttttattatttgaggaaaaatgtgagttttttagtgctgccaggcaaaatctcaaggaggcatgaaaacaaactgcagtctcagaagctgctgtcctcgtcctgctctcatcgccatcttgaagtcctggggtggggaagttgcagggtgcttcccgcctttggcactagaggagccttgtggggaggtttctcctagggagtgcggccggttctggtgtggctgtgactttggcggctgtcagggccaggctgggggcctccatgcatgccctgccctatgtgtcatcctgacactctccatggccaggagctcttagttcagtgacgtcacaagatctgccctgtgtcgttttcatccagatgttagcgtgctcttacagtggacacctgcagatcctgttgctgtgaagcactttgcctctcactcgattgctgcctggacaggtgacccttgctccaggtggtgacggcaaccatttcctcttttccttggttctctctctaaagactcctttccttttggccctaattgaaacacatgtgctccctggagctcctccttgggccctcactgtcctcaggtgggcttgcaactgccttctgagggcctgggtgagattaggggcccctcagtcagcctcggaccagctggcagtctgtggggcctatctctagagtctacaaacctttgcctcaaacactcccagcctccttgacaaattgccatcagcaatgtccctgtccctgccctactgcagacgaggcctccccaggaatctctgcttctagcagatggggactagacatggattcctcaggcagacctggcttcactccacttactgcagggcaggtagcagcaccatgagcacgacctgcgcagctcatgtcccgttgctggctgccgcttgcctgctcaaggtggcaggtaacccagtgtccttctccccttctgccttcctctccaagcctctggctactgcatggtgtgaactcgtggccacctgggcctcctgtttccctcacccttaggaggtcccagtctttcatactgatccatctgtcatgccagcagctggattgggcttttaaaacatagattcaggctgggcacagtagctcacgcctgtaatcccagcactttgggaggcaggcggatcacctgaggtcaggagtttgagaccagcctggccaacatggagaaaccccgtttctactaaaaatacaaaattagccaggcatggtagcgcatgccggtaatcccagctacttgggaggctgaggcaggagaatcgcttgaacccagcaggcagaggttgtggtgagccgagatcgcgccattgcactccagcctgggtaacaagagtgaaactccatctcaaaaaaaaaaaaaacaaaacatagatctgatcacgttacctgcttattaaaaggtaagcccttctagaaagtgctagttttccctcattctgtcaccactgtccagtccaggggtgcacagggcccaggcctcacctggcaggtacggtggctgtgcccaggtgcagcctaatgtagttcttggccctgagcaaggcagggctggcccgtcctgcctctgaggctgtgggagtcctgggactcccctggctccataccctggcaacgggaccaccacagtgagcccctcacagcctcttcagtcaagggacccccccagtgtcattatgtgggaaacctcagctttctgaggctcttttcccttcctttccccttcccctccccgtccccctccccctcccccactcagaaccagtttgggaagggatgtggggtaaaggcagagtattcctgtcctccctgcacttaggaagctgggattaggatagaaaaaggatgtggtgctcacaggggctgggttgtggctcagcattgccagcttctgcctggcaggccacaccagagccgcccctgacaggctatgtccatcctcctgccccacagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggaggtaatagcctgggaccagatccccaccctgctcccagcagcctttccagagcatcagctgtgcccagctgtggcctgaggggttcatctagacagtcctacccgcgagggacttgcagacccctaggggagacagacgcatagatgagtcctcatagttgaggcagacctgagagctgtgggagcgtgccagtgcatgcagggcagggaaaggggccttccaggcacagaggaattcttccgatggtgggggcccctgccattgagaggcaagcggcgttgcagggcctagatggtttcctcgttctgactcccgatggcaggaggggcgcgagcagggcaaggcttttgcattacgcagccctggcttggacaggtcaaagctgtaggcagagaccagccccaggtgctcttacagtggcttggggacggccgatcagatctgaagccaggggcatccagcaggagatgacagctgggtcctaggtcatgaggatatgaagcagaagacagtggtgaggcagggtaggctgtggatgaaggctgccctgtgactgtcactcctccacgaggccttcagtgcacctaggtacatagatgaacaagctggcccccgaactataaaataagatgttctttcatggaaatgtatgcagaaatccagtctgcagaacttcagtggtagattgacatgtctgggcagggagtctcgtagctggggaggtgtagcgttacagtttttgtagaactccctgtttcactctccatttagggacagttttcaacactgtgtttcaaatgtgttctcttacgtaagtagcttgttaaagatttgccacttgggtatgcctcaagcttctcatcttttttgtattttattaactgtatgaggctgagttaccaccagcactaatacttgtactttttcattttcctcatccattaacaagtaacaaaggcaagatgaaataaaataacagttgaaactcacattacttcaggctaccaaaatgggccagccagcaggcgacacactggctcaacaatctggggggtcagtcttcactgtttaaaagtcaggggtcggctgggcatggtggctcacgcctgtaatcccggtactttgggaggccgaggcgggcggatcacaaggtcaagagatcaagaccatccggccaacatggtgaaaccccgtctctactaaaaatacaaaaattagctgggcatggtggtgcattcctgtagtcccagctacttggaaggctgaggcaggagaatcacttgaacccaggaggcagaggttgcagtgacctgagatcgcaccatcgtactccagcctggcgacagagcgagagtccatctcaaaaaaaataaataaaagtcaggggtctccccgcctctcacagcacagtctgtcagcaccctgggcggcactggcctgactgtccaccacacacacagctccattcagcacgagctctgggagcaggttgggtagccctgcacatggccaggcatcaggaggcacctgggaggtgtgtagggaagaggtggatggatgaatgagtagctgaagctgttgaaagcaagaagagtgtaaaatagcttactcatgggtatccacaccttgtttgagggaactgcgggaactctttttgcaaacagaactttgtggaatccatcatgtaaagctggtcaaatggagtggtttcagttgagaccatagtgggccctggagtgaggcctgcttggggccaccactcacagtggtccctgtagagcctagcctggcctgtgtgaccagctgaggacacccaaaggaccccatggggtgcttcctccagatgcagatgcaaaacccttgttccccagtggacacattccccttctcagaaatgaacaccccgtatgggccttggcacctatatagggcgtgcatgttggaaccttgagcaggtgtgggaagtatgtgggcatccaggggtgcctggagtagggaaggacaaggtagtcccttggtgcccataaggtaccaagtctgccattgttactgatggcttgcattggaaccttcacttccaaatgctgctggtaaaggccatatcagcacatctgctgaaatgtggagactccaaaactcttgggccacatggaagaccagtgaaagagtctgtgctgtgcagctgctttgtttatcattgtcattttgcataaaagtgtgtgtctttttgccaacagctggagcagagccagaaggaggcctcagaccttctggagcagaaccggctcctgcaggaccagctgagggtggccctgggccgggagcagagcgcccgtgagggctacgtgctgcaggtagggtggaggggctgctgtggcccatggtgcgctcaggagcttcagtgtgaagggttcatgctcaggcaggctaggagtgtgcaaaacttggctgagcaggggtgtctcccaggagctcatgcccctgggcttttctgccacaggactggacactcaatgtgcttgggggggtctgtttgtttttccctcctgatatgacattttggggaatctccctgaaacctctatatctaaggactttttttggtaataaaatgattttggtgacctttccctttgactctgaaagtagccaatatacatttattgtaaataccatacatttgcatgtgatttctcatagttttcactatagtaatattggacctattgtacagattgaagacattgaatcacacagcaagtccagtgcctgcttacaaccaacagcaagtcagtggcaaagctagtactggaccccattcccatctgtttctataccacacctggcaggcagagctggggctcttaccactactagcccaaccccgggatacctccactgagatcctgtaccacagagccctgatataggggtgtcacaaggctggagctagcctggcccaagggcgtgcctatgtctgctgactttcctgcagcgtgccaggccttgtgccaggtattgggcataaaacagatatactcttgtccccattgagtggtagaggagattgtgataggaagattgatatataaatactgcaggagaagtgaagtggggtaccagaacagggagcctaagttctcggcaaaggctgagggtataacattagaatcaaggtcctaggttcaagacttggccctgctactgacccccaaagcaagtgcatgtgtcccctcctctacagcggcagtctgctgcctgtgtagacttagacccagtgatccctgagggcccttccggctcttagaccccgagtctctgtcacgtattgtctacatttgcagaccgcagtgcgctgaccttggtctgagttgtcccaggcagcagatggaacaggggcactcagctggcctctgaccatagtctgcctctttgcagactctctgctgtttcttctcctgtgtgctccctgggccttctctttctttctgccccacatgccctagactctcctctccagcctcttctgccatagtcattgccatgccctgttcagacctggtgaacagggcctccctgtgggcctccctgccaaggtcatttgcgcttgccctccaggtttgaggagcatctttttaattcttgattgggcctcatcctataagaactggcttcaaatcaggtagtaaagataaaagttcagcatcccaaattcgaaaatctgaaatgctccaaaatccaaaactgaacgctgacattatgctgaaaggaaatgctcactggagcatttcagattttggatttttggattggggatgctcacccagtaagtagaatgcaaatattttaaaatccgaaacagttcttgtcccaagtattttggataagggatactcaacttgtactaagcagcggactttgcacattgctaacctaggaacctacctctgtctaacttgcataattgcatgagcctacactgaagcccctgttggtcagcactgggcaaagctggtctttaataccttttccctaagtctaataacctgtgacttctcaccaccctttatgctttggaaatgcttttaatcacgactcagaatgagcagggggtctgtggggttaagggtcaggagccagctactggggtgggtgctatactaactgctgggaggagcttgcatgatttggacattgagtgtgaagtgtaacttgaacttaacataactgagtgtcacatctgtggcttccccggccagcagaccgagagggagccataggcaggccagattcttaggctgggctcggctcactcttgtttgtgttgtttttccctatattaatgagttctgtctctgcatgcctttcagtgtggggagttttgtttcatttacgttgtgttttgtttttgcatgcttcactttttcttattttgaactccacaaaggtttgtttgttttgttgattattgtatcttactccatggttcccgttcccccctcgttttgacttcttacaggtagagattagttcttcctgttactctagaggactgactacactttccacaggaaaatgtttggatgtcaccttgctgacatctcccgagtgttaccttccttccttctcctcctgtcttagaaggaagtggcatcatttacctacaccttgtgtcctgcgcttgtttaggatttgttgtcaagactgcgtactttttgttttgtgaaacaaacagctgcaggtgctgtgctcctcccgcctgtccctcttcctggcgctctcttgtcctttagtctttgttttgcttcttagtgtgttccattattcagttttgtttggtttatttctcctagaagctgtttggttaaagctgttttctgatgttattgtccatgttttctgtttacctggaagcagctacttactaaaaaaaaaaaaaaagaaaatttgttggatttttttaatgggaaaaaaaaataaagttgtacaaaggataaaagccaaagccatcaaggagctttctgtggttgttcctggccagaggtgtgacactcagaactgggaggcccgagtgttactaaccagtatttaatcggtttttttaagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccgctgagctagccatcaaggagcaggcgctggccaagctcaagggcgacctgaagcgggagcagggccgggtccgcgagcagctggaggagcggcaacacagcgaggcggcgctgagcagccagctgagggctagcgagcagaagctcaagagtgctgaggccctgctgctggagaagacgcaggagctacggggcctggagacacagcaggcgctgcagcgggaccggcagaaggaggtccagaggctgcaggagcgcattgccgacctcagccagcaactgggcgccagtgagcaggcgcagcggctgatggaggagaagctgcagagaaactatgagctgctgctggagagctgtgagaaggagaagcaggcattgctgcagaacctaaaggaagtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacccctgaagagacagaaagggatggcactttgctcccaggccaaccagtccaagccactagggcacctctaggcctcccacacacaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggtcttaacgccccattcaatttgcagagcagatcttccttgataatggggtgggtgtggggacgtctggctcagctaccgtgcaggcagaattgaggggatatgctgctgtccctctacttgctagccatggtgtggtctcagcagggcctgggccgcaggcttagcctcttgttcggcatcccccagtgtcctccaccaggaggagaactagcaggagggccgccagggtccctggtgggagaggagcacgtagtcttcccagcacttccctgcctgcctaatgcggcctctccgtgttcctgagagcagcccccaatccccttgccagccttgcctccttcctgcccctgccccgggaaccccgtctggcccagtcccagcccaaatctgaggcagctgcctgaggacagccttgtactcacagcaacaccccggagagccagggcccagttggagggcagtctcctcctgattgccctaggagagcacagtcgggcggagggtccctctctggaactggcatttgatgtgtgctctggtgagaagaactttcccacggagcacagcctccagccactcctgtccccttccccaggacctttacaagtagattttccccagaactgtcctgcatccccgcccctgaggtcctggagcacaaaggcgaaatgccaggccctggaggtggtggtgggctgagtggaggcccagctgtctggccccaccctttgtagctgcaggccacacccaccatgtgtggctgtcaagcatcatcccttagactcaaaagtttaccatgatacctgtgcccttatgttccttccactcaggaagctgccccagtaaatgactaggatgactaggcccctcaaaagccatgttcaggtggtgccttccacgctcatgtggcagagccaggcgcgcacacagccagcaccattgtgctgcaagctcctgactcccaggtggctgccactgctcctgcctacacatcctcacagccactgtctagcaggacacctgtttttcccagcccgttactcctgtagctctgaatggaaacagcagctcacatgtcacctctgtgtgacggactcggccccacccagacacacaggtgtggttgtcagcgagcacctcaggagaactgagaagctctttttcaccattctttccccaaatcagtcaaaaccttttaaaaaccattatgagttgtgagaaggtttcaacagctatgttttcaaagtgtgtgtatatgatggcactgtggtcagttcaccaagagcagcactgagatgggtggatccaggtgcaccttgaaaagttaattgcacaaacctttgctttgaccccaaatacgcttgctagtgcccttccctgcagcttcccagacaatcagcagggtccatgggggcagggcctgggcacagcaatgccctgcttcctgtctgcatccataagaggcccctccacaccgaggctgctttaggttagccaaccaggtgcaggggaggccccatgcaggtgccattataccaacagtgagcaagaaatcagaaaaaagaggactgccttatgttgagaactgaccagagattgtgctgggccagtgtcactaggagggagaaacagatgatgcaggtcgggatgaggcccctcccaggggcttggacactgtccactccctgctgccttagctgccgttgcatagtgtcccctcctgtgcctgggagcttctagcccaggtgtggtgttctcacccacccctgcagacttacagaacttgtaaatagacagcaccttgagatttcatcactttatgcagatttccacttgggtcgttggggacagggtcttggcctaacagccgtcctctgacatccacaggctcccaccacaccacgattgcagtcatcggggaacttcttttggtgtcaggaatgattggcttaaattaacatttgtttgcaagatcaattattttttagcatatagtttctctccaaagaagcaactaggtctttaaagatgtcccagtgcttctgttagatttttgactcttacctgcataatattccaaagcactcagatcaaaataagacttttcccagcaagtagactcaaagaaaaaaaaaaaagacttaaaagatctattaatactagttgtgctcgttttagcagcatatatactaaaattggaatgatacagagaagattagtatggcccctttacaaggatgacacacaaattcatgaagtattccatatatatatatattttttttttttttaattaaaaaagacctattagttaaatgtgttaactgagaagccacatacaaacagaagcgagtgggaggaagaaagaagagctcaaccttggggcctgaggaccaggagctccagagctccgagctcctgcagccgtcctgaggtgtgagggtggcagaaagagacagatgcttccaggtggagccgctgggagaggggatgggacgcctagttaatagtggcaatagctgagacattcacccagagcagcacataggttgcagtcaagtccagactgaccacgagtttggaaatactgcctgaggctctcagagttggccatcaccaaaagtgggcccagagaaaaatgcccaggcatgctgataggatttcttggtatcctttcttgaatccacatgcaagaagattaaccaagtggtgcaggctatcagcccagagtggggaaacccccacacttgaatttggaatggaatgtggccacgttcttccagtttttaaaactcagcgagaggcccagtcccttctctgaagcagaccacttgaaggatttagacagaaagtgtgtgcctccgtgctcaaaatagctgcacacccacccttcccggcagctgtgcagcacgctcacctgctttgttagtgagcacagctctgataaccaggcctgggcttcctggtgtggcttgctcccatcctggggcatgcctatgtcgctctagggaggcacaggagagtttggaaagcaggtctcctgtcatgtacttgttagagttagcagaggtgctaagtcattggtgcccttctttaagaaaagagtaagaaagaagacacaggctagaaggaaggggagcctgtagcctgatcttactccctcagtcaacacctgagcattaagtgaccagctggaggttgtcagctggctagtggcagagtcccaacccccagctcccagaagtggactctatgtacccccaacccactgtgggttgagaggctcccagcccggtgcccgccaggccactccctatatgtggaatggccttggttccctccagcagacaagtccctcatccctgttttacgggcctttcaccgtgtccctccagaccagacacagccagcctctgcccacgtgctctctcttccttcctgtgggtcccacctggcagcaacgcaggaaggtccagggttggctggtttccatttcatagcagcctgtccccacctaccataccaacttctcccaggaagaaatggggcacagtacagtcacagaaataagaggtagagttgactggtaacacccttttctgaatgctctgatggcattgctgagaatccccagacagccccagggatcctgttcagggcgcccatggtggagcaagctcagtgaatgcccagtcacagctgggcctggacagggtgggattcctggctcctttatttaaaagggcccccaacttagaggtaaagaaagaagtcgatgaagtcccttttgcattttgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcaggttggggggtggggtaaccctgagggcagggtgggtggccagctttttttgagctagacacacaactcagaggaatggcagcctttaaattgccttttggctgagatgtaaacttcattgttgaagggttctttgactattcactctgaggcaaaggccaattttaggtcccttttgagagcttgtaaactgagagcgcacacttcgacccctgacagccccgtcgtggccggctgcacacaaggagctgtcccaacctgtgactttccagttccaacaagtagactgaccagtgtcagtccagccagtgactttccccctgacagacacctgtcaacgtgggaccacctctggccagaatgcccctgccgtcagcgtgaagatatgtagcttcaccggcaggtggccctaaacaagcacgtcccctccgccttgtgctgccttccctttatgtaatcgccacctcagtggtttgttaatttagttccaaggaagaaaatacaccagcacaaaagcttgcttgttttataaactcatgttggaatttaacaatgacatttatttaatcagtttggttttcttctaacaccaaaaaaaaagccaaacgtgcattccttccagggggagttcatgaagaattctcccagcctgcacccacctcagagaattggttcatgaggggccagcctgtcatgcaaaatccaactgctgattgactaagcaagcatcagcagtggcaggcgccatcccattgtgtggagctccccacccccacccctgtcagcaggaagggcgtggtccctcggtgctgaggccgtgtccttgcctgcagccatcgaagccatgaagaacgcccaccgggaggaaatggagcgggagctggagaagagccagcggtcccagatcagcagcgtcaactcggatgttgaggccctgcggcgccagtacctgtaagtggctgggcctgcccatctgcccttgggagggcccctctggggtgctgaccaggccacagctgggcccttcctgtgtctttgcagaggcctccagaagtggggcctggggcccctgggtgctgagggcagctcagatgccctcttgtccagtgcaggatatggcccaagtggggcctcctttattcagagagactgttcctcgaaatgccaagaacgagatgtaacaaacgaaatcttaaactcccctcttgtccagggctgatcccagcaactgcccagatgtgttcttcgacagctgccctgctagcccaccaggagccaggcagccgggcttggtcgtacagggcagaagtgagaactagcactgtggtttaaaaccacacgtgctgattccctctgcacaggcaggatagaaaaataccagaaaaactgctgtagacttttttcacttggtagaattgacacagccagaagcccacagattggccaccatgagcctcacggcactcaggctctaccaggagcctttatagcatagccgaagccaggggccctgcctcaggagctggcagcagtcagcagcaccctgtagaggctcacgctgaccttggtcagagcagggtggcccacctggaagcccctcatccctggttcacctgcaggaggacggccctcctggatccagggtggcagaacagcctcaggaagcttgggtttttgggtcttgtgtagagcctggtcctggctgtcagacacagatggcttcaaaagtgggtttactgaaaacaaattctgagtcagaagagagttctagaaatgggggttctgtgtggctgcagactggactctgtcctgactggcatccccagagaagtgctagctgtaggactgtcagactgtgagaaaggaccagggaggggcgtgaggccatctctgtaagggatcccttactctgtatgacccaggctgattaagacaacagactgtgtgggcctgacctgtgcttggctgtgtctggtgtcaaggagggacaccggcctctgagaggccttgtccagaagcaggcagaggagtgagtgctgccctctccccagggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggtgagcctgcagccaggtgagcccaaggttagtcaggggcactcaaggtcaggtagacccatagtcaggtgagtccacactggagctggagccaggcctcaccctcaaagtggcatgaaggtccctgaaccacagagtggttacctgccccagggcttctccctgccacccagcgtggccatctgtgttgtcagaaacatcaccgcggatagctagagcaacgctgtactgccacgtgcaccacctgcttacacatgacatcactcttgctttgaccctttctgagactctcgggtgtcttggtgtcttctctgtgctcctctgaacctctggctcactgtttctgggcagggcctggcagggtcatcccaatcctccaggatcctgtcccccagggattgagctgacacttctcagggtcaggcttacggctcacatttatttttgtcagattttttttcttaagatttgcttgctctgtccgggcgcggtggctcacgcctgtaatcccagcgctttgggaggccaagacgggcggatcacaaggtcagggattgagaccatcctggctaacatggtgaaaccccatctctactaaaaatacaaaaaattagctgggtgtggtggtgggcgcctatagtcccatctactgggaaggctgaggcaggagaatggtgtgaactcgggaggcggagcctgggtgacagagcgagactccgtctaaaaaaaaaaaaaaaaagatttgcttgctccttagttaattggggtgcatttaaatcctggctaatggaaaggttcaagccaggattcgttcaatattggcttttctgtgggcaccaaattaaaacagccctctatgaccctgccctgcacaaacaccccctggggctgggaacatagtccctttctcacctgaggccttcccaaggggcatggctgctgcacagggctgtgtatgaggctgctcaggcaggactgggtccactcactgctgctgtggcttaaagattaccccacaggagctcagatgggaccagccatggaacagattgacactagttattgtgacagaaaggaattaagggttatcgattggatcctgcctacgcagttccacagatacacaaagaacctagggaaatggccttcccgggttgtgtcatgcgacttggccccaggcagctctggagtgtcactgttgtgttgctgtcccccaggagctgaacaaccgcctggctgcagagatcacacggttgcggacgctgctgactggggacggcggtggggaggccactgggtcaccccttgcacagggcaaggatgcctatgaactagaggtaccatcaggagccaggccctgcctgactcagctctgcacccaggaaccccaggggagtgcagcatggcccctgtcttacagggttgtgggaggaacagacctgagacagcaggagtcacagggtccaggaagatccaaatcacccgaaggcggcgaggagcagtgagctgccaggtggcatgagagccactagccgagtggagccctcgaggggctgtggggatcctgaccccatctcactccacccactcccctccatttctgctatgccacaaacactgaccactcaaaaggacacgttctgtagccatgtggctgctgcagctcaggtcagggaggctcgctttatgttagaatgatggattctggagtatagggtgtccttttaggaaggcacttagatttctccacattcaattaaaatttcaccctaaaatgtgctaaaatttcagcactcagccagccagagctcacccagctgggctggttctggtggctttgagctttgtctctgtcgtggagccgcctcctggcagtgacactgagaggccaaggctgggagggaccagtgcttggtgtgatcagctcctgccccgagtccaggtgttgggccgctgtctgctgtgcctgtgccttgtactaaatgagtgctttaccaaaagggcgggcaagagaggctgagtgagtctgacacaagtgtcagtggtaacatttcctgattctcgcgggcttggtccccagagacaagcaggtctagttcacagcaccccaggctgaggagggagtccttggcactgggaggaatcacggccatttccttcctcttcctgtttctgtatgtgaggctgaagctgtgagcggtgtttaaacgatgcttgcccgcattgggcaccacgaggctgccctgctcactggtgattggagagccctctgcacgcttcagcctgctgtggagactctggaggtttctttgctcctgaatattggtccctgatctctctgtcattttaggtcttattgcgggtaaaggaatcggaaatacagtacctgaaacaggagattagctccctcaaggatgagctgcagacggcactgcgggtaaggccaccgcaccacaggagggcgggtacgggaacaggctctaggtgacatgcgcctcctgaactcaggctggtgctcagcgcgggctcttctgaagcagattttactcttgtgaggaaggaggtttccaaaatcaagccctcttaaaagaccagcctgcaggcaggtgctgtgggaacgtggacatgagcaacctgcctggcctggctccagcttcagtgtgtatgtgctttttgtgtgccttgggaggaatgttccagagaaaaggcctgtgaagtgaggcaaggcttgacttccatttgagccgccccctggcttccaccagcctcctccagggactcctggagtcaggggagatgacagaatcattggtggtcactcagtcacctagggaatctaggacacagagaggatttccaggctgaagcccacaagggaggggcctgggcactcagggccacaccaggctggtcgggcaatcccggaactgcctcctgcactcaccgggcctggagattatcctgccatgtcctgatggctgtgcccgtgtccttaggccccgtggtttttcctctctgtccactgtctgcctctagaagacagaggtgaacaagcctcctcttccgcccacagcaagcctccctaccgtgttcagtccccaggaagacaggccatgttgtatgtgctcctctttcctggatgtaactaccattctctgtcatttcactcccaaggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatggtgcgtcctcgggtcatgccctctcggttattgctggggggcttatgggggtttggtcgtagaggtttcccggtgcttgacttgaagcagaagagtcccagtgatgcttgtagacccaggcatcccagtggagcaggagcaccagcttcacacggctgccccagacaggccttgctctccccatcgcagcagtggatgctgtgctgattgctctagggagaacccatagtatcagcataatattttcgaaataataacaagtcttatttttctaaagaactcaaccactgggcagaagtagctctcactagctgcttgatcctaggatttgactataatatctgtaaaaggccatagagtggagaatgggagggagctccctgctttctggaatgaacaacagaactggccctttttttcttggctaaaaacatttaggtaccctgtaaaaaatagatggcaggaaggatgaaagagttaacattttatcaagcattttcagctcatacgtaatttttttttttttttttttgaaactgggtcttgctctgttgcccagggtggaatgcaatggcgtgatttcactgcagcctccgcctcccaggctcaaggattctcccaccttagcctccccagtagctgggactacaggagtgcaccacaaaacacctggctaatttttgtatttttagtagagacagagtttcaccacgttgctcagactgatctcaaactcctgggctcaagcgatccagccaccttggcctcccaaagtgctgagattacaggtgtgagccactgcacctggccagattatacataatttcatttgaccttcatcttgattttttatacagagacgcacaaacaggaaaagatgtgctagctcactaatatcaaaaaagaaaaaatcaactttttttctgtcaggcaaggaatagtgattatgtactgacagatgctgggaggaagacttcatttttccataaataccttgagtagtcaggcttggtggtaggcctggctacccaggaggctgaggtgggaggatcacttgagcccaggagttctaggcagtcacacacaaagctaagtcgatcaggtgtccacactaagtttggcatcaatatggtgacctcctgcgagtaggggatcaccaggttgcctaaggaggggtgaactggctcaggtcaaaatgaaagaggtcaaaactcctgtgctggccaggtgcagtggctcacacctgtaatcccagcactttgggaagctaggtgggcagatcacttgatctcaaaagttcaagaccagcctgggcaacatggcaaaaccctgtctctacaaaaaatacaaaaaaactagctgggactgctggcatgcacctgtagtcccagcgctacttgggaggctgaggtgggaggatcacttaagcccagcaggtggaaatggcagtgagccatgattacactgctgcactccagcctgggtgacagaatgagaccctgcctcaaaaaaaaaagaaaaaaaaaacctgtgctgacctgtggtggaatcacacctgtgaataggcactgcattctagtctgggcaacacagcaagaatctgtctcttaaaagaaacagagggcgggcgtggtggcacccgcctgtaatcccagcactttgggaggttgaggcgggtggatcacgaggtcaggaattcgagaccagtctggccaacattgtgaaaccccgtctctactaaaaatacaaaaattagctggacatggtggcacatgcctgtaatcccagcactttgggaggttgaggcgggtggatcacgaggtcaggagttcgagaccagtctggccaacattgtgaaaccccgtctctactaaaaatacaaaaattagctggacatggtggcacgcacctgtagtcccagctactcgggaggctgaggcaggagaatcgcttgaacccaggaggcagaggttgcagtgagctgctgagtttgtgccactgcactccagcctggcgacagagcaagactccatctcaaaaaaaaaaaaaaaaagcaaaacaaaaaaccccacacatgcacaggatgtgtgatatgactcagtatctgtttgtgttacaggtacttaagtagacatttctaagaagcctaaaggactgctatctgggtgggtggacaatgagaaggccttggccttatcatcttgctttagacagccctgtgctaccaggaggaaggtagagaatcatggataatgggggtaggggtctgctcagcattgaggtcccacaccagagtgaggggaccaagtccctttgaagggaatgctgttgtgggctacagtcacagtgcaggaagccctggcggggccccacatacacattctcccattgtgctggtgttttatggtggtctgaagagatctagcatgttttatggttattggctttgaattcccttagagttgtttaaggaattgtcctaagtatgctgcagtaggaagcttgggaaatgtttcaggatttagtctggttccagagggttttagaaagcaaaggtaacaggtctgtttgttttcattatataccgcagatataatgaaatctaaaagcaaccctgacttcttgaagaaagacagatcctgtgtcacccggcaactcagaaacatcaggtccaaggtgagtctggggtccagccccctggtgggaggggcttgagggacactggggagagtagcccaaattgaagtatgagtgctcccatgggccacagctgccaaagccccagggcccagcactgagccagcccgagctcaccctgctgggctggttctggtggctttgagctctgtgtctgtcttggagccacctcctggcaatgacactgacaggccagggctgtgaagagcagtgcttggcatgatcagctcctgcctcgaggccaggtttcacccagccctgctcatgtcggcctgctgtcagctgtgcctgtgttgttccttgcacatcactgttgtgacactggtgccgcctccaagagatgatgctgcctgctcttgttccccagccaggaagcagtacatctttagtgtgctgtccagagccagccatgcacaggagggcgggcggaggtgggagcggcaccgcgtgtgtttgggattggttgtgtgtctcatgtctgctctctcctctgacagtccgtaattgagcaggtctcgtgggatacctgaaatgcacccgcttcccggcccatgcaggaggtaaaccgcctctcccaccgcctgcatgcactgctcacacccccatggcaaacgcctgtgtcatggttactttatttcaattcatcctgctccaacaaacacataccaaatccaagtgaggtttctttaacctgctctggggagttaattggcactctaacctcttaacagagatgaccctggcagtgaggtgctcctctagcctggtgggcaggcagagagccaggcacccatcagcatgcatgttggataatctgtgcacaacggctgaactcactccaccccctcaggggacacttgtcttgccctctgtcacgaggtggaatttacagatgtccacactggcaagtgaagtctaccgtcaccaaaggcctcgcccacctagtgagccacttagtggcctctgtctgtcaaggctaacagggtggtcattctaggaatggataaaccaggactagagcttggtgaagatggttcagaagagcgtgataactacaagcaataggggcgaaatatttaccagtatttttttttttaataaaacaaaagcttctcactaggtgccattgaaggccctatgccagagaggaggtgggggagggcccatggtgggagacaccctgagaatgagtagttgccggctcagtagcttgatctcgttcatcccggaatgagaacatggaggaaagcaagaaccacgtcttcctccccatgctggccctttctcaggcacacccacagcaccccgccgtccgaaggacttcatcctgaggcttggttaaagagttgaaggttttaagcctagtcagtttggttttatttttctacagttctaagtcccctatacccaaatatggtttaggcttgattgaaaacttagcttgggcatttttctttaaacataacgttttgtttagcaaaaggaaacttgttcttttttggttcacggttttcttactgaagattctactacttatttgaggctaaactgtagctagtatctttgagcttttcttgaaggagtttgaagttcactattagtgatttgggcttttggaccatgtctataagtgacatgggaccggctgtcactgacaggacccttccagggaggctgtgcaacacccacgggcccctgacagtaactctgtgcagtgagtgggtgggggcctctcacagtggctgggaaccagccagagcagggatgagggagcagactgtctgggccccagggcagactgaaaaggatggagagaaaccccaggatggggtcctcctccttatgtgtttttaagttgatgtttggcttggctgggtttccgtaataaaaatccttggagtgcagggctagtcctgctggccccagcagaaagtcgaggacttcctagatgtctgtggtgcaacagggcaggatggggccgtgttcgcgctcccaggagacattaggaggcacaggcatgggtgggtgtcatccttttcctcaactgtatctgaagactccacccaacccttcaagaagatggaaatgcagttgcccagaaaccgtacttctcagtggtgttttttgatgtggcatctgatgtgcactgatctgtgtcttttgttctgttctgtttttctgtcctgcctcgctcgaaaggaccgcaagtctcagctgctacaaaatcaaagacagcaagttgcttaggagcagcacagccttttctgggattgagaccagagaatgcttccctcggggttcttaaggggcccccgtgtctgtggtcagctcagtatgtggggctacaggaggcactcagtggagacaacagcctagggggagatgaaccccagagggagctggctgagccttgggctgagcagccaccgggagagaatccagaggacgtagagagagaaacagcctcctgcagccagtgtgggaataacgtaggggatttcacttacttcccacccttggaattgtagcaagcccagcatcacctgagcctgagctctgccctttgtcactggggcaggagccagtagcgagcatgctgggtgctgtggctgtcagggcgctcccctcccctgggcctgctgtagcaggaatctggggcttctgacgcagtgcctgcaaggagcaaacccaggccttaggagtgatcaaactcactacagtcctgacagaaagtccccaacaagcaggaaccgggatgtcagtgacatcccccagccatgctccggggcctgcctctgagtagcacttaggctcagggctgcctgcctggcttggccccagccccttcaatggtgaccagatgtctacccaggtcctctgcaagactgactgctgtgagaaccctgcactctgtggggagggaccccccaagggcacctggaagcaggcatgggtgttgaggtacatctgggctcagaatgggagatggattttccccccattcccccagccactctctgtggcaggcttccaaagaaaccctctcagaaacacacaattatcaagctgtgacaactgcttgaggtgaggctcacctggaccagtgaggttgtttgtttgttttgagacggagtctcgctctgtcgcccaggctagagtgcagtggcgcgatctctgctcactgcaagctccgcctcccgggttcacgccattctcctgcctcagcctcccatgtagctgggactacaggcgcctgccaccacgcccagctaattttttgtattttttagtagagacggggtttcactgtgttagccaggatggtctcgatctcctgacatcgtgatctgcccgcctcggcctcccaaagtgctgggattacaggcgtgagccaccgcgcccggcctggaccagtgagttttaaaatgcttagcagcagaaccctgtatttaaaaatcacattgtttatttatttacacagacacatagctccagaatatagcaaacaagcaggtctgttctgggtagagctgggtggggtgggggacagtggagctcccccttcccttgagctttggagggagcctcaagctgaccagcccatgctcagtccccagtctatcacaccagagtctccaggacagtgccagagtgtgcctgagcctaagctggcgacttcccagtagatggggtacagcctgcagtttcacgttgctcaggtttttggttgaaactggtagaatcaggcagaccctgagctagagcccatcccttcagcttccagtttctcagtaaagcctgtacctgcaccagctctggcaagggtaagccacagggagtcagcagggctgagtgtgatggcgacacttagcgtgaagagggagataagtgaagagccacagcactttccagtcagtactggaatgcccttcatttccagtcattctctgaaaagtgctcttccttttcttattcagaaattaaatcattgaggaaagtctgtaagaatgagatgggaaatactctgtcccctagttagtaagatctcattcatctctggacatacagatttaagctttagcaagattccacgtgaacagagtattggttttatgttttgaaaatcttactagatacgttggcgtgttcccacatccccataacactcacaggcctctgatgagggaatgccagaaatgggtctgagggcagcaggtgctgcggaggcactgtaggagcgaggccctgtcccgggacacccatcctgctggggattccctggagcatctggtcctcctcagctgaggctgtcaggtgaagaatctctggagctggatgtggacaaatccattcacaagacaagacacggggatgggcagtctccttgctcattgcactgttttccctggctggattcgtttgatcactgcttctctaaagagccctaagctcagaatttagctgcttaaacacatggtcttgtctctctgatttttttttcctttttcatccaagtaattttgtgaaggggaaaacatcctccaataacagcatttcccggggactctcctcctggcatgcccactaaccgcacctgcacccggctctctgactgatgccggctccaccagcggtccggtctggtccggtccggtccagtgcagggggtctaacggtgtgtttattttctcctcctgctctgtctctacccagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaatccccggcccctc

SEQ ID NO: 37648 - DNA, 1382 bp, Homo sapiens
tgctcccttgggctctagagaggaagcccctcttagccctcagcccctctttcctccctctcctaaagtaatttgatcctcaggaatttgttccgccctcatctggccccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaaggtgcgtatggccccagggaatgctcagagggtgccgctgagcctggagctccacctgcccacatgctgcctggggtggggacttgtgtgtccctgtgactgtgagtttgtgtgcacctctgtcccgtgtgtgcccacgtcagtggctttgtctgtgtgatctgtgtgtgtgtgtggcttggggaatctgcccagtgcaggtttaggaggaggctccaggaggctggctggctggctcagagtctgtccccggctatccactagcccagagcagttctccctatagcccagtaagaaattacaccttcaccttccagactggcacccaggctctcccagaaagtgagaagggaactcacaggtgacttcaccccatggtggggagaacagcctgtgctgaggtcaaggcagaaggaggatgagccccgaggctcctggagagtctgagcccgggtgaggaaggggaggaggtggtccctgatctcagggcggggagagccaatgaggagacggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgctgctg

SEQ ID NO: 37649 - DNA, 62901 bp, Homo sapiens
ggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgtaaataggagtcttcatttctttctttctttttcttcctctgcacttcttggtccctgggtaattctgcttacgagatggttcgacttcgcttcaactttggaatggctattctaagctttactgtgtgactagaaagcatagagatttaagaaatgtgttttaacatgggaatggttaaaattgaagaaatagtacttaaaatttaatgtggtaaggctagtctttcatttggataattaactacatgggttgaccctttctgccccttacccattttaaaccttatttcagtaacaggtatagtcctgtgagcagacaaaaaccagatgcagggaggaaatgctgaaaagcattagccccattaaacctacgttggcctttttgtttcattctgctctgctcactgactgtaatgtccaaatcttatttgggcttttattatggtaaacgttataccttttgttcagtggtgaagattttcaggtgttcagttaggtttttacttgttactaaaatggttaatagttaagtctttttagatttgaaaataaaactctggttatttgcacacagaatagttcattagaaaaaatgattggttattctgagcagtgattggtgagtaaagggaatgaactgattaaggggtacgtcccataaagatttaagttaagttggaatttctagcagtcttagatagttatatgatgctttggtaattgaagccatctgaggctaattatctttcctttatgtttgcaggggaaaaattattttagttttggaaagatcctcttcagaaataccactatcttcctgaagtgtgagtttttgaatttcatgaagttttaatttgaattttaaaaatttataggtaatgttttaaattacctattttataagttctgaaatctaatagtctggcattatctaggtataaatatttttagtattactaaggtccttttactgaatcatcttcaaagtactcgtgtgaactttattttcttctcttgtttttctggtgtttacattgcatatatacactatgtagacattatatattagtatatataatgtatatattaatatatatgctgtatatactacattgaatattcagtcacatctcagtcgaattacatttacagttgatactttctgagaaaagcatccttaggtgattttgtcattatgcaaacatcatagagtatacttaaaactggatggcactacacgcctagtttgtatggtacagcctattgctcctaggctataaacctgtataacatgttactgtactgaatgctataggtggttgtaacacaatggtaagtttttgtatatctaaacataggaaagtagagtacaaatacgatattacaattttatgggacccccgttgtatatgtagtctttcatttactgaaatgttatgtagtgaatgactgtgattatgttggggttgattccctgcatggtggttttaatctgttctgtgtagattaaagaggttttactcttgtgtgcttgttaaatgtttactgcaaacatgacctaggtttgtcaggccgttggctgtgaaggaatatatttagtagatcctttatttacaaaaggagtattttactgctttggaagaggaagctcagatattatcaagaaatagggattatgtagaacaaaactagtttgtctagtggaaaaatgactgtatctgaatctaaagtatcccattgtgtgttcagtaaaagcttccttttagttctgaaaccggctttaatttagagaacgattgatcgtgggcagctttatttctagatgagggataaaaatcctgatgatagatgtgtgattctatgcatactgtcttcacggaagtgcaaaattttaagtcatagttggataattttattcttttcaattgtttagtgagtaattattacttattgcatagactgtggggaagtaatagaaaaatgttcttccctcatcgagcttacattctagtgggagtgaaaacagcaggtagaatttctctgaagaatatatactgtatccatgaatatgtaatcagtctcctgaccagtgacttatatttgatttagatcaaatctactctgacactggccttgtgagattggtttactgggtaacctagtaacccttgtcttttggaatagcttgacagcctgtttgctgttttattcttttattaggtccagtctttttttctcgtgtagtttgatctagtggtgttttgccaagttaaaccaactgcattttttttaagatggtgtctcactctgtcacccagactggagtgcagtggtacgatcttggcttactgcaacctccacctcccaggttcaagcgattctcctgcctcagcctcccgagtagctgggattacaggcatgagtctctatgcccagccctaactgcgtattttgaagtgtttatatttcattgtttttggaggatttgaggcactttattttttgttgttgttttttgagacggagttttgctgtgacgcccaggctggaatgcagtggcacgatctcggctcactgtaacctctgcttcctgggttcaagcgattcttctgcctcagcctcccgagtagctgggactataggcgcgtgccaccacgccggctaatttttgtatttttagcagaggtgggggtttcaccatattggccaggctggtctcgaactcccgacctcaagttatctgcctgccttggcctcccacagttctgggattacaggtgtgagccaccgtgcccggcctgagacactttaacattatctttttctttgttatttctgtgctttctcatatttaccagttgtctttgattttgtactttttgggggatggtatatagctttccatggaatagctgggaccatttttttttttttttttttttttgagacggagtctcgctctgtcgcccaggccggactgcggattgcagtggcgcaatctcggctcactgcaagctccgcttcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccgaccttattgtctcttaaagcctttcatttaaagttctaaatattgtcttgtaacataaacagcagtatttttgctgccaaatttccttacaagtctcctgtttgggggatgtgttcttactggctttttattagttaatcctgtccctgtatggattattttgaatagttcatagcccaattgctttttatcatttccataaattctatccaacaggtcaaatttttgaacattctaatagagtcctttgaaaatgtgttggtcatctaaaaattagtttgagaaaacagtttaaaagaaaaaaaaaggaagcttataattaggttgcttcttttgttatgaatgaaaagtagattcctaaatgcagtcatgtttatttttgtcatgtttattattacatttatataaagtagggagtctttagtatatttttcctttcatagctagaatcaaagataaaagcgaatactgacttcctccagctaatcagtcatatagtcagatttaccctcccaagtcttcagaataatgtcttgatccattagaatactgtgttccaaactgtgtttaatgagctttatgaagcttccatgataacatgagcttccttgaggcctcttttaaggtaggctttgaaaaaaaaaatctgatactcttatctttgcttttgctatttctaccttccacagccatgtttgcttttcgttcattgctctttctgttctatcttgatatctttcaaggtctgagatagcaattttgctctcagtggaactattatgtatatcatcatttaacaccatttaacagttgttaatattgccttgtgacatgcattcctaattttattattgcttgtctcttcaactagccttttgaagggtcttaataatttgtttccactcgtttccctctttagcctaacagtgtgccattatacctttgtaatacttgtgctatttatttatttatttatttatttatgttttttgagacagggtctcgctctgtcgcccaggctggagtgcagtggtaccatcatggctcactgcagacttgacctcctgggctcaagtgatcctcctgcctcccttgcctgagtagctgggactacaagcatgtaccaccacgcctagctttttaatcattttttgtagagatgagttctcactatgttgcctagggtggtcttgagctcctgggctcaagcgatccccctgccttggcctcccaaacttctggggttataggtgtgagctaccgcacctagcctgctcaataaatacttaaataatagaagactggcttgaatttagagtgctttatcactcccaggtttttctcaatagagatccagaagttaggactttatggcataaaaatagatccacagtttccagaggttaaaaactgcttacctgctatttttctatgaacaacaatacttttatcttaatatccagctctttttgcatgtattatttcaataccttatgtttggagaaaggatggtctttgagtatctcagtttagggtacgaaatgaataggatataggttaacagcttaggaaaaatgctttgttggggaattatcttttgttaacaaagatttcttcttttgtagttgatggagaaccttgtgacctgtctttgaatataacctggtatctgaaaagcgctgattgttacaatgaaatctataacttcaaggtaaggaacataaaattacagagtttttttggaccttagtgattatctggttccagtctcttaatttcatagaggaaagagtatcatgtagctatggaggaggagagctgaaactagaatgcatgcttcccaatttgcagaccaccaattctcaaactttttggtttcagaactcttatatttgtaaaaattattgtggactccagaaagcctttgagcatgtgggttatgctattagaaattacaactgagaaaatataaaaatatttattagtttattttaaagtagcaataataaacttattgcatgttaatataaataactgtttttcccagaaaaccacacagaagagtaggattgttttgtatttttgtaaatttgtttactatctggcataacagaagatcactgtattcttatattccctccttcactcagtctgttgcaataatttggcttaagtacatgtagaaaataatgacctcatacagatatatagttgggaaaaggaatggtattttaatggccttttcagataactgaggatattcttttttgattctataccaaaactcaacaagtggaagtttttaaaggttagttgcaatgtggaatctgaaatattaatgaactttttttgtactctgataagaaatccactgatatgaatgtatcttttacctgtgtgtgatcttgtagcatcatttattggtcatttagaaaatagcagttgactgaattatatacatttttataaatattaactcatttcacacttagctaaaaattacattgtttataactataccctgccctcttcatctcatcagtaggttcttaagttttggaagccgttaaattcagtgtagcagatacaagttcttcaaaattccagtttttgcttgaaatctcaaattttattttggcagtgaatactgtcagttgtcttccttgaggggacagcctctgttgcccatttccagagaaataactctcaaataaccaagtctgagtaatggtagtttttcagtcattctttcaagtaaatatggtgtttcgtggaaaaaatgattagtttaactcacaagtcaaagcaattgcagagtgctttatctcaagacaataatttattgtattttgcatgctttccattttgtcacctagattatttaaaaagtcaggtactcaaaaggtccagatttaataacattaataatttttactgctttatctaggatattcttacataaaagtggcatttttaaaaactgccagtttgtgactatgaagaatatgactgctagtagaattaaatgccactgccttagttcctgataaggggcaacagttttacccactattgcttttgtaatatcgttacaagtcaaatagcatactattattattatgaaaatagtttttttttttttgagatggagtctcactctgtcacccaggctggagtgcagtggcgcgatctcagctcaccacaacctctgcctcctgggttcaagtgattgtccagcctcagcctcccaagtagctgggattacaggtgtctgccaccacacccggctaatttttgtatttttagtaaagatggggttttgccatgttggccaggctggtctcaaactcctgacctcaggtgatccacctgcctcagtctcccaaagtgctgggattacaggcgtgagccattgtgcccagccatgaaaatagttttgtctatggttcaacggccacacttttgagaattgccataatctagaatacttgagcgttgaaaatatattgctcaaagaataaagctggaagcatcacattacctgacttcaaactgtactacagggctacagtaaccaaaacagacacaaagaccaatgaaacagagaagacagcccagaaataaggccgcacacctacaaccatctgatatttaacaaagctgacaaaaaacaagcaatggggaaaggactccctatttagtagatagtgttgcggtagcgtgctggccatatgcagattgaaactggaccccttcctcacaccatattcaaaaatcaactcaagatagattaaagacttaaatgtaaaacccaaaactataaaaaccctggaagacaacctaggcaataccattctggacatgggaagtggcaaagatttcatgatgaagatgccaaaagcaattgcgccaaaagcaattgcaacaaaagcaaaaattgacaaatgggatctaattaagtttaagagcttctgcacagcaaaagaaactatcaatagagtagacagcctacagaatgggagaaaatatttgcaaactatgcatccaacaaaggtctaatatccagcctctataaggaacttaaacaaatttatatgcaaaaaacaaccccatagaaaagtgggtaaaggacatgaacagacacttttcaaaagaagatatacagccaacaagcatatgaaaaaaaaaaagctcagtatcgttgattattagagaaatgcaaatcaaaaccacaatgagataccatctcacatcagaatggctattatgagaaagtcaaaggataatagatgctggcaaggttgtggagaaaagggaatgcttatacattgttagtgggagtgtaaattagttcaaccactgtggaaagcactgtggcaattcctcaaagagctaaaaacagaattaccatttgacccagcaatcccattactgggtatatatccaaagtaatataaatcattctaccgtaaagacatatgcacatatatgttcactgcagcactgtttacaatagcaaagacatggaatcaacctaaatgcccatcaatggtaaactggataaatgtggtacatatgcggccataaaaaagaatgtgatacatatgcaaccataaaaaagaatgagatcatttcctttgcaagaacacagaaggagctggaggccattaaccttagcaaactaacacaggaacagaaagcgaaataccacgttttcacttataagtgggagctgaatgatgagaacacatgatcacaaagaggggaacggcagacactgggcctacttgagggtggagggtgggaggagggagaggatcagaaaaaataactcttgagtactaggcagtacctgggtgatgaaataatctgtaaaacagttccctgtgagttcagtttacctatataacaaagttgcgtatgtataccggaacctaaaataaaagttaaaaaaaaaatatatatatatatatacacacacatatatatagttctgagttgaatttttcagaccttttccattctgtttctatctctcaatttgcatttttaagaagattatcctagttctgtgcttgcaacaattttctgctctatcttagcttatgagcatgaatatttttttgttgatgttgttaatttggtcaagtaaatcttttaagtatattttaatgtgacaaaaccctctacactctggcagtttcccagtctactcagaattgttagtagaactatgccttgtgagccaaagactagagtctaatagtccttgagtctgatagtgtttgattcttagatatttttatatagagcctttatctgatgctgttcatttttaaaatagcaaactcaaaattgtatctgtactgcaggtgaactgtttgttgtgctgtgctcttagtatcttattttttggaaggtgagttaactactctgtattatctctttttccaggcagaagaagtagagttgtatttggaaaaacttaaggaaaaaagaggcttgtctgggaaatatcaaacatcatcaaaattgttccagaactgcagtgaactctttaaaacacaggtaatctttgaaagtgattggagataaatagaataggcaaaaattggaatgtatatatttttggctgtatccacttccgacttctcaagtatttcttttggcagaagtaagtggaagcatgttctgataggtacatagtcagccacttatacatactcatcaaagagaggttgtactttgctttgtgtgtaaaaagcaaacccccatttttttattgtggtaaaatatacactacataaaatttaccattttaaccatttctaagtgtataatacagtggcattaaatatattcacattgctgtgcagccatcgacccatctccagtactttttttttccccaaggcagattcttgctctgtccgccaggctggagtgcagtggcacaatctcggctcactgcagtctccatcacccggatctaagcaattctttcacctcagcctcccaagtggctagggctacagattcacaccattacgcctggctaattttttttgtattttctgtagagacaggatttcaccatgttagccaggctggtcttgaactcttgacctgaagtgatccacccaccttggcctcccaaaatgctgggattacaggtgtgagccaccgggctgagccccatctctagtacttttatcatcccaaactgaaacatcatacctattaaacaaaaattccccaccttccaaccccaagaccatggtaaccactcttctactttccatgaatttgactattctagatacctcatataaatagaatcatacaacttttgttcttttttgtctgacttcttccacttagcataatgtttttaaggttcatccatgttatagcgttatcagaatttcattcctttttaaggctaagtgatgttctattgtatgtatgtaccacattttgtttttccattcatctgttgatggacatttaaaacgtcacatttttaattctttggtctcctcatctaattaatatgttcccagaaaaatcagggtttttaaaatttacttctatagatctgaaatcagaagggtatcatcattgtcttagagttcaatttcacaccttaattttgtagaaagagggagatgtgaataatcatacatttttcgtgcttacacatatgcaatcatgtaagtggagattctgatatcaaattttgttgtcttagaaatagtaatctcagttttttgatagaaaaattttatatgtgttgaaaatagttatagtaattatcatctatacttgtccttactatatttaaaaattattttggaatatttagcaacttgccttgaactgtcaaattactagaagtaaagtttattattaagaagacaaatttagtcattggtaattgaggccagatgcggtggctcaggcctgtaatcccagcactttgggaggccgaggtgggcggatcacctgaggtcaggagttcaagaccagcctggccaacatggtgaaaccctgtctctacaaaaaaattagccgggcatggtggcgggtacctgtaatcccagctactcgggaggctgaagtgggagaatcacttgaacccaggaggctgagatagtgtcagtgcactccagcctgggcgacaagagtgaaacttggtctcaaaaaaaaaaaaaaaaaagggataattgatgagcagatgaattaattggtaattgaaggaagagttccgcttttattataacttagattttatggtcttggagggaaaagaaaatagctttaagatggtgaaagaatggtagagaaagctagaagcaatgtgatgttgtgtagtttgtatgttttctgttggttttccaaatttatcccttagactaggaggattggttggtcttttcttggatttgattatggaaagctacctgatgcatctggttgctggaggctgactacttttagatgtgctgtaatctttccagggtcttggcttattggtaaggtttcctctcctcctccagtctaatgtaacagggttgaattacacagtctcattactcaggaaggacaatgcctcatctactgataactggtaagaaagataattagtgtagttttttacaggcataaaaaatgtagtatggtggaagggacagcagacctaagcatcaagaatattaggtttaggccgggcgcggtggctcacgcctgtagtcccagcacttcgggaggccgatgtgggcggatcatgaggtcaggagattgagaccatcctggctaacacggtgaaaccctgtctctactaaaaatacaaaaaaattagccaggcatggtggcgggcacctgtagtcccagctattcgggaggctgaggcaggagaatggcatgaacctgggaggcggagcttgcagtgagccgagataacaccactgcactccagtctgtgcaacagagcaagactccgtctcaaaaaaaaaaaaaagaatattaggtttaaatcctatttctttgtctaaagctttgtagttttgagccacattttactcatctgtagaatgaggggaaatgatctaagcttcttctatcctaagcatacatcctatatctaaagctttgtcattcttaaatgtttattattctgatagaaaaattgaatggccattttggtttgatactattttctagttcccagcagggttttattcacttgtttgtggttaattggaaatgttttgtctactgatgctgtgttattatatttactagttagggtgtggtgttttgttctaaccatttctttgtattttgagctacacttttcttctagtatttacacacctttaatgttttgttttgtgtttcttttatagaccttttctggagattttatgcatcgactgcctcttttaggagaaaaacaggaggtaattgttttcattatatatttctgagagtgcagtaaaaactttggtggtgcaggagatacccgtgctcactgcatctctaaggagggagtgctgcacctggggagcaggcttccccagtggctacaggaacttgggcagctaaaaacaagaagttctgaattaattattattatttttttaatgtttaaaggctaaggagaatggaacaaaccttacctttattggagacaaaaccgtaagtatatttggggatttggggcattgaacacatattttagttttcttaaatttgtgtatttctgaattgttctcccatactatgctaatatttgaaaagaaagttaaatctggaagctatagaccaaaatgttaaaaatggttggatctctggatgatagtatgagtgatttttagtttctttgtgttttctgaattttctactgtacacatgtattgcttttataattatccccccataaatatctgtaaacaggaagaaacttattaaaaataagaactcttaaacttcatctaaaattatctgtgataaaatataattgaaagagagtttggaaaaattgaaataaggtctaaagctataaatatgccttaagttttcataaatatgcattgtatggatactattttcaaattcataattaattcctcaaaacatcaccagttaaaaatttagaggaaggatgacagctatcaatgttgggttatggtttttacaaagctgattaaagtttttaattttataacaactttatgaaggtataatatacatattacagaagttatgttttgtttcgttttttgagacaaggtctcactcttgcccatgctggagaacagtggtatgaagatggctccctgcagccttgacgtcttgggctcaagtgatcctcctgcctcagactccaagtaactggggccacaggcacataccaccatgcctggttaattttaaaaaattttttgtgggggttgggtctcaccatgttgcccaggctggtatagaactcctaggctcaagtaatagtctcacttcagcctcccaaagtgctaggattataggcgtgagccactgcacctagcctaaaagttgttattaaagttattaaagcatataattgagtggtttttagtattctcaagttgtgcaagcaccaatcgctaattccagaattgttcatccccaaaagtagccccatactcatcagtcactccgcatttctcctgcccccagcctctgacaatcagtaatctattttctttctctgtacttgccttttctggacattttgtgtaactggaatcatataatacatggacttgtgtctggcttctttcacagtttacactctgtctcaacttttacttcctgcttgcacagaaccttaagatcagccagtgaatgattagggcctcctcaggtctctcctggacctgtgcacagccctgggcatgtgtgcacagccctgcacatatggccttctagatttccaggaatattttggagctttccaaaattcctatggacatctcattctccaatttttccttttaagtttccaatcagcctcttaatagcctcagttggtaaggtcacctcaggcagctgtgatcttgaaggattgctgttcaatgtttttgacaaatgctttgagtacagggttgttgacactgggtgatctctgagtcaggtcagataaagacaagccctgagaatggagcttttcagcaatttgccagacagctcaggtgatcagtcttttagggacctccaaatgtattttttcctttgggaggcctaggtgggcagatcacttgagagccaggagtttgacaccagcctggccaacgtggtgaaaccccgtctctaccaaaaatacaaaaattaggcaggtgtggtggtgcacgcctgtaatcccagctacttgggaggctgaagcaggagaatcacttgaacccagaaggtggaggctgcaatgagccgagatcacaccactgcactccagcctaggcaacagagtgaaactctgtgtttgcttcccctaccccctttgcctagtggctgctaagctgttgtttttatcagctgttaacagtttcagggactttggttttaaggagcttgggagagaggaatgggaatagggtgaacacagacatctcaagcttgcttttctttcctagattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgttctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagtgtcttattgtatgagtacattgcaatttgttcaattctctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatggataaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtagtccccgctacttgggagactgaagtgggaggatggcttgagtctgggaggcagaggttgcagtgagccaaagtcacaccacttcactctaggcgatagagccatacctcgtctctaaaacaaaaacaacagcaaaaaaattattgttgagggtgaaccttcatttatatggatattggcacttgtgctttcttcagttgtcttctgtgcacagcatactttgagttctactcaaggcttgagtcttgttacagtgattaaaactggctgaaaggtgagcctgttgaataccacaagtaatatttaggaatacttagtcaaaatatagtcaaaagaaatgaaagagttatctatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagcccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgtgaggccaaggtgggtggatcacctgatgtcaggagttcgagatcagcctggcaaacatggtgaaacctcatctctactaaaaatacaaaaaaaaaaaaaaattagctgggtgtggtggcgcacgcctataatcccagctacttgggaggctgaggtgggaggatcccttgaacccaggaggtggagattacattgagccaagatcgttccgttgtactccagcctgggcaacagagcaagactccatctaaaaaaaaaaaaacaaaaatctatatgtttatggaagaaaggtcctctgcatgtcccttcttctaaggaaatattgataaaagagaacactttaatattttgattaactcagttttttggatttaagcaataatgtgatacatttaacataatttaaaaaaattaatagagtttattgtttagagcagttttaggttcacaacagaattgagtaaaaggtacagagagggcagtgcagtggcttatgcctgtaattgcagcacttcagaagccagggtgggaggatcacttgaacccaggagttcaagagcagcctggaaaacattagagacactatctctacaaaaagcaaaagttggccgggtgcggtggctcacatctgtaatcccagcactttaggaggcccaggcagacagatcacctgaggtcacgagttcaagaccaacctgaccaacgtggagaaaaccatttctactaaaaatataaaattagctgcgcatggtggcacatgcctgtaatcctagctacttgggaggctgaggcaggagaatggcttgaacctgggaggtggaggtagcggcgagccaagatcgtgccattgcattccagcctgggcgacaagagcaaaactccgtcttaaaaaaaaacaaaacccccaatttacccagcatggttgtgcatgcctatagtcaccgctacaggggaggctgaagtgaggatcacttgagcccaggaggtcaaggctgcagtgagccatgatcatgccactgtactccagtctaagcaataaagcaagactctgtctcaaaaaaaaaaaaaaaaaaggagacctcccacatgctgtgtctatacctatacacttagcctcccccatcgtcaacatactgcaccactgtggcacactgttaaagttgatgaaccacgttgacatgttattatcaaagtctatagtttaaggttcactctgcagtgtacattgtatgaattttgataaatgtgtaaagacatcttcacctttgtagtatcatacagaatagtttcagtgcctaaaaatcctctgtgctctgcctgttcatctctcccttccccttcaactcctggcaatcattgatctttttactatcttcatagttttgccttttccagaatgtcatctagttggaattgtacaaatatgtgacctctttagattggcttctttcagttagtaatatgcatttaagtttcctccatgtcttctggtggcttgatagttcatttctttttagtgctgaatcatattccattgtttggatatatcacagtttatccattcatctattgaaggacatcttgattgctttcaagttataacaattatagataaaactgttgtaaacatttgtgtccaggcttttatgtggacataagttttcaactcatttgggtaattatcaaggagcatgactgctagattgtatggtaagagtatgtttagttttgtaacaattgcatttttgacaatgcagtgcttaatcaaaaacaatgttttgggaacaaaactactcttgtaggctgtctgtctgacagcatcaataactggattgtcacttgtagctttaattaccttactcatggggttaaaaggttcttttgaagggcacttacaattttgagatcataccatgaagacagtgctttaaaaacagttctgttcacaagctagtggtagactgtgaaaaagagaaaaaaaaaaagaaaaaaatagttttgttatggagaacaaaataattaatagttgagatggtagttaagagcccaggctctcgggtcagatgtcctagactttgaaatcccaacttcacaacttaatatttcccttggaaatgttattgtgcttcagtttcttacataataaaatggagctaataggaatgatattaccaagaattgtggagtagtgaggtccaggtctccatgcctccacaaaagcaactagtaagctgatgaaagctatcacattcagctttcacagaactttgaaatctaaccaaaacttaataaggaaaaagttcaacaaagaaagaagctgctacattacattaagaaagtgcagtgatattgtaatttgtttaccataccctccttcccagttcagaggcaggaagatggcaactcgcagtcgtggtgcaggttgctggtgccaggggaactaatacagacctttttcttaaagacttgccattgtgtgttttcacctgcctggaggctccctgaaggaaccttgccaggacttaactttgttttccccaacttagagtgttcccagggctggagtggcttcctgggttgtgtttgccaaaagcatttgaatgcagaagtattatgtgcatagggaaggggataacagtggggataagcaatagagagactgtcaagcatgagaaggaaagggtccagaaaggagatttgtgggagaacaaggctttttaaggcttctgtgtatattgagctatgaagaaagccatatatattctcaagactggacatacgatcagaaaagaccttagatgaccctaagctttcattctggctctgtacaagcaaaaagtgaagaataaggaatggctttaattggcccagctaagcattgaaggattgcgccagggtgcaaagactgggaggatattctgttcttttttgtctttggctcctggtgtttaagaaatctttgtcaaaacactagctgaccactaagctaaaggaatatagattccagtagccacacaggtctaagaatgcagactttacaaaaatggtttagaaaacttactaagcaaaagagacataacccatattattattaccagctaacaaaccccaaggagggggcagattgtggtttccagagttgccactttataacattcagttttcagtggaaaattatgaggcatgcacagaaacaacgtatggcatatttacaggattaaaaaaaatacatgctttgaagaggaagcctcagcattagacttaccagaccaaagattttaagtgaactgtcttaaatatactcaaagagctaaaaataaaaaaaccatggatgaagaaactaaaggaaaccaggagaacatagagataaaaatgataaaaagaatgaagatgagcctgagagacctatgggacaccctcaggtgtatcaacatccacataataggaattcatcagagggagaagagagggagaaaggtatgggaagaatatttgaaggaataatgcccagaaacttaccaaatttgatgaaagtatgaatttcagaaagattgagaggctcacaaatctcaaactacaagcaggaatgaaaaagtaaaatgttgtatgttcataaaatggaatatcattcatctgtaaaaatgaatgggagctggattccaagatggccaaataggaacagctccgtctacagctcccagcgtgatcgacacagaagacgggtgatttctgcatttccaactgaggtacctggctcatctcactgggaatggttggacagtgggtgcagcccacggagggcaagccgaagcagggcaggacatcacctcacccaggaagcgcaaggggtcgggggatttccctttcctagccaagggaagccgtgacagactgtactgggaaaactgggacactcccgccttaatactgcatttttccaacagtcttagcaaacggcacaccaggagattatatcccgcacctggctcagcgggtcccacgcccacggagccttgctcactgcaagtgcagcagtcccaaatcgaactgcgaggtggcagccaggctggggaaggggcatcgccattgctgaggcttgagtaggtaaaaaagcggccaggaagttcgaattgggtggagcccaccacagctcagtgaggcctgcctgcctctgtagactccacctctgggggcagggcatagctgaacaaaaggcagcagaaacttctgaagactaaaacgtccctgtctgacagctctgaagagagcaatcgttctcccagcacagtgtttgagctctgagaatggacagactgcctcctcaagtgggtccctgacccccatgtagcctaactgggagacacctcccagtaggggccaactgacacttcatacagctgggtgtccctctgagatgaagcttccagaggaaggatcaggcaacaatatttgctgttctgcagcctcctctggtgataaccaggcgaacagggtgtggagtggacctccagcaaactccaacagacctgcagctgagggacctgactcttagaaggaaaactaacaaacagaaaagaataacatcaacatcaataaaaaggacatccacaccaaaaccccatctgtaggtcaccaacatcaaagaccaaaggtagataaaaccacaaagatggggagaaaccagagcagaaaagctgaaaattctaaaaaccacagcatctcttctcctccaaaggattgcagctccccgcgagcaacggaacaaagctggacagataatgaatttgacgagttgacagaagtaggcttcagaaggttggtaataacaaacctctctgagctaaaggaggatgttcaaacccatcacaaggaagctaaaaaccttgaaaaaagagtagatgaatggctatctagaataaacagtgtagagaagaccttaaatgacctgatggagctgaaaaccatggcacgagaactatgtgatgcatgcacaagcttcagtagctgattcgatcaagtggaagaaagggtatcagtgattgaaaatcaaatgaatgaaatgaagcgagaagagaagtttagagaaaaaaagagtaaaaagaaatgaaaaaagcctgcaagaaatatgggactgtgtgaaaaggccaaatctacatctgattggtatacctgaaagtgatggggagaatggaaccaagctggacaacactcttcaggatattatctaggagaacttcccccacctagcaaggtaggccaacattcaaattcaggaaatacagagaacatcacaaagatactcctcaagaagagcaaccccaagacacataattgtcagattcaccaaggttgaaatgaaggaaaaaaatgttaagggcagccagagagaaaggtcgggttacccacaaagggaaggccatcagactaacagacaatctgttagtgggggccaatattcaacattcttaaataattttcaatccagaatttcatatccagccaaactaagcttcataagtgaaggagaaataaaatcctttacagacaagcaaatgctgagagatttttgtcaccaccaggcctgccctacaagagttccggaaggaagcactaaacgtggaaaggaacaaccagtaccagccactgcaaaaacatgccaaattgtaaagaccatcgatgctaggaagaaactgcatcaaccaacgggcaaaataacccactagtatcataatgacaggatcaaattcacacataacaatattaaccttaaatgtagacgggctaaatgccccaattaaaagacacagactggcaaattggataaagagtcaagacccattggtgtgctgtattcaggatacccatctcatgtgcagagacaaacataggttcaaaataaagggatggaggaagatttaccaagcaaatggaaagcaaaagaaaaagcagggttgcaattctagtctctgataaaacagactttaaaccaacaaagatcaaaagagacaaggccattacataatggtaaaggggtcaattcaacaagaagagctaactatcctaaatatatatgcacccaatacaggagcacccagattcataaagcaagtccttagagacctacaaagagacttagactcgcacacaataataatgagagactttaacaccccactgtcaatattagatcaatgagacagaaggttaacaaggatatccaggacttgaactcagttctgcaccgagcagacctaacagacatctacagaactttccaccccaaatcagcagattgtacattcttctcagcaccacatcacacttattccaaaattgaccacatagttggaagtaaagtactcatcaacaaatgtaaaagaagtcacaaccgtctctcagacgacattgcaatcaaattagaactcaagattaagaaactcactcaaaaccacacaaatacatggaaactgaacaaactgcttctgaatgactgctggataaataacgaaatgaaagcagaaataaagatgttctttgaaaccaatgagaacaaagacacaacataccagaatctctgggacacatttaaagcagtgtgtagagggaaatttatagcactgaatgcccacaagagaaagcaggaaagatctaaaatcgacaccctaacatcacaattaaaagagctagagaagcaagagcaaacaaattcaaaagctactagaagacaagaaataactaagatgagagcagaactgatggacatagagacacaaaaaacccttcaagagaatcaatgaatccaggaactggttttttgaaaagatcaaccaaatagacctctagcaagactaataaagaagaaaagagagaagaatcaaatagatgcaataaaaaatgataaaggggatatcactactgatcccacagaaatacaaactaccatcagagaatactataaacatctccacacaaataaactagaaaatctagaagaaatggataaattcctgtacacatagaccctcccaagactaaactaggaagaagttgaatctctgaatagatcaataacaggttctgaaattgaggcaataattaatagcctaccaactaaaataagtccaggaccagttggattcacagctgaattctaccagaggtacaaagaggagctggtaccattccttctgaaactattccaaccaatagaaaaagagggaatcctccctaactcattttatgaggccagcatcatcctgataccaaagcctggcggagacacaacaaaaaaaagagaattttagaccactatccccgatgaacatcgatgcgaaaatcctcaataaaatacttgcaaaccgaatccagcagcacatcaaaaagcatgtccaccaagatcaagttggcttcatccctgggatgcaagggtggttcaacatatgcaaatcaataaacgtaatccatcacataaacagaaccaaagacaaaaaccacatgattatctcaatagatgccaaaaaggcctttgacagaattcaacagcccttcatgctaaaaactctcaataaactaagtattgatggaacgtatgtcaaaataataagagctatttatgacaaacccacagccaatatcatactgaatgggcaaaaactggaagcattccctttgaaaactggcagaagacagggatgtcctctctcactactcctattcaacatagtgttggaagtaatggccagggcagtcaggcaagagaaagaaagaaagtgtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcaatatgcaaaaatcacaagcattcctgtacgccaataacaaacaaacagccaaatcatgagtgaactcccattcacaattgctacaaagagaataaaatacctaggaatccaatttaaaagggatgtgaagaacctcttcaaggagaactacaaaccactgctcaaagaaataaaagaggacacaaacaaatggaagaacattccatgctcatggataggaagaatcaatattgtgaaaatggccatactgcccaaggtaatttatagattcaatgccatccccatcaagctaccaatgactttcttcacagaattggaaaaaatacttcgaagttcatatggaaccaaaaaagagcccacattgccaagacaatcctaagcaaagagaacaaagttggaggcatcacgctacctgacttcaaactatactacaaggctacagtaaccaaaacagcatggtactggtaccaaaacagacatatagaccaatggaacagaacagaggcctcagaaataacaccacacatttacaaccatctgatctttgacaaacctgacaaaaacaagaaatgggaaaaggattccctatttaataaatggtgctgggaaaactggctaggcatatgtagaaagctgaaactggatcccttccttacacctcatataaaaattaattcaagatggattaaagacttaaatgttagacctaaaaccataaaatccctagaaggaaacctaggcaataccattcaggacataggcatagggaaggacttcatgactgaaacaccaaaagcaatggcaacaaaagccagaatagataaatcagaactaattaaagagcttctgcacagcaaaagaaactaccgtcagagtgaacaggcaacctgcagaataggagaaaatttttacaattcacccatccgacaaagggctaatatccagaatctacgaagaacttaaacaaatttacaagaaaaaatcaaccccatcaaaaagtggacaaaggatatgaacagacacttttcagaagaagacgtttatgcagccaacagacacatgaaaaaaatgctcatcatcactggtcatcagagaaatgcaaatcaaaaccacaatgagataccatctcatgccagttagaatggtgatcagtaaaaagtcaggaaacaacaggtgctggagaggatgtggagaaataggaacacttttacactgttggtgggggtgtaaactagttcagccattgtggaagacagtatggcaattcctcaaggatctagaactagaaataccagttgacccagccatcccattactgggtatacacccaaatgattataaatcatgctagtataaggacacatgcacacgtatgtttattgcagcactgttcgcaatagcaaagacttggaaccaacccaaatgtccgtcaatgatagactggattaagaaaatgtggcacatatacaccatggaatactatgcagccataaaaaaggatgagttcatgtcctttgtagggacatggatgaagctggaaagcatcattctgagcaaactctcgaggacagaaaaccaaacactgcatgttctcactcataggtgggagttgaacaatgagaacacttggacacagggcggggaacatcacacagtggggcctgtcgtcgggtcgggggctgggtgagggatagcattaggagaaatacctaatgtaaatgacgagttaatgggtgcaacaaaccaacatggcacatgtatacctatgtaacaaacctgcacgttgtgcacatgtaccctagaacttaaggtataaaaaaaaacaacaaaacttgggtctcagtacttagaaaatagttaaccatgatcaataaaatatttgccaattccttcaactcaaaaagaaaaaaataaatgaagctctgatacatacagcaatatagatgaaccctgaaaacattatgttaagtgagagaagctagacccatttatatgaaatgtccgtaatagatgactccatggagacaagaagtaaataagtagttgcaagtggtgacagaggaagaaatggggagctactgcttaatgagtacagggtctccatttcggttgatgaaaatgttttggaactagatagaggtgatatttgcacatcattgtgcttgtaccacataccattgatttatacgcattaaaattgtgaattttatgttgtgtaaaatttaccttagtttacaaaggagttaatacctatctgatagggctgctgtgaggatgtaaaaatgtagtaaatgggccggggcgtggtagctcacaccttaatcctagcacttagggaggccaaggtgggtggatcacctgaggtcaggagttcgagaccaggctggccaacatggcgaaaccccgtctctaccaaaaatacaaaaaaaaaaaattagctgggtgtggtgtcatgcacctgttatcccagctacttgggaggctgaggcaggagaattgcttgaacccgggaggcggacgtcacagtgagccaagattgcactgctgtactcctgcctgggcgatggagcgagactctgcctcaaaaaaaaaaaaaaaaaaaaaagtaataaatgtcatatgcttaacagagttatctggcatataaatgttatttttacagggtcagaatctctgcattccagagttaagtataaactttctcaaatcctggaatatgagaattgatcaatttattttagaatttgtaagaggtggttttaagacatatatgattaatagagcaggttattacaccagcattttataggttgatgagtaagtaagttcaggaaaggttctgtaattatggctaagcagacatgtattacccataactttgaagctgcaaagttttctcacaaattggttgtgagtctcgtcagagactattaggtggagataaatcaatgtatgattaggaagacatttatattcttaaattttactaagataacctagtaaatggatatctggagaattgtttagtctgctttgtttgacatggatttttatcatggaatataatttttgaactaagccttttcttggttgtaggatattttaaccatttgaggagaactatggctccacaggaaaatgcataaacataaaaaatcagctattcattttggggggttcacagaacctagaagcttacccagagatctctggataaacgtttctccttttaagaacagatggtagtaaattgcaattccaaggaagaagaaaccagttattttctgtgttcctctttatcattgtgtcttagtcttctgtttgtgaagactctagtctatgtgaaaagcaagagtcactacccctcaaagtcaaggacttggagactgttaatttgtcttccttgactttgaggggtagtgactcttgcttaccacatagactagctcaaggttaaatttttgatataaatgtgagaccatgtcagcagaaattctgatattcttgggaagcatgttgaacaaagggattagatttaggaattggtgattagaattcattttactgataccatcattaagttttgtttaaggtgatttaaataatcatttaaattcctttgtaatgtctgcataaaacacaaactagtatcctagtatggcttagttaaacagagattaaattagtgattttagttgggggtttcctcattaaaaaaatatgttaaatgtgatttttgtgtacaagacatggtatcttgcctttcagtaattcataatctagcctactttatgcactaggcttgtttggtttgttgtgcctaatgtttcaatgaatgaaagagaaggactttaccatatttctgggcacattctggagcaaaatttgcatattgtattattaatttgtgctcttaattcttaagatttatagatgtgatgcccttttccctttctaggcaatgcatgaaccattgcaaacttggcaagatgcaccatacatttttattgtacatattggcatttcatcctcaaaggaatcatcaaaagaaaattcactgagtaatctttttaccagtaagttcagttttttttttaatggttatgttattatctggttatgtcattcatgtactttacatatgcttttttattaggtattacaggtatcagatttctatttccttcatttgacactcctgctgttaaaatttttagttagtaacatgttttcagtattctgaactagaattgtcaaaacttggtcaccaagccagagataaggaaattttaaattaattaacattggccgggcgcggtggctcatgcctgtaatcctagcactttgggaggccgtggcaggcagatcacatgaggtcgggagttttaagaccagcctgaccaacatggagaaaccccgtctctactaaaaatacaaaattagctcggtgtggtggcacatgcctgtaatcccagctacttgggaggctgaggcgggagaatcgcttgaacccgggagatggaggttgtggtgagccgagatcacgccattccactccagcctgggcaacaagaactttcgttcttgttctcaaaaaaaaaaaaaaaaaaaaattaattaacattggtagtttttaatgtctcaagaatttaagtgttctcctttccaaggttgctgcctagttcatagagtcatcatcttttacgtggaatttccaagaacttcctaactggtcttatttcctgtggtttcccccttgtttcttctttgtgtttttgcaatttcctttcctcccctgctttctttttttttatttatttatttatttatttatttatttatttatttatttatttttgagatggaatctcactctgtcgcccaggctagagtgcagtggcgtaatctcggctcactgcaagctccgcctcctgggttcacgccattctcctgcctcagtctccgaagtagctgggactacaggcgcccgccaccacacccagctaatttttttgtattttttagtggagacggagtttcaccgtgttagccaggatggtttcgatctcctgaccttgtgatccgcctgccttggcctcccaaagtgctgggattacaggggtgagccgccgtgcctggccctttcctaccctgctttcttaagcagaatatggaatagaaacaatgatggcagccaccgttacttcgctcctgactttactggctgtattggtatatttcaccattaagtactgtgtttactgtagaacttttgaaatattcttcatttggttaaagatgttcctttctattcctagtttaatgagaatagtttccttttttaaaaaaaatgttaagaatgaatacttagctttatcaaatagtttaattgtactgatttaaatgatcatatgggctttctcatttaataagttaatgtcatacattaaattaactgatcttctaacattaaatcattgttgaacttctgggataccactacttggttttgacacacacacgcatattctctctgtctgtctgtctctctctctctttctcttcctctcctccctccctccctctccctctctccctgtccctctccccctcactcatacatgtgtatcctcctgtctttttaggcccatgactttctaatggattatagtctcaaggcacagttaccagtgttcattttcaaccttctttctttgaaaaggctggaagagaagctttattccaccctacttcagcttcttcatgcatccagcctggctctggtccctcttctttttctttgaaacctactagcttcaatgatcccatgtactaccgtagtacattggtagtgtacttccaactaccatagatcccatagggacagcacttccaactaccatagcctgcttctggcccaagagcccaacatgatcatggagtcggcctcgtgcactgttttgagtttctgttttgattcttggaaatgtctgtcttgtttttgagcttatatccttttttgtttttttctttttctttttttttttctttttttttttgagatagagtctcactctgtcacccaggctggagtgcagtggtgtgatcttgactcattgcaacctctgactcctgggttcaagtgattctgctgcctcagcctcccaagtagctgggattgctggcctgcaccatcacacctagctaatttttgtatttttagtacattgtgtttttacaacctactaaattattatttatctgctaaattattaaatctactagatttttatttagtagattgtatttttagtttcaccatgttggccaggctggtcttgaactcctgacttcaagtaatctgcccgccttggcctcgcaatgtgctgggattacaggtgtgagccgccgcacctggccttgttttttcattttaaaaatacccgtctttttttggaatggagaagatacatcatcactaatacagttttatcatttttcttcccttcatcgaaacctttaatggatggctccccattgcctataaaatgactacattttgcagcaaggtttataaaactctttacaactggtcccagtttaccttttgctgccttatgtcaaaacaccactactatatggtattatatgcagtctcagactatatttgttctttaaatataccacacattttcacagctgttttgttcatgttatttcctctacctagaaggctttttactttgttctggaaaatacatacttatccttctagtctggctgagagggatagttctctacttatccttctagtctggctgagagggatagttctctatgtagcttgtcaactccctctcccctgcaaggtggttacccatttgatggcagaaaacatcttactcatgtttctgtctgctgtgttttccataggcctgtcaaataataagtgcttagtaaatgtatattttagcatagagcaggggctagcaaatttttttcttaaagagtcaggtagtaaattttttctctattataactacccaactctgcgaggtggtgcagaggcagctgtagacaatatgtaaatgagtggatgtggctgtgttccaataaaactttattaacagaaaaagctggtggccagatttggcccatgtgctatattttgctgaccaaggcatagagtaagcaaagaatatgatccaagtatttactaattattttgtttactcttttattgaattaggaaggtatagatttaataatagttctgctctgaaatttttataattgctcttatggaatgctctttttttcatgtaagtattggatgtagtttactttaaataatggtatatcagaagctagtagggaattgttgaatgaacagttattagtctgtctctagggatgatcaccactcaagtcagatttttatttattaattatgcctagaatttatccaaattattttatcaatacaataataaaatagtccatcttgaaatagtttttaaaattacagataatcttaaaattagtcaatgtttgctttactaaggcaaatatgtctttcagatatatgttattactgttactttatctgtctcattaaacactttgttattaacaaattctttgaaaaatgttaactagcaggttttggggaagttcaattctatgtttattggatggagctttgccttgaagcatctgaacttttgagttatttttattttggagtgagcatctagggtacctgattgtgaagctagatttcaatcttgtatgagggatggtatatttttttgtgtgagttaatttaaatttttaagtttttttccaatgccttcattccgaaaatgatacatgaatgtagcaataaaagaaaattggagtccatgaaaaaatagtaaagcaataggaaaatacaggtgaggaaagatagaaaacaaagaagatggcaatatgtaaaaaggaagtcctgtaaggcatattttactgatgtgttgtaaggaaaagtatatatgaagtatgtttagaatttagagtatgtgtagagttgttccagatgggcagccagagaaggctgtgtggaggaaatattcaatctagtcttttttaagatgtgagtatggaaacaaaagagccttcccacttcagactatggtggaggcatggaaacctgtgcaggacacagcatgaactatgaggacacttaatgactttccaagtgctgtacaaatataatgtaatattgaccaggattgaagtgcctaaaagtaaatgacccaatgaaattcttactaagttcattaaacaaatattaggcaatatttttgtttaatttctgcatcctgtaaattaattctgaggactctgttttggcagtgactgttgaagtgaagggtccctatgaatacctcacacttgaagactatcccttgatgattgtaagtgactttatattatttaacctcagtattggatggttttgggttcaaagattgtcccatgttttgtggcagtattctttttaatgaattgttcctgtgcaattcagaaaatgttgcttgtagtcctggatttatttcttattagactgggactttgagagagtcagtatacccttgtgtgcctcattttcttatccatataatgaaggggtcagtgacctgtggaaatacctcaaagatcatctcacattctctctaggatgcatagtggggcactttttactacaactctattgtttctgatcccacttacattaactaaatgaggctgggtgccctggctcatgcctgtaatcccaacattttgggaagctgaggcgggcagatcacttgaggtcaggagtttgagaccagcctggccaacatggtgaaaccccatctctactaaaaatacaaaaattagctgggcgtggtggtaggcgcctgtagtcccagctactcgggaggctaaagcagaattgcttgaacccaggagacagaggcttctgtgagctgagatcttgccactgcactccagcctgggcgacagagtgaaactgtctcaacaacaaaaaattaacaaaatgatgaagctcccttctcttcattttgtgtgtgtatgtgtgtatgtgtgcacatacatgtatgtgtgcatacgtctgtgtctcagaatatccttaatatattttcaattttctttgttcatgattattctcttcttcctttccctttaatagttttcccgttttgttgtgtttccttgcctctagatgtatcctaatcatcatgccatttttcttcttcagtgttgtcttcatctatataattttagatcgtgagctgaaatagctccttctttaaaaaaaaaaaaaaaaaaagagagtctcactctgtctcccaggctggagtgcagtggcatgataatggataatggctcactgcagccttaaactccaggctgaagctaccctccacctcagcctcccaagcagctaggacaacaggcgtgtgccactatgcctggctaatttttattttattttattattttttatcttgaaacgtagtctcactctgtcacccagactggagtggaatggcacgatcttggctcaatgcaacctccagctcctgggttcaagcgattctcctgcctcagcctcctgagtagctgggactacaggtgcgcaccaccatgcctggctaatttttgtatttttagtagagacggggtttcaccatgttttggccaggctggtcttgaactcctgacctcaagtaatctgcccatctctgcctcccaaattgctggtattacaggcatgagccaccatgcctggcctaatttttattttttgtagggacagagtcttgctatgttgcctagactggccttgaactcatgacctcaagcagtcctcctgcctcggcttcccaaagcactattgcaggtgtgaattaccacgcctgaccagaaaaagctcttttactataggagagcaggctgagtgctctctatatataccatatatgtgtctgtgtgtataatagagagcaccttttatatggtatacatatgtgatacatacatacacacacacacacacacacacacacacacatatatatatatacatatgagagcattcgctcttgaggacaagttcatatgtagtcttctctgctcaagacaagataatgctttcatattagttaatgttaagctccaaaggaagaattatttcttaactagaaggtagaatatatttttgtaacttgttaagactgtatattgattcaggacaggcgctgtggcttatgcctgtaatcccaacactttgggaggcagagatgggaggattgcttgagtccagaagttcaagaccatcctaggcaacatagcaaatccccatctcttaaaaaaaaaaaaaaagtatatattgattctaaatctacagacttggctcttggccctaattctcctttttatcttttacccaatttgataacagtttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctggtaagtaaccagaaaatctttgccagttcgagtggttggaaggtgagatgtatgaaaatattcctaaggtcagcagtcactacataggcttaacttttcaattacttaattattacaatatcttaagcagaatcactatgactctgacttttgtttttaatcttatgagttcagtgatgtaagactaattttactgaaatatgctcacaaaagtcacaacagtagtgaccattttgggaatgattattaacatcaaatctcaatttctgttgatttctaaggcaccattatacatctaagaaaaaaagtaaagctgtcaatttaattgtaaaatgtcactgattgtaagacacaccttgatttaaaaaacctcaaaatgtggtgggaaagtgcatctaactgataaaatatagtcatatcaagaaaataggagagtgcttatggtttagtaaggtgaactggtaatgacagaagttgttttatactgtagttttttgtgattgcttcagttttttcttgtcagaccatttaatttagtcataattattattgtgagataaactgataagattttccctggtctttgaaaggtcttgaaaatagtagatctgaaaaaagttaagctgtacatgccaacaagcgtgtacacgagtgtgttttgtgcttttctatgtgtagctgtatttcacagtttttaaaaatgggggaaattgtctcgatgctacaaactgtccatatagggtgaggtattctgttaaagttttagtgaatttggggccaggtcggggagggagctgagttgagcgcacccagattgccatacatagacatgagtaagattgtgagtggcatcagcttgtatcctgtaaaaactgtggaagaggtattctattttagcaggactaatatcaatgcttattctgaagagtgtagaaagcagcagtctagtattggcatctggcctgttgccaaacctagattatggtgccatttcttcccttctttttcatagtccagggtgctttgatccttgcagagctgctttcagcagtgaaacgctcactggctcgaaccctggtcatcatagtcagtctgggatatggcatcgtcaagtaagtattaacttcctgtatggaagagcaaattaaaatgctgattaaattaaaacagtattgcatgttcccaatgtagtagttctgaaatagttgataaaagaaataattctgaaacaagaaaggtatttgaaattttgtagcattgtaaatgttgggaaaatgtgtttcattttccatacttccaaatatattccatacttccaaatatattccatacttccaagtccaaatgtattccatacttccaaatccaaatgtattccatacttccgaatatatttccatacttccaaaatattttttgcaaattagattttttatgggaaacgcattcttgctgtaactgtctgaaaatatttttctatccaaaaaattttatttttattgaggagtgtcttctataggcattctttgaggcattgttctaggccctggggatatggcaagtaaacagaagattttgagcttacatttgtggagggaggggacaaagacaaaatttaagtgggtaaaatattttaatatgtcagtggaaagtgcagtggagcaggtaatgcaggagctagagcttgcagttgtacatagggtgatcaaggagggcttcacttaatgacatttaagcagagacttcaaggaggtgagggagctatatgtatacccaagggaagagatgctgaattgagatcagattctatatatattttgaaggtggaaccagtggaatttgctgatggatcagatgtatgataggaaagagaagaggaattaaggatgatgccaattgttttgatctgataaaatggcaggatggaattgaagatttactgagttcaggaagaccttaggtgaaataagtgtggagcaggggcaagattggagttgaattagataactaagtaggggaaacaaaggggagaggttggggcagagataaaagtttgggagtcatgaagataaagatattatttaaagtcatgaaggccaggcgtggtggcttacgccataatcctcacactttgggaggccaaggcgggcagattgcctgaggtcaggagttcaagaccagcctggacaacacagtgaaaccctgtgtctgctaaaatacaaaaaattagccggctgtggtggcatgcacctgtagtcccagctacttggaaggctgaggcaagagaatcgcttgaaccctggaggcggagattgcagtgagccaagatcatgccactgcactctagcctgggtaacagaacgagactccatctccaaagttaaataaataaataaataaagtcatgagactggatttggtcaccaaggaagtgagtatatatagagaagaggtccaagggctgggcccttgaatatttaatattatttagaagtctgtaagatgaagtagttagcagaagaaattgaggagagaccagtgaggtgggtagaaaactgaagaatgtgtttcaaggaggaagtgattgtgtcaagagatcctgataggtcaagtgagaattggccattgagtttacctatatggagggtcatagtgatagttttggtgaagagatagggacaaaagcctaattggggagagttccagagagtataggaggagaggaattagaataattgtatagacaattatttaaaggaattttgctttaagtgggattaagtaatgctatagcatcactttatagtgctttaagtaggattaaggttagttgttttaagtttgtttattcaattaaaggagttttgctttaaatgggattagagatatggggaattttaattcttaaaacttatttatttaacaattatttgagtgcctcctatatgccaggaagtattctaggtttccaagatgaatggggagaaaattccctgctcatatggagttttccccaatgtataacaaaaaatataagaacaaatattggtaaggcctatgcagacatgatttaaggcagcacatcttaaactacactacactaaggaatcacctaaggattttgttaacatgtggattctggttgtgtaggattttgaatctcaaggagttaagactttttctccttcaaacagaagttgctcagaagacttttcatatattaggtttcgagcttgcaaatatactatttaatgaaccgtaataggatatttgattatattaaggaatcgttagaatttttagatttgatggtggtatcttggtgatgttttttaaaagtttcttttgtgggccaggcacagtggctcatgcctgtaatcccagcccttggggaggccaatgcaggagaatcgcttaagcctaggagttctagaccagcctgggcaacacggtgagaccttgtctctacaaaacatcaaaaaaaaaaaaaaaaattagcctggtgtagtgggacgtgcctgtagtcctcagctactcgggaggctgaggtgggagggttgcttgagcccaggagttcacggctccagtgactgggccactgcacttcagcgtgggcgatagagtgagaccctgtttctttaggggaaaaaaagaaaggcccttttgtagccattgaaataccaaagaaaaataaggtcctcatttattaaaaacacatactgaaatatatcaaagatatactgtctaggatttgcatcaagagaatatgaaagggtggaaaggggatggggtatgcatgggacaaaactgaccataggttagtggttgttgggccttggtgaagggtttataagggtgcattatactacttgtgaatatgtttcaaaactctctgaggaaacattttttaaaatgtggtaaccagacacaagatctcaagttgtagtgttccctatcttgttttaagaccataaggtcttagtttttttctcttaggtgaatcaagtgtatattatttattgctttaaattgttggcctatattaattaacacaagttcctgttacttagcttgtttcggcatttgtcccatatgtactcaaatatctccttgcttcctctttaggccacgccttggagtcactcttcataaggttgtagtagcaggagccctctatcttttgttctctggcatggaaggggtcctcagagttactggggttagtactgcttaatctcattttctgtggtcagttcaattatattgtttacatcttgacagtgtggattggaaatgtctgtgggcttctttctgtttgctttaagtcacttttgggctctgattttcaaaatatatgtatagttcatgttctcttttaaatctattagagctttgtaaatttagtgtgtgcccgaatgaatgcttttccacctgtctccaaattgctaattgttttagttcctcctcccaagcagtagacttgcatttttttttctttttctaatcaatggaatccagactgaaatccagactgaaattcttgtgtaaatggcagactttggagtcatacacttactagttaatctaatctaaagtaactgttgtttcttaacatttcagtttcaaaaacttccttaaaatgcagctaatgaggctgggtgtgtaatcatgcctgtaatcccagcattttgggaggccgaggcaggcggatcactaggtcagaagatcaagaccatcctggctaacatggtgaaaccctgtctctactaaaaaaaaaaaaaatacgagaaattagctgggcgtggtggcaggcgcctgtagtcccagctacttgggagactgaggcaggagaatggtgtgaactcgggaggcggagcttgcagtgagccgagatcgtgccactgcactccagcctgggcgacagagcaagactccgtctcaaaaaaagaaaaaaaaatgcagctaatgaagtttcacaccatttttgagaattgtataattattccctttgccagggaaggaaaccaaagaatctaagtgataaagaaatttatggctgggagcagtggtgggtgcctgtagtcctggctacttgggaggctgaggtggaaggactgattgagttcaggctgcggtgagccatgatcatgccattacactccagcaacagagtgatacctcttccttaaaaaagaggagaaaagaaatttatgttaccactggattaatacgaagaagtataaggttctctaggccatttcaattaattttcttattttttaaaaaaagactccacagcaacctattagattcaatattgtaaaaactataaacttggctttgcccacaagaaaacggctcaatatgttttgcaataaattgcctcttaaatcaaacactttgtggatgcacatttgcttttcaaatcacactgtcctctgtatgtaattctcttagacttctagcaactttaaccctctgtcaatttcattttctttcttctgctgttgctatagtatttttcttatcccttgactctgatagtaaacctggccctctcagcaattgacgcctgtgttattttatggatatcctttcagtaatgcctgttgattgggtaattagggttatataaaaaacatactctatataaactcctggaaacatgcagcatagtttttcagacagataattgccttacattttattttggggtgagctcttatttgtaaaatattataattttagaaattaataattctttgtatatgatgcagtaattttttttaaatacgagaaaagtcttttcagacttgtagccaaaattgcaataataggaaatgatagattaaggatggggcttataaacattagaacttttttggaatatggtcacttgttaacatggatctttatatatgaaaaactcgtacttagcagtatgtttcgagattgtaaatgacaatttatgtgaaatgcttatagctgtatattctatgtgatggtttataagaagggaagaatgattaggtgtcaaatgttctttttattttctttcagttcaatgcaaaaactttccagtgattatgtaaatgcagaatcatgtggtggtttcttctctgtgcctctctagacatctgtttttcaccacttctttttctttgtctgcaggcccagactgatcttgcttccttggcctttatccccttggctttcctagacactgccttgtgctggtggatatccttctcattggcttgtttgatgatggtccattttctccccttgagatgggtttccattgatctttctgcaaagagtttttatcagttttgttaattactccttagtgtggggaacagtgcatgctaagtcttaacaacctgagggttcaggtaagcagttttttttgtttctatttttttaattttaaaaatcaaattggaaattggtgactgtggaccgagctcgagataaaatcttttggcttttttcttttaagtgagcatttcatcttgattttgcacttcttgtttgtgtacctaatcatttagtgttagagtcactggctgtgctggtcctgctctgccttttagcctctagcaattcttaaatgctttgaaacttatgaaaagattttgatccttaaaatttgatttcaggaactatgtaaggtgctttgacttttctgaaactctgtatgttcagcaggttttaacccttatggagtgagtgttttcttgcctcattcaaaagctggcttggaattgtttgaagatttccacccttcagaataaataattgattcatttacaggcagagtcaaccagcagataacaaacaagcttctatttgagcaatctttttctcctgctctttaaaattaaatttatatattaggggcttggcctgatggctaaaggattcaagtttttggactttatcttattgaatttgttttggtttttatatatttggtcctattagcagttttcattattactgacctgatagattgtgactgttgaaaaactgtgaatgtaaacaaaattgttttgtgaatttgagtgggttgctgtataagagttttcagttaaagtgtccttggactaaatagccaaagcttttctagattagtatctttctaagtgttttgtgaacctctgcaagcgttgagagaagagggaggtgggaatggattgtacagtaagataacccaatgactaggtaacagctacggctctgtaagggcagagcaagtgccaaatcccttatttttgtatctgcttctcattctgaaaattgagccgggtgcagtggctcatgcctgtaaccccagcactttgggaggctgagatgggcagattgctttaagctcaggagtttgagaccagcctgggcaacatggcgaagccctatctctacaaaaaatacaaaaattcatcaggcattgtggcttgcacctgtagtcccagctgctcgggagcctgaggcaggagaattgcttgagccctggaagcggaggttgcagtgagccgagatcgcaccgctgcactccagcctgagtgacagagtgagaccctgtctcaaaaagaaaagaacattgaacgtgagagcagataccatttttagtagtcaccaattcccctcctgtttttctctggcaacttctacttgagaataatgttctgaaaatggagagtcattgcttttggaagcaaaccatatgagcttctcaaccaattgtaaggtcctcttaattcaggatagtgcaggcaactgatggcaggttccttaagatggcatgaggggactgagtgtagatctctgggagattataggcacgagtataattatgaccctcaactagatttgctggacagatgagaacagagctacccaccttaaagggagagagaagatgatgttaactctttgtcccttgcctgttactcatgttcactttatcttctgccatttctctatttattttctgtcttttttttttgtttctctagaaagcctcttcctttctcttttttatattttttctcttgtgattttgtacattcttactttattctggttctgtcttctctttaatgtctcattgaaaatgatgacttccggccaggtatggtggctcgtgcctgtaatgccagcactttgggaggccaaggcaggaggatcagttgaggtcaggagtttaagaccagcctgagcaacatagcgagaccttatctctacaaaaaaatttaaaaattagccaggcatggtggcacatgcctgtagtcccagctgcttgggaggctgaggtgggaggatcgcttgagcttcagtggtcaaggctgcagtgagccgtgattgtgccactgcactctagcctgggctagaccttgcctcacaaaaaaaaaaggaaaagaaaataaaatgatgactttcttattcatcttgaggtgtttgtgagattaagtgagaataagagagctataaggcctctgagagatctataagtttattggcatgaccccagatccttaaagaaacctgaaaactaattggctagcttactgttttttcctgaatgttgaattccttgacctgcaaacacatatttattagcctgactcaaacaatgaagctattaaaacttcggaggaacattgtaaaactctctttgtatcggcatttcaccaacacgcttattttggcagtggcaggtaagtctgggactttcttcttggagttcaaatgtgatctgtttagaatggacattcttaacctgaaaggccatgggtggacatagaaagttttgtatatttcacttggaaaagggttcttagctcttgtcaaattctcagaaggatctgtggtttttaaaaagttgagaaccatttattttatgtacagtagctggaaatcaacctcatatttcagctcttcatttatccctcttctatttgcattctttcttgaggcattctttttcttgaggttagttagcttaagtgccagagagtactccttttagaagacattaccacatgtttgtttagttttattaaatagttgtagaattttagggtgcattgctattatagtggttttacatatgtcagcaagcatatgtaaaaaattgacattaggtggactgtaaccaaactaggctaatttgcctacctcctgacccttgtaccaggaatagtgaggtctgatttatgattggaactagctcttctgtttgtgttacagtcgttttatcagccattttttttcatctgaccagccaaagaaaaattagcattactatactaaggataaaaggagaaaaaaattatattgataatgctggaaagagctatatttccaataccttattttccaaccacactggttactgatgtagccagatggcaaataacattattaccaaattattctttaaatagagaaaggattggccagagtatgtatcatgagccttgctgatagcaggtatacagtccttttgtattgaatacatttgttaaaataactgatagagttgtgatgtatttgggggttcggggtgtgtgggattccacttaaccggaaatgggggaatgtaattggggatgtaaaccagcattcatactctgacctggtttttcatttactgttagcatccattgtgtttatcatctggacaaccatgaagttcagaatagtgacatgtcagtcggtgagttataagcacatttatgaataatgtactgtcttataaacaactgatggtgttgatgacagtggtaaggttcttctaagttatataccttataaaaaattagagctaggtctctactctgagggttgtgatacttccctcctcctaagtattctgtactatcatggtgcttggtatagtagttttttgtttgttttttctgactgtattctcccagttttgggagagaattttgtaagttataactacagtgtgctataacccagtcttattttaactaaaaatcttaagaagtccagagtactaaatattaagtaccatatgtgtaaataatactaatctgaatagaagccacatccttaagatctgagctcaacgactgtgacagtaggatttcttcagaagcagctaaggctcttattttgttcaataaataatgaaaatgaaaattataaagtataccaacctaatgtaactttctcttacactgtataaggtaactttctcttaaccctgtataaaaccctttcttaaagcttctcagagggatgatgaagctttgacaaatactctgttccgttgatgcattttctttaacaacagtaagcactacaagggcaaaaactacattcattcactttgtttccccacacttaccacagtactgagcacgtagcaggctcttagtaaacataacttgaatgaacaaataagtgatttttgttctatgccaaaggctttatgaacaaggggttaagataatgtgtataaatgttgtacttctcccctgtattgtaggactggcgggagctgtgggtagacgatgccatctggcgcttgctgttctccatgatcctctttgtcatcatggttctctggcgaccatctgcaaacaaccagaggttcttggactcttctgtttactctgctaacatgagatgaccatgtcatcaattaggggtggtgcattgggggacagtatcagggctgtgtcatatagtggaaggaacactgggcctggaatcagaagaactgggttcctatctcagctctcctcttaacttcatgatttttggcatgcagcctctccacctctctggccttagtttcctttctatatactgagggggaattaaacccagcaacatgaagttcctttcagctctgacattttgtgataaatacacaggcatactatggaaataaattgcaagtttggtttcagaccatcacgataaagcagatattgagttacatacatattttgttttttccagtgcatatcaaagttatgtttacactattctgtagtctactatgtgtgcaatagcattatgtctaaaaaatatatgcacgttaatttaaaaacactttattgccaaaaaaaaaaaaaaaataccgacacaggggctgggcgtggtggctcacgcctgtaattccagcactttgggaggccaaggcagttggatcacctgaggtcaggagttcgagaccagcctgaccaccgtggcggaaccccgtctctactaaaaatacaaaaattaactgagtgtggaggtggatgcctgtaatcccagctacttgggcaactgaggcaggagaatcgcttgaacctgggaggcagaggttgcactgagccgagatcatgccactgcacagcataggtgacagagcgagactccctctcaaaaaaaaaatgctgacacacaaagtgagcacattactgttggaaaatggcaccaatagacttccttgacatagggttgctgcaaaatctgggaagcacagtaaaatgaagcaccataaaaccaagtataactgtaagtatttgtatagtaaacaagggagatagatatataatctattgtgtcaaccaggcacggtggctcatgcctgtaatcccagcactttgggaggccaaggtgggcagatcacatgaatccaggagtttgagccaacatggtttcggccaacatggcaaaaccccacctctactaaaaatacaaaaattaaccgagcatggcagtgcacacctctaatcccagctactcgggaggctgaggcacaagaatcgcttgaacccggagacagaggttgcagtgaggcgagatggcgccactgcactccatcctgggtgacagagtgagactgtctcaaagaaaacagaagatataattgtatcacttacactgagtctctcctgtctagtgtctagaaggaaagaaaatttctgtaaccagcagcccagctcactttgtaatgatagaaagggtaaaattaaaacttacataaccaactttgaaattaaaaatgtatgtgtaaatctgatttgtccaactataggcaaatttcagtcatttaggaactgcctagctttattttgtgattatgccttccccccccccccatttgcatttagacggttaagagcttatattaaacacccataccaccaaagaaggaaaagggtagcatgatataaatgactaattttataaccagacccaatgaaagattgaaatagaaaataggtgaaatccttttactccatgaaaatggccttgctgtcatttcaaactatgcactttatatgtgtttatcaaaaaaagtcagaatagagaaaagtaatgaaagaaaataaaggagatctgaaatcacactattgagaaagaacttttacattctggagacccttcttttatatccgtctgttgatctactggttactcactagctatatttgtatttaaatattttcccttcctcagtcattaaaaaatttttgcgttaccttccctcttctttttttcccccttttcttttaaaacattgccccctttctctgtgacttcagtgttaactgcatattataatgtgtcttttccctgttcatgtatggaatcttacattactcttgtgacagtacattgtggagattccttccagtgtaacaggtttaactgaactcattcattttcatggatagcataaatatgggacatgtgtagtacagttaaattaacatattctcttattaatgggcatttgggatatttccagtttgaggtgtgtcagggtcctcaagaccatcctgatgttcagtgatttactagaaggcctcatgggatgcagcgtacagttatactcacagttaaggtgtattacaacaaaatggtgatagcaggtagagtctggggaaatctgtattttctttcctggtgttcggtctctcttctgaggaagtacatcaagtcagttcttttccccagcaacaaaaatgtagtaacacattgtttctgtctgggaaagcccattaatgttcagcactcaagatttttattgggcagtgttacctcctcccagccaaatatgtgacagtatgcacagactattgccaatgtgggaaacccatttgagctttcaatgtccagagtttttactggggctcaatcacatactgtctctgttgctgacttttagtttccaacccctcctggcagtcatgctaataccatttcctctggaggtcagagctgatatggcatggcccaaagcccctatcataaaccatactgttacactgtcagccaaagtccccaggcaaataaagacaggacatgttatgggtgtcgggatcacctcacattagtcaatgaaggttaggttctcactacacactggcacatgctcaagaaatatttaatgagtgggcttggatttgctaggttgaaggatatgtgtagattgtaatttttaaagtatttccagattacgttcccaaaaaaaacctgaaagaaattgcatatttaacaacaatggtatgagagaggttttttcttcttcccttgttttatgtcccatcattttatttaatttctgcagatttggtggatgagaattaatattgttactttttgcatttaaggttggatctttagcttattttttattggcttattgatcattgtctctgtccattttcagctgctataacaaactaccacagactgtttgtttataatgaacagaaatttgttggctcgcagtgtcagcatctggtgagggccttcttactgggtcgtcacatgacagaaggtggaagggcaaaagggagagcccactccagaaaaccctttatgtaacagcattaattcattcatgagggtggagccctcatgacctaaatgccttccattaggcccaactcccaacactgtcaccctgggaattaggtttcaacatgagttttggaggggacagacattcagactgtaacaatcacttatgtattgattcgtaggaatttatttattttgagatggggtctcgctctgaagccaaggctggagtgtagtggagcaaccttggcccactacaacctccacctcctgggctcaaatgatcctcccacctcagcctcctgagtagctgggaccaccggtgtgcaccaccacactgggctaatctttgtattttttgtagagatggggttttgccatgttgcccaggcttgttataaactcctgagctcaagcgatctgcctgccttggcctcccaaaacgctgggattacaggcgtgagccaccataccaggcccaatttgtaggaatttctgatatattttgtatgccaatattttgtttgttctaagtattgcatatattttctgccagttaataatcttatgatttttatgctgtttttaatcatacaaaatctcagaaatatggagtagtttttcccttcaaggattgtacattttgcatcttattttgacaaattcttatctagcctaaggtgatttcaaaaaattattctctaatgactttttaaaaatttcacaatcaggccgggcgctatggctcatgcctgtaatcccagcactttgggaggctgaggcgggtggacaacctgaggtcaggagttcgagaccagccggaccaacatgatgaaacctcatctctactaaaaataacaacaattagccaggcgtggtggcaggcgcctgtcatcccagctacttgggaggctgagacagcagaattgcttgaacccgggaggcggaggttgcagcgagctgagatcatgccgttgcactccagcctgggcaacaagagagaaactctgtctcaaaaaaaaaaaaaatcacaatcaagatgttcatccaccaagaattacttgattctaggctctctactctcttctgttctgctcctgcatcagtagcacactgtctgaattaccctaggcttctgataaactgtggtatctggagggcctgaacccctaatcatatttataagtgcaggctcagctgcatactacctggctcttttaaaaatagcctttgggccaggcaccgtggttcatgcctataatcccagcactttgggaggctgaagcggacagatcacctgaggtcaggagttcgagaccagtttgaccaactagaaaaaccccgtctctactaaaaataccaaattagttgggcatgatggcacatgcctgtaatcccagctatttgggagactgaggcaggagtgcttgaaccccaggagggggaggttgctgtgagctgagatcgcgccattgcactccagtctggacaacgagtgaaactctttctcaaaaaaaacaaccaaaaaaacatttggccaggcgtgatggctcacacctgtcattccagcactttgggaggtctggccgggaggattgcttgagcccaggagtttgagaccagccctggcaatatagcaagatcccatttctacaaaaaaaattgttttaggttagctgggcatggtagtgcatgcctgtaatcccagctacttgggaggctgaggtgggaggatcacttgaacctgggatgtcgaggctgcagtgagccgtggtcataccactgcactgcagcctggacaacagagcaagaccctgtctcaaaaaaattttttaaaagcctttggtgttgaatttttgccctttatttttaaaatttttttattttagatggggtcttgctatgttgcctaggctagactcaaacttctgggctcaagggatcctcctacctcagcctcctcagtagctgagactactggtacatgtcactacacccagcttttgttttttaataaaaattttagattgcttaattctaggaaaacctattaagattttgattggaacttaattgaattaataaattagggagattatatatatatttttgataattccttgagtatggcatctctccattttttagtctttgaattacgttttgtaacttctgatttaaatttgtgactcttacgaatgcaacttttaaaaatatatacagcttttccaaatatgtaggaatgctgttgccttttcctctgtctctctctctctctgtctctctctctctgtctctctctctctctctctctctctgtctctgtctctcctttcttttcttgacggagtctcgctgtgtcgcccaggctggagtgcagtggtgcaatcttggctcactgcaacttctgttccccggggtcaagggattctcatcagttgatggacaaagttgttttcggccaggcgcggtggctcacacctttaatcccagcactttgggaggccgtggcgggcggctgaggcaggcggatcacctgaggctgtctcagcctcccaagtagctggaattacaggcgtgcacctccacgcccagctaatttttgtatttttaataaaaaaatgcaaaaaattggccaggcatcgtggcgggcgcctgtactcccagctattcgggaagctgaggcaggagaatggtgtgaacccgggaggcggagcttgcagtgaggtgagatcatgccactgcactccagcctgggcgacagagcgagactccgtctcaaaaaataaataaataaataaataataaaacaaataaataaaagctaaagcattctaggaattacatgtctgggagctgctttgctgaatctcttggaagttgttaaggaaaggcatctgagatataccagatcagaccttcatcttctgagcttcccacttgtaaactgaaattaaattacctggaataggcctcccttctcttaactcccaatttgaaggctgcgattttaaattagatgagaatttacttaactctatttgatacatatccttatgaatgaacatttgttgactgtctactgaatgtgacaggtattgttctaagcactttatttgtaacgacttacttttacaaaacacccctatgagtaatgttctattgtccccttatttacagttgaggaaactgggtacagagagattaagtaactagtctgatgtcacaggtagtattcagctgagcctgcactcataaatatgatactgtcctgcttctcccttgctaatataggcaataaagagctttctgaaggggaagaaatattattattaaactgatttaatgaattactataattgcagtttcaataattagttttgtaaaatgcaactggtatagcagtttttgaagttttctaattttttccttctgttcactttggttctgttaggtttgccttttcaccattgtctgaggaagaggaggaggatgaacaaaaggagcctatgctgaaagaaagctttggtaataataaaattcacctcttattagtactttaaatattatttttctgtaagtacattgtttattattttataactgtgttgttcctatatttggtgtgggatgaagtcagggttaagaaaataagggtgtgaatcttaagatgaaggcatggtaaattcagtaagtaattgcacattaagtatccattttacttgctagaagtgagctaaaaattttgctttgaacttcccagcttacatataaagatggagaagcatctgttgtatacttcacaagtattaggaagcttaaaataaaactatgataagtaactttggggcttttaatttaaaaaaagaaaaagttctgaatccgttttgccaacattgttggtctgttcacaaagttaaacagtgtatatttattttcttctacagaaggaatgaaaatgagaagtaccaaacaagaacccaatggaaatagtaaagttaacaaagcagtaagtatgacttttccatttgtctttgttctttgtcccatcttccaacccttagtagaactactagaagaaaacaggaggaaaattctgtgacattggtcttggcaatgatttttttttgtatatgaccccaaaagcacagggaacaaagcaaaaatagagaagtgagagtacatcaaactataaagcttctgcccagcaaaggaaacaattaacgaagtgaaaagacaacctacagagtgggagaaaacatttgcaaacattgcatctgttaaggggttaatacccaatttatataaggaactcagtagcaagaaaacgaatagcccagtttaaaaatgggcaatggacctgaatatacatttcttaacataacacctacaaatggccaacaagtatatgaaaaaatttttatcattactaatcctcagggaaatgcaaatgaaaaccacagtgagataacacctcacacctgtttgaatggcatttatcaaaatgaagaaataacaagtgttggcaaggacatggaaaaaagggaacccttgtactctgttgataggaatgtgagttagtatagccattatggaaaatagtatggagcttcctcaaaattaaaaatagaactaccttatgatccaggattcatgtcactgggtatatacctaaaggaaatgaaatcagtatgttaaagagatacttgcactgtcatgttcattgcagcattaatcacagtagccaagatacagaatcaacctgcatgtccatcagtagatgaatggataaggaaaatgtgtattttgatatacaatggaatactatttagattcagaagagaaggaaatcttgtcattcgcaacagcgtgaagaagcctggaagatactatgttaagcaaaataagccaggcacagaaagacaaataccacatgatctcacttacgtcgaatctaaaaaagttgaattcctagaagcagagggttgagtgctggttaccaggggctatgggagaactggggagatgttggtcaaagggatttttaaaaatgtttttaaaaattaaaatatttgacttttctgtcagcagtcccatttgtgaatgtatgactacagaattatgaaagacaagttttaagaccttcatgtccttacttgagatgtattatgtggtgcattttagtaatgagtggtatttgtatgttcccagcaggaagatgatttgaagtgggtagaagagaatgttccttcttctgtgacagatgtgtaagtttttgaatgattaccacaagaatcctatttcaaagttagtactactttgttattattttaaatgagcaagttatactcatgaaaatacaagatactgaaaaataattaaaagaataggaataatccgcaaacaaaattaattgggtttattcattcagatgacatttctgcttagaaagatttagctatgtagtatatcttaaaatgaatgggatactccttttgaaatttttagttcctttccagggctataattttaatgaaacattggtcctgttgcattgcaaaatacgttttttttctatacaatttctgtaactgttgcttattgtatttgctgtttatttttcctaaaagggccattaataaaatgcaaatcttagataattataaagcttttaattgcattattccattgtcttttatgaaccatttatggctttattttacattgttcaatttagtatttctctctctttgcagagcacttccagcccttctggattcagatgaggttggtactcaattcacgtgcataaattatgtatatggtgactaaatagaaagtcatgaatcgtctgttcatggagattctctttatttgactcagtagtggcctgaaaactatagtttatatagttgaaaaggataagaatagaaatactaatagagttcaaacattcaagaatcttcctttctttgcatctgtctatacatgtttcacctttcaaagttatatggtcagacttcagaatgtttttgtttaaattgggtagtaaatacagtactctccaccatctagttcttttgtctgtaagaaatgcaaatttaactctaatctaatattggcaaaaataataaggaaaaatattgagaaaggaatatagtagaccaaaacaaaatctaaattgttacctactatttaataatatttttgtcactaccttcttcagatagtaaggattataattagtacctctaatatttatgtttttaatcttttagtttgcctccatacagttaatctagaaggcttcacatgaagtcttatgttaggattgtgggccaggtatagtggctcatgcctgtaatcccagcactttgggaggcctaggcaggaggatcagttgaggtcaggagcttgagaccagcctgggcaacgtggtgaaaccccatctctacaaaacatacaaaaattagccggagatggtggcatacacctgtagtctcagctacttgggaggtgaagtgggaggatcacttgagccctggaggcagaggttgcagtgagctgagattacgccactccagcctgggcaaaagagtgagaccccatctcaaaaaaaaaaaaaaaagaaaagaaaaagaattgtggcctgagttcatggaaactagttctggatatgttctgaatattaggtcattttagagtttttgtttgtttgtttttgttttgttttttttcaggaagccttttggaagcattttgtctgattctgattcattgtgttgaattggctgctaaaaatgttttgttcatttcccactgacatgatctttgacacagcatgtacagtatcaaattccttagctgttctatgtgttgaaataattgagaactctaccattcagatttgaacctatctacataacactttgctttctgtggtatattctgctgttcccacatctccctcttgaggtcttcctctgctaattatttgcctttaaggcttcccttgtacttcagctctccatgagctgctataagcagagaaggctgattaattgaaacctgattgtgcccttcatgggaatgcaagtttgctatagtaatttggtggcactgagttcagccatctgttcatattttcctctgtgaaaacactgtgcaagattttccaggtatacataaggcttttttgtggtaagaaaacataacaatgagatctactctcttaactcctttagtgtacgttacagtattattacgtataagcacaatgttgtacagcagatctctagaacattttcatctcatttaaatgaaattttatacctgttgaatagcaactcttgctttccccctccctcagcgcctggcatccatcattctatttctgcctttgagttctattttagataactcatataagtggaatcatgcagcatttgtccccctgtggcttgcttatttcacttagcataatgtcttcaagatttatctaagttgtagcacatgtcagaatttccttcctttttaaggttgacaagtgttccattgtatatatgtaacatgttatcttcatccatttatctgtcagtggacacgggttatttccataccttggctgttgtgaataatgttgcagtgaacatgggagtgcacatttctctttgagatcctgcttcatttcttttaggtatatatgcagaagtgggattactggattatatggtagttattttttaatttttttgaggagctttcatactgttttccatagtgattgcaccattttacatttccaccagcaatgcacaggggttccaatttctttctttgcccacatttgttattttttgttttttgataatgaccatcctaacaggtgtgacgtgacaccttgtggttttggtttgtatttctctgatgattagtgatgatgagcattttttttatatacctgtcagccatttggaagccctcttttgagaaatgtctcttccagtccctggcccagtttttaatcaagttagttgattttttgctgttgaattgtaggggtttcttatatattttggatattaaccctgatcagatacagtcctatgccacatttcagtcagcaacggaccacatatatgacagtggtcccataagaacctccgggttcacgccattctcctgcctcagcctcccaagtagctgggactacaggcgcccgccaccacgcccggcaaattttttgcatttttttagtagagacggggtttcaccgtgttagccaggatggtctcggtctcctgaccttgtgatccacccacctcagcctcccaaaatgctgggattacaggcgtgagccaccgcacctggccaatactgaatttttactgtaccttttcaatgtttagataactttagatacccaaatacttaccattgtattccagttgcctttggtattcagtacagtaacatgctgtacaggtttttagcctagagcaataggcttatacatatagccgaggtatgtagtaggctatataacatctagatttgtgtaagtatattctgtgaagttcacacagctatgaaattgcctaatgatgcagttctcagaatgtatccctatcattaagtatacgtgactgtatgtagtatgcaaatattttctccaattctgtaggttgcttttcattctgttgtgtgcttcccttgctgtgcagaagctttttagtttgatgtagtcccattggtctgttttgctcttgttttgtgcttttggtgtcttagacaagaaatcactgctaagaccaatttcaagaaacttaggttgtcttctaggagttttgtggtttcaaatcttatgtctaattctttaatctattttgacttgtctaagtctttaatctattttgagttgatttttgtgtatagtgaagatgagttactttcattctttctcatgtgaatatctagtttttccagcaccatttgttgaggaaactgtcagtttccccactgtgtagtgttgtctctcttttcgaagatcagttgaccatgtatgtgtagttttatttctgggctttctattttgttccacttggtcatagtatgtgattctttcaacgtgccgttaaattctgttttccattgtttcattgaagatttttgcgtctgctcatcagggatattggcctgtcgtttctcttcttgtcatgtctttggctttggcattagggtaatgctggcctcatagaataagtttggaagttccttccaaataaatgttttcgtctttaatttttttgaaagcgtttaagaaggattagtgttactttgtctttaagtacctggtaggactcaactaaagaagccatctggtcctgggctgtttttttgttgggatgtttttgattactgatggaatcttgttgtaggtcttaccaggttgtgtgttccccccccggattttctattccttgatgattcagtcttggtagattgtatacttctaggaattatatattttgttctaggttatccagtttcttggcatatttttaaaaatgttttgtatatttttattgaaattcttactttgttcatgcattgttctcctgagttcgttgaacatcttcatgatagttgttttgcattctctttcaaataattcctatacctctgtttcactggggttggtttccagagatttatcttcttcctttgtttgggccatgtttcactgattctctattttccttaattctttgtgttggtttcattgcattagaaaaaaaaacagttacctttccagtgttcatggactggcattgtacaggagaacaccctcatcaatcattctgatagcctctctaacccactctgtattatgtcttttctggacttctgcatatgtattcccaatcagagggatttgctgggtttttccctccccaggaatttataatctcttgctcccttttgtgtttatctgctgtatcatgggtctcctggagccagtggcatagcccagctctttttttgttcatactggccccaggcacctaaaatatactggtcccatctgtgcttcaaaccattccctacagaaaccattccctcaggtaacctcttacaaagttggaacattttcacagtccatctctcctccctagggaaaagctaggatttggggatgttggggattctacctgcttactctgcactgagctgggggagcggctgtagtgagctcatgcttgctagtccaaacttccactttgatttcagcaacttccaacctgggccctttgtttttagctctcggactcaggcaagacagaaaacagtctctcgtgcaggttccagaaaagtcagaatgttggatgtacattccagtcatttccttccctctgcaaaaagaagctgggagctgagggtttcctctctatcatgtggtactgtgctgggtccatgggaagggaagaattatggcaagagggtgcctcaggtttttctgccgactttgattcagctggtttcatgctttcctatagtgcagaagaccctcaactggtttctggatttcccacaaagggaatttttccatgtgttattgaatcagtgtgtctgtagagggaaggagtgtccagggcttcctattctgtcatcttgctgacatcactttctccaaggcctttttttcccttaaaactgaaaaagaccttaaatgaattacaggagaaacaatttacatgatggaccaggaatcaaaatggcataaggctcttcaacaacatctttgggagccagaacaaagcctttgaattctgaggaaaatcattttcaacctagaattctgtactcaactaaactatcattatgagggtaaaataaagatgtttctagtcacacaagaagtaaaataattgatgttctatatgcagtttctgaagaaagtaggggaaaatgttctccacaaaaatgaggaagctaggaaaaagacttgggatctaggaaataaagggtccaacacagagacaagaaaaattcccagtatgatgtaagaaattctcaggttggcagctgggcaccaggcttggatggagtggagaacagagagcatcggaaaggatatttttaagaaaaagggaaacatctatagattatctgatgtgattgattatattcaaaaaggatttgtagttctgtcagtttgtgatacaatagtgagaggtacttcgcaaatgaagcaaaagaaaaatgaaaattaactctaaggtataaaattgcctaagaagggaaatttaagggtagtacattaattattttaattgaaatgggatactgtaaatactatattaaattaaatgtaattttattttttacatgatttttaaaaagtgtagtaaaaaacacataacaaatcaaccctcctaaccattctaaagtgcaaagtgctaactaggtgcacgtctttgccctcatccttcactgggtcttcaagtgaaattcctgaattagaggagttacacatttttattaaagcctaatcttatgtaaatatttgtttacataagatcttagctgactctatacatttccttctgagtgctgattttctgtccagaagcctagagcttttgatttagttgttcttgggtgaggtctggacatctgtatgttcaaaatcttcacaaatgtttaggaaccatttctctaaacatttaattaacataaagtactcgtggaagatgtttgcttggatagtctgtatagaagatatttggaatatagatcattttaacctaatatacttcaacctttttttttttccctaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaac

SEQ ID NO: 37650 - DNA, 18308 bp, Homo sapiens; identical to SEQ ID NO: 36177

SEQ ID NO: 37651 - DNA, 34606 bp, Homo sapiens; identical to SEQ ID NO: 37432

SEQ ID NO: 37652 - DNA, 85319 bp, Homo sapiens; identical to SEQ ID NO: 37206

SEQ ID NO: 37653 - DNA, 2751 bp, Homo sapiens; identical to SEQ ID NO: 36048

SEQ ID NO: 37654 - DNA, 85319 bp, Homo sapiens; identical to SEQ ID NO: 37206

SEQ ID NO: 37655 - DNA, 51644 bp, Homo sapiens
ccgggctgcgcggcgaggctgacccgggcccgggcgccggggtcgggggcggctggcgcgggcaggaagcgcatcgcggcccgggcccgccccccgcctcccgccgcctccgggctcccggctcccggccgcgcctcgccccatgcactcgccgcgccgcgcagcccgcgcacgcccggatggctcctcgcgccgcgggcggcgcaccccttagcgcccgggccgccgccgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgtgagcgcaagctcaacatccaggtacacccgggcggtggcggcggcggcggcggcggcggcggcgggggcgggggcgggggcgggcgggaaccgagcgggtcgtgagctgagtgggtcacaggtgggagcgcgcagagatccagatgtacgtggaacccaggtgtgcacgcgagaatacaggtgtcccccgaggggtactactggcgcctgtatggcccaggtgggcatgtgcagggactcaagtgagtgccggctcatgggcgcgcatacctaggcgtactgggaggggtccaagttgccacaggtacccaggtgcgcataaagcccaggtatgcacgtgagggtcacaggtgcatgctgagggcgcagtaagtgactgcatgcctgaccaaagttgtgttctggggccactgcgtgagcctgtcagagttaccattgcacgttggtgatgggtgcatgggtgtggcaggtgtgcaaggaggcacacaggtgtgcaccagggccctgcagatgtctgcatggacttgtgtgccagcaagctggggcctgaagacgcacagggcagacaggtgtactgcacagacactggtacaacgggacagggctaggtgtgcagtgggatgtgcgtggcaggggacgcaggtatttgggcatgagtcggtactctgaggaggctgcatggttggcaaacaggtgtgtgcctgaggccaacttttattcacctattctgcaaatatttcctgagcacctagtatgtaccaggtgtgggagtctggggtaaacaatagcacttgtggagtgccagctaggggcatcacatgtcacaattcccagttctcagaacaaccctctcaggtagcctctattctcatcacattttacagatgaagaaacaggcacagagaggttaagcaacttgctgaggatcacacagttgggcactagcagaggtggatttgaatccagcctgtctggcctcagcatctgtgtttttaatgcccagcctttgctgccttctggacttggatctcagagtgcgtgtgttttgggggcgtcccaggcagctggggtgggcagatgccagggccaggagaatggagggatgtgaacaggggtgttttgggggcaggagagggccgtggggctcagtggggaatgaggaggagtacaggcaggcatggggcccaggtgtctgaggctgggttgggcagtagcaaggggggccaggttgacggaatcagcatgtgtgttgacatgacaagggtgcgggaggggacttggtgtggttccctgaaaggaagttcatggcaagggattgctcctcacactggctttgggagctgggtctgttgatccccatagttcaccctgaggaatgaggccccagaatgacactggggcctttcccacaccctccacccatctgagtctggcgagcccacttcagctccactgcctgccattcccttaggaagctgcatctccatcagcaaaatgcagaactcagccttcttgtggtgacccaagccttccttggggccccaccctgtcccttctccatggctgtgacaagaatttcatgagattaaccattcctctgtgggcgggcccaacactggggctttgagaaaatgcagattccttctcccaaggtcgaggtcggtctcccacgactgcccaccatctggccggccaccctgaaagtaaaggtcacggtgggtgagcagggcagacagtccaaagggtggtggggctgcttgccctgtgccatggttggttcatccaccatctccaccccagagcttcatctcgcaggcaactgtgtttggcactgggggtctcagtggggagtcgctgaatggagagaagtgtcctgtggactgagggccttcctccagtagtttcaggccctgtgtctcggccctttggtgtaagctgatctgtgggattccttaggccagcccagggttccctccccctctggcaagaaccattctggttcccacggtccgctccctcggtgcagtgactcacccagctgaggggggctggagcttctctacctaaggggacagggcctctccagggacacagccccaggacagagtggcgaagggcctcttccccaccccaaggccacagattccggctgcggccttccttggtcaccctccctgtgttttccacacccttctcctcttcgccgtgcccgctgtgggcacaggccagtgccacttggcagtatctcccagaggtgctcaaggtccccggtctgggcctctagcatgggcaggggtgggggagggatcattattcttgctccaggctgttgccagctatgcagcgacagattcagaacctagactttgcatcaggctgcttgggttcaagtcccactttgtcacttcccagctgtgtgaccttggccaaggaacttaacctctctgggcctcagtttcttcatctgtgaagtggggacagtaaaagcaatccttatcccaaagcattgttttaaggactagatgaatcgataaatgcagctcagtgtacccagtacacagtaagcaccaagcagatggcagttcttcttgttattactctaagggacattattagcacaggtctctgcttggtcctggagagcagttgcctaatctggcttgttctgcagctgtaaacaccccaccatctcctacttctagccccagatgacacctccatagacatttactaagtccctattgtgagcccagtcccatgctgtgccctggggagccaatggcaactcactttgtttctactcttgtgggctgggcaggtgagccgaggacggatgtgtgaccaggcccttatacacagggcaatgcgtgccgcaaagggagaatgagggtggagggagcccagcggagggggcggaggagcaggaggaagccaggtgaggccggagaagaggaaaggcatccaggcaaagggagcagcctgtgcgaaggctgtgagcaggctcgagggggtctgcgtggccaggcgagtagagtgggaagcacatgacacaagggccagggaggcctggggagaccgtccttgggagtctggactttatcctggggtcctgggagccatgaagggttttagccagagaagtggagtggtctcagcaggcacctgagtctccccgctgcagaaggggaatgctcgtgaatacctgcctcttagggctgttgggggtattaaatgagatcatttatgtacctggcgcctgtttgcaatgactacaattcttctacctattattttagaaagcccctaggtagctggtgagaaggagcaatggaggagggagagtggctgagaggctgaggccgcctcccgggaatagattccttcactcagtcgcaaatatatcttgagcacttactgtgtgccaggctctgtggtgggtgccagatggcagtggggagatggggccggccttgttctctggagacatggctggcctggtctgcagcagtgctgagggcttggagggtggcaggtgggctctggacagatttgggggctgggatgcagccccagtggtggggagtgatgggatggaggagcagaaagctgcccagagtcaggctcagcaacaggatagatgttggtacccatggggtggggcatgtgatggggtacctctggggaagaggatgagtttggtctggggagaaccaggagcctagaatccttttttctcctggtcccatctggctggatttctctgtcactggcactgggtggcctgggtggggctgcacatggggcaggaccccagggccgaatgacctgcaagtggggcagctcagccaggcctttggaaacccagcctctcgctcctgcttgagggtctcacgaagaaccctgggccctggcaggaatcccttgagccgcccacaactccagagcctgggtcaggatggcctcccgacattccgggttcccagctgacaggacttgccctctgccctccaccttcttcccgagaacccaaagggagaagctgctgaagtgtgaggccagaggcagagaacctcggtccccgcagccctcagaagtccccaaatttgtccctgattgttttcaacgtatttggggcagttaagatattttgagagaaactgagtgaagaaattagcctccattgcatgtagcttggatccctttcctcaaatcacaacctgtttggagtgcaagccagttgggaagttgttgagtgccactgatgggggaaactgaggcacagcatcacccaacaaggtggggcagactgagtctaccttccttccccaagtctttctccccaacctatgaatgaccataatatttgtatttttaaaacaaaaggaataccgacaggccaatgtcagtgcagcattttcaaggtgtctttttatagtaaaggtggaaaaaaaaccatcaggcagttttaaactggcatgcagtgggtgggtgcacgtcgtcaagaagacatttttttgcaccaatttaggggctgagatgccaggtgggggcggagggagagagagcttccaagatgggctttacatttgggtttgggctgggggctgggagtgatctcccagtgacgaagggtgcaagcagagacacttggcaggatttaggagagggggttctaggaggattggctgagatgaccctctggcctggagaaacagatagggcttggaccaggagacatccctcccagccctgagaatgtctcgacccccaggtacatgggcatacagtccataagctgtgtgtcccagggccagtcatttaccctctctgggcctcattctttctcattataaaacaggtcttatgcctccctcctaggatgtgggtagattaaaatctcaggggtgtctctctcagcctactctggcttagggggctgcccataataaaaaataaatacataaaataaaacctcacatgcagtgcccaggaaatggcaggcacaggtattagtatcaagagggagaaaagacaccagaaaaaactggcctcagtggacaggggatgctcagaggagggagggtcagggccttggaggagatgagatcaaatagggcctgaaggcaggcaggggtgggtgagacgcctgggtgcagcaagggtgtgttgggtgctgtcccagccccagcacagagactgagatggagagaatggtctctagtgcccgggctgaggagtccagggcagcactgtcttgaaggcaagaggcctgtgggctccttggagtgaataaaaaccgtcgccgagctcgcgctctgcaggccttttataagcacctacatggttgacctcatggctgcccctcccctggtcaggcagacagtgcgtcatcatcatccccagcttacagaaggggaaactgaggccaagagaggggaagtgacttgccctggctcacacagctggggagtgagggtctggatccgcagatagaagcaggagtcctcttcctggtggctggtgagctgtgagctctccgtggtggggaattctgcagttccccctctggctgggccatagagattcaggcagggcccattgtgatagcagtgactcaggcgggctggggcatctgcagaggccaggccacatgctgggggatgggggctgacccagcttcctgaggaagtcaggggaggcaaggaacttctagttgcatttgtctgaaaatgcgatcatcagcctctggaaggagtgagcccatggccctttgggtgtgcaaatgagagatgtgggttcaatggtcagtgtgaatgatggtccacccaggagggtgagtgggggatctgtcagcgccctggatacgcccacagtgaggccttccacagccaggcaggcgcacatcgctaggtgagtgcaggaccctggggccaacttcccagattcaaatcctgcctctgccccttcctagctgtggaaagtcccatccgttcttggagcctccattttcccatctataaagtgggctgagcgcagggaagactggagtggcctggcggcattcagcaagggccacgcgcatcgggcccggcagaaacgccctctgcaaagtccgattcacccgcctgtgactcccggtctccatggagattaaggaaaccagctgggttccatgtcctggttgctgccgtgaacaaagacgcgtggcgtgtactgggacaggagcgggagggcaggagccccgggagagagtggtgccttcccctacctgggcctccgttctccgaccctggagttggcccatggagtggcaaggaagccttccctctgacaccagaactgccccatcatgtcataattactgtggttgttgcttgagaactttctctgtgttagccctttgcagagcactttacatatcttttaatctccccagaacctgaatgacatgactgttatccccagtctatggaaggggaaacagaggtccagaagggttaagcatcttgcctgaggtcacaccgtggtgtgtgactgtggtgctccaggtggagcaggcttctggctgtagcgcctgtgacccctcattcctccaaaatctttgaccgaaggggtgtgagccagagggtgtcggaaggggtgaatgggcccattttaaaggtgaggaaactgagacccagggaacttctgcgtccgccgaggcccctgtgagaagcagtgagggcctttcagggtggcctgcagagctgcccagccccagcgcccatcatggtcgcgggctggggttaggatgaccccctggtgtggactcctgctaccgggcctgtagctgtctccacccacacataccagaggccagcacctccttggtaacatcgcatgcccgtccaagctctgggtggggagctctctagagtatgtgagtatgggaggaggctcagcttgctacaggacagcccccaagagagacaaattggaccctctccaggagcccccagaatggtgagggaggaggtcatgacatcagacagatgccacacactaaccagctcatcagaggagtgcgggagggcttcctggaggaggggaggttggagcagcacttgacagatggggctggggaaggcattccaggcagagcacacgataggggcaaaggctcagagatgttggaatgtggcttgggtagcaggccgaggggaagctgagagtgtgctgggccttgcctgcaggctaaagacttggatgctgtcatgtgggctgcggggagccagcagggctttggggaaaggagagacatggctgatctggttccggaagggaccctgtggctgctggtctgtattggccctgccaggtgctggcaggatccaggggcggaggcgctcacccggagcccccactgtggctggaccaggtaactcccgagggcctctccagctctgacagccatgtggggattgccatggaaaccagccggttcccgagtggggacaagcccagaaagtctctgagtgccagccacgtggacttggatcctcactgccccccaagtacagccgttttcttctttccaaaggccatgtctgagccagggccgaaccaaacagaccgcccagacaggcatccagtggcaggggccctgctccaccctgctcggctgatactcgatgcagtcaagatctgggggccagcgccagcgggggccctccccgcctagtccaccgtcctttaccctgaaacttgataaatcatgcgctggagggggagggaagctcgcagctccattacgagtcccggcaaggccccagtggggcgttaatcatgtagcactttatgctctgatcggtaaataatgggggggggcccgcaggcagaggccttggagtggaggccaggcccaggaaagtggccaaacccccttgcctgtgcccttctccagcctctgcccgctatctttgtttgaggtgactgagctctctagaagcagccatcaccttgatgggcctcagtttccccagctcaaaacccagggtttttccagctccaagcggctgatttcctggcaaccattggtggctcccagcagagcggcgggtggggaggctgtggttaagggcggggatctggagcccgcaggcctgcgctggaggcttggatctagccattccggctgtgtgcccctgggcaaatcacttcaactctctgtgcctcagtttcctttactgtaaagcagcatcaactctttcagggtgtggtgagggttgaatgagataatacagaaagaggtctcagcacaaagcagactgcacacagctgcttgctactgtcactctaccgaactgttactatgagaaagctgcccctccccatcctggggctgggcctctgagctcggatgtgggcagctggagagagggccccgttgtcacctctgtgtccccagctcatggaatccagcccggagatgtttgcgcaaggctccaagcagccctgtcttcttggctgtgtccacagcggtcgtgcgatgactctgggaccagcggtagagtcctgctgcagagcacagcctgcggccaggcatatgggctggaccccgaggagaccaggggctggggaggagggtgtgagatcgaacctccaagtccccccagccccaggagggaactgccagtgttccctggagaggcaactatttctcggctcctggcctggagtcccttcaggggaggaagctgggagggaaactgttccagggcttggaaagactggcttcgtgctctgcccctcctgctggggggagggaagccttttccctgggccagggaagagccgctggctgcccatcccacactgtgctcctctgggacccagggggaggggagctggaaatggggccaggccgggccggaatgagaaacagcttcatgaagggggagctgggtgtctaggggctgcgtccagctaactaaacaatggctgcttgagtcagcgactgtggcggtggttcccaggcgccagggcagagcaggccgaggccagagctcccactactgtgtccttggtgagggcggtgtagcccatccagcctcggatgctttgacttcaggaagcggtggagtggcttgtccctgtcctcgggagctcccgagcctctgctccgtggtctgcatagctaattgggaacatttattgagcacctacagtgcttagcactgaaggctcctatgagctcagtccttccataagccctaggtggtgggtgctattgctgtcttattttacagatgtggagtccgaggttcagaggggatggtgcctcccatagtgaggtaagagctgtgagacttaggagtcaggagcctcagctttctcatctgtaaaatgggtacgcagcaagagtgtgtgtgtgtgtgtgtgtgtgtgtgcgtgcgtgcacccccagggctgtaaggtgcccccagtagctgtagtgtcacacagtaggtccttaatccagccaggcttgtgacctaagcctggggcttgtccttccaggccatgcctgtttggggtgggtgggcagatcatgcccagtctgtgtgttggccctcagggcggcctggctggctggcttcagcccttccagatggtgtccagctggtctggataacctcaaagccctggagctgggtgacccgcctcttccagaggggtcagggaaaccaaggcaggcctccccgaagggtctgccagagctgctgtgtcctttgccgtttgtctgaagcctctgctcttctctgtgccttggtttctccaacgtgctcctccaggctgcttttcctctgtggctaaggccaggcttcctgaccatggtgctaggcctggttggccatcttctccctacagcccctccaggaagcctcttggtcacccctgaaggcgctggtatttactttctcagcagcaggtggtctcctccctggcatgggggctgctgccagaggccacccaggaccgagtccgtcctgccccctcccagggctggcacacagtgtgcccatggctcattccttgcctcagtttactctcagcagaggtgtcagcttgcacagtgttctgagaggcagtgcatgctgaagtggaaggagctggggtctgggagtcacaggtgtggcttcataccctggcctggctgtgtgcggctgggctgctggactgagactggacacagtccacaggccaccactgagcccgtgccacatgggctccactcaggggagcccaggaggactggccctacctacctgggctgtccaagctgagggaggagttggcggggacgggggctgagagaggccacagaggtcagggccagattgagtggggcttcaagggcccaggagcaaagtttgggtttgtgttgacagcactagggaaccatgggaagctgttgagctgcacaggagatgtgacctgctttgcggggttttttttttttacaaaataaactttttactttggaataattttagattttcaggaaagttacaaagatagtacagacagttcctgtatacccgtcccctagtttctcccattgctaacatcttaccgttaccgtggtacatttgtcaaaactaagaagccaacatttgttctttactcccaactaaactccagactgcactccacaaacgtctgctttcttttccaggagcccatgttgcattaagcgctttgcagttttaaaagctctctttggctcccgtgaaggatgaatgggaaggagcccagctttgggaggagctggggggtccagacagcccagtccccggccaggatgtagtgagctgcggtcaccttgcagtttttttatttttattttttcgagacagggtctctgtcacccagactggagtgcggtggtgaaattatagctcactgcagccttgacctccaggcttcaggcgatccttccacgtccacctcccaaagcgctgggattacaggcgtgagccatggtgcgaacggcccaccctgcagtcttaataccccaaagtgatcatgtgctttcagctctgtggcaaatttcagctctgtggcaaggaaacctgactttcccaggatcataaacaatcaaacacttcaggcaggaaggtgccctcacttctcaagtgcaaagcctccgcagccggtgtggtagccatgcagtctgtacctgtgacggaaccgctggattttgcaacctgccgcagcgcccactgttaatgccgcatccttttcatagtgccacctgcggtgggtctgcggcaggatgtgaggcctgagaagccgggctcttgaagcgctccttccaactggcttcctggggagagaaagtcaacacaattacagctggtagtaaaatcaatatgtcagagttttaatgggagagtgggcagagctgagctttggccccaggagggagccagctggagggggagggggcatcctgctctcaaaacggggccgaaaccagcggcggttgctcatcccatgtgagagagggataaagtgaggtttttacaggaactgaagctagcagccagtgttgcctgggcctgaatacccgcctccctttgttgccacacgcagagtaggcatacgtttccctcagttctccagcacccagcatggccgtgttgctctcagtcactcgacttagagagaaagcagctgaccacagtcgttcacactttagtcaaaattaggttcctttcttttgtaaacattccctccagagcacaggctccatgctggagaacgtcatgcatgtgctgccatgggaaatgtgtgaccagcacagtgccatcacaggagttggggggctgagccacatcttgaaaacttgccgtctgggcatgcctggagagggaacagcatgggtccagacaccgggggcgctgaagtgccaaggggagtacgaatgcctcagaggcatgggatgggcattggctgctgaagggacatttacaatggtacaagagccccgggtatgaggtgtgggcacattccaggacctgtggagactgatgtggtgggcgcagcgggtggggcagagggaggagggagactggaggcctgggagctggcaggagctggggcacgaaggccttgaatgcgaggctggactgctggggcttgatcccgaggacagccaggagctgggttgtaggtagggagggtctgaccagctttgtgtgagagaaagatggccctgtgacttggagggcgctgcggggatagccgagccttccctgctctcaggagaacttgagttttgaaagactcatgctcattagcctttaaggaggacggtgctggggtcagggggtattttgggcctgtgaggctaactgtccctggagaccaagttcagccgaggccagcatgctcaggacgtctagtccccgagtcccgtgtccccctcccccagcctgcatccccctcccccagcaggggcggcacttcccgccacgctgggcttccgtgtttgagccggtttgccttgtgatttcccctggcagctggggaatcagcttccccctcggaacacagatcattcggagcagccgacggcttacttctttaaaaaaattttttaaaattttattttaggataaggggaaaaaacgctgggggaaaggccttttagaaaattccttcggtgcagaattaatggcttgtgaaagtcagcgcggggtgggggaggggggagcgggctcccagcgagctcccctccctcctgctcccctcctccctgctgccctagcccacagatcaccccgagctgggcgcctggtccgccttttcccaggaccccaccctggctggatgtcagggtatgcccaaaggtgtcatctggggcctcccaggtgtccccttccagaacttatgttcccttggtgggagggattcacaattttaattttaaacaacttatttttaaatgatgcaagtaattcatattcagtgaaaaaagttacttagttacctagcccctaggaaaatcatccctcgcagtggtgaggatcccacctcacctcttccctgcagctgcaggattgctgaggggtgggaccccgcctggttggggcagctggggagaccgctcagcacccaccttccagggctgtccccaactgtaacacacacaggatggagtcgggtaggtcagggctggcactgagaggaggtgccaatgatgcagctctcgggtgggggggaatggcttcctgggcagagggagcggccaggccagaggtcctgaggcaggaacgagcttgtgatatttgaggcacagaaatgaggccagtgtggctggggtgaaggagcaagggcaagggaggtgtgaaatggagttagaagatgaggggacccacgggaggatttaggattcaggatttattctgagtgtcctggaaaccatgggagggcttgaatcgggggagacctgctttacatttttaaagggctcatttggcagctgtgttagcagataggaaatgtcagtgtagggggcaagagtggtcttggaaaatgaagagggctgggagggctgtccaggtgagaggatggctgctcaaaagctttaaggtaggcatgatttgccctgaattttctttctttcttttttgatcagcagttgaacatgggtaacttttacttcataataataacataagcagcagtcatgtctgaaacacaatagtatcggctaacacttcctggacacttactgtgggccaggtactgtatgaacactttaacctgctccgtttccgacctgggccagttcacccctccttaggcaacctggtggtcccccgctcccgggaggtcaccatattgatgctgaacttagtgtggacacccgatcagcatagcacactacagcctagaactcctggactcaagtgatcctccagcctcagcctcccaagtagctgggaactacaggcacgtgccaccacgcccggcgtttgggaacactttaaaacaaatgattcatcccagcctctatgcggaaaacactatggatatacccattttatagttgagtaaaatgaggctcagaggcgaagtgccttgcctgggtcacccgccgtcatcctccggaagaccattccctcctgtatgttggtccagggcatccccagcccatcacacctctgggctcagggcttggcccccagggacatgctggaaacagccccagcctagaagcccatccggccgtaactgtgtttatttgcccaagcacagaaggacccactatttattgctttcttttgaaaactagctgagcctgtgcaaaaaccaggcaggcacatcatcagtggcttaagcttgcaaaaagcacagacaagaaatttaaaaagaaaaatctttaaagctttgccctaaagatggttccaatgctgccttccggtgacctccctgagtcctgctctgagcctctgatgtccaaatgcagctgaggcatgggctcaagtctgctacctgggtcagccctgggggcgtgacattgtagttagccattttcccctctgagcctcagtttccccatctgtgagataggacccctagggctgccaggattctgggagtcagtgcactggcctggtacagtgtcagttcccagtaaatgtggcctgttattatgtttactgttgtgactatttattgtttatgcaccagttttaccaaaatgggcccatgacatcctgtgacttttcttgtaatcagtgtgggcttatggcgtcactgcgggatgggggctgctctcctggatgataagccatgatggacgcactcagtcccatccgacacatgtgtgtgtccccttttcactcctctgcaccacccttgtgcctgcgtctttgcggagttgcacagttattgtctcagggtcacttcctggaggcctgttttctatttttgtgcaaattgcaccaggaacctttgaacataccaagacccaggagaagggagggaaggtaggagcaagttcagggaacagcccggacatgggatcacctctcacagctgccctgtgagccgcagctgatttgctgctggagggcatgggtgatgctgggctgttgtggacatgggactgtgcattcagacacacccagcctgtttgtccccctgtaatgtgggcagatgaggggataggtgcttggggagggaaagaaaggctgcggtttagggaggcctccacctggagtcttgcaagctgctggggctttggggtggtggtcctagggtcagagcagacacccggcaggaggaaagcccatggttgctgtggagacgcagagccagccggggctgtaggaaaacagccgaggcaagagggacacctcttgggtgccagcgggttaagctgaggctgacggtggcctccggtcatctggtgtggactcctctgctcttcccagctgtgcccagccaggaggggcagccccaagggggtgcgggtgtagctctcaccctggccggcctccctggactctttaaaatcaaacctgaccttgttccctcgcctgctggttcccgtgtaccttgaacatcatctccttggaacagctctgtaaccaacactgaggtcagggcaggcctgggcttggggatggggtcccgtttgtgtttgggcctcagctgagcactgaggatataaagtaggaacaagacttgaaagctctgatgccagggcctgagatcccagccagctgtgcgggcggggagccggagaaggttctggagctgggatctgacgtgccgttcctcttccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaaggtaggtatggttggggatgtggggagggggtgggggtgggaggctcccctgggagttggctgagggggtcagtctgtacacagggctgctacaggtccagcctgaccctttgttttctcccattcgcctagcactttacagtttacaaagtattttgcaagtctgtttttgccactattgctcataatataggtggcgtccatacagaggagggaaaccagggctcagagagggtgattctctcagaggctctaggactggggctttgaaactgtatggctctgagttcaaatgtctgggctctgccatttgctggccctttgaccttgggcaacacatattctctctccaggcctcagtttccctgtcaagggctgtaagctgttgtggggctttggcagggtaaggccatggcctggtgagcaggaatgctcattcatttctcctccccagccctgccagccaccccgtcccagggtgactggtgtctagagttaactgtaccccagcccgtggccccgagattcctggagctgggaggagatgcgcagaatccagtttccctgctctggggcaggacagacatggcggagcctgggccagacccccaggtgcagccctggacctgcccccaacccagccatctctcctgctccctcttgggagactaagctaagcgccaccactctattcatgcaccaggcccggcctaactgctcagatctgatcacccaagtcccccccaacccactgcctgggcagacgctgtgggctgggtgggcgtggggagtggagtcccaggaccccaccgctgtggctggggagaggaaaaatgtggggctcgtcaatggggctcgtggtttggggtcagatactcacattcggagtctggctctgctgcttccagcttggtgacttggggccagtttcttctcccctgcgagcctcagtgtcctggcttgggaacatgagccaggcccctcccccacccccgacacccatgaggctgcagttgttaggcgcctactgtctacccagagcctaaagggcatcctctcacttaattctcacacccctgcaagggaggcagaggcacgattctcatgccacagatgagaacgttgaggctctgagaggggaaatgattgccccagagtcgcacagcaggagctggcccatagcccacaccccgccacagcctggagcccctcacctaccaccctgcacagtgtggcctctgtctccagccaaccctgccctgctcgggccttaaatcgccacacccagcacaggccctggggcacagtagttgctcaataaatgattgaaggagtggaaatgacttgagtgtccactggacgcctggacataggggtgggtgcgggcagtggcctgagcccctgcaaggctccgccaagaggccacgtgggacaggagtgtctcaggctgggacaaagcccatggaagcctggggagaaggtaattttgagttggtgtgtagaggcttctgggcctcatgtgtgcattggtagaaggggaacaggaaggaatattccagaggagagcacagcataggcaaatgcctggaggctggaatgtgtgagcagggttgagggggtggagataaagctggggttgtccgggttagatcaccaggaccttgagtgccagaacaggttcattccataagcagaagggagccatgaagggtttgggagccccaggaggaaggctggggcagaaactggcctgggaggtgtccggaccactggccccatctcaaaatgcccagcctggggcctggcagggcccagacaagacaacacactgggaacaggcagggccaggcaaaaaagagcagagtttggtggggctctgaccggtattgtcatcctcaggaggacacgcagagggtccctcagagccagagaagcttccaggccccagataatcctggtcttcctcctccctgcaccttggttccacacccctagccttaagccttggactgtggggtcaggcaggcctggtattgcattgtagccttgtgatctcttcactttgtgcctcttgccaactccctcggccgctcccagcctcagattcctcttcggtgaaatgggcgtcggggggaggaatgagacgtgcagcctagcagcttccccgggcctgaccccatcagcctggcctgtgtcttatttaatgctcatggcccgcctgccccattagctcaggaaacaggctcagagaggggaggcagcttgtacaacttacacattgtagagctcctcagtgtcaaagccagaatccaaacccaagcccctgcccttagccatggtgcctaacagcctcccagagcacgtttcgtaaactacaaagcctgcacacgttcacagggcgggatgccttggagacgagcccagaaggagctcctggtgggggcacagcagaggcagaagcatcaaggcccggccctgtgccctcccctgcacgcccgtgacttcccacccctcctgaagggtccaagacaggatggggaggcagagcccccagacccgggctcaggttgtcccctgggtttggcctcccctgctatgggctccagcaccctgatgcccactacccccacagatcaacctgaacgagagcatgcaggtggtgagcaggcgggtggtgactgtggcctatggggagcccgtgcaccatgtcatgcagtttgacccagcagactccggttacctttacctgatgacgtcccaccaggtgaggccagagccccagcccaacgccatcccagcaccagccgagccctcttgcttgcctggcctttacacacgctgttcctctgctgggagcaccctcctcctccatctcccttatctgctaactccaccttgtcctgcgcctcccaacaccgaccttgcctctgcagggaagccttgtctcccatgttcccccattagagtgttgaccctcagtttccccagcctctcatggcccgcaccatgctgaccgtaccacctccccaagggagaggctggcagtcccattgagctgggcccccacctctgcccccagatggccagggtgaaggtcgccgcctgcaacgtgcactccacctgtggggactgcgtgggtgcggcggacgcctactgcggctggtgtgccctggagacgcggtgaggctggacaccagcaacagctggaccaggagggctgtgggggtgggaggagctgacctgggtcctgaccctgcggtgccaccccaggtgcaccttgcagcaggactgcaccaattccagccagcagcatttctggaccagtgccagcgagggccccagccgctgtcctgccatgaccgtcctgccttccgagatcgatgtgcgccaggagtacccagtgagtcctgggggaggcaagacccagctcgggacacaggggagcctcccttcacccagcacccaggccccgagaggtggagactcccacccatggtgccccaaggacctgaagacaaataatgagaacagtgacaatgactgggctttcctgaccaactagtaagtgccaggcacgtgctctgtgcttgacgtccacctccgttaggccttacacaccctatgaagcagatgcttttgacatcctcattttacagatggggaaactgaggcaccaagtggtgaaacgacttgctgcaggtcgcacagctagggagtggtagagctggaatctaaactcaagaggcgggttctagagacccaggagggagggtacaagttggaggcttggaggacagtgagttccacccaccttttcccagaacaggggatggagggagggaccaccaggtgccagactgaaatttctccttctcagaaacagataaacctgcaatgcagggggctgggtctcccccggcttgtgccaggagggctctggcaggcagccttggcggtgggggattctgggccccggcaaggggtgggagccgagggtcagacaggcctggggttcatgcatctggctctcagtgacttctctgaggatgagggtcctcttctctcaccctggggggctctgacagcccggctctggcctgtagctgctcagcatctggggctcctctgccctgccctgccgttatcacacatcacagagtccttccctcattcattcagtcatttcatttattggacaaatattatggaacacgtactatgtgccaagcacagttctggactctggggacacatcagtaatcaagacagacccctggccccaggctcatgggggaggagaataggcaagataaaacctgaaggtgatgctaagtactgtggagaaaatgaaagcagaacaggggtggggagcgggttgtgggtgcagacatctcaggccaggtcaggtaagatatgcaggaggggagccagggtgagcatctggaaagagcgtctgggtggagggaactgccagtgcaaaggccctgaggtagaaacaagatcagctgtttcggagagtattaggggatggggtcagaggtcacaggggccagatcatgcagagccttcttgaccactgtaagatgatgtttcattttgcagctggggaaactgaggctcagagggtcacatgtagggcatagccctctggccctgagtcctggccaccactaccccttcccccaggggacattcaggcagtgccagaccttgggttggtgcacagccctggggcaggctgtgaggagcatagcctggacccccagagctgagggctccttgcccccagggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccagggtaagcacgctgtgctgttggcacagccccagaggggcagaacggtggactgtcaggcatggggatggcagggggccagaggtcacagcttctgatgttggtggcaatcccctgcccccatgtcctcccctggctcccccatccattccagaccacgtgactgttgagatgtctgtgagggtcaatgggcggaacatcgtcaaggccaatttcaccatctacgactgcagccgcactgcacaagtgtacccccacacagcgtgagtggcttgggtggcttgcctccagttggtggagggaggaacgcatccccgggaagggtctttgctttcagggggccctgagaagaaaaatcatagcatcgtagaggtagacaggcccttcagttgttcattcaccagcacatttattcattctacaataaatgcatactgcctgatgcctggcctctgtggacagccaggtgggacggggcaaagtgctttgattatactcagtttagtcttctaaaggccctgtctcttttaactcctatttgtatacctcttgttagcaggcagctcactaccttaaagacccaatctttcccaggcagccccgatgatgagaaagacctttccctgtgctgggatctgccttttgggttctagttcctgggacagggatgagttgaggggtggggaaccaggagttgaggggcctccttgtcttccagctgtaccagctgcctgtcggcacagtggccctgtttctggtgcagccagcagcactcctgtgtttccaaccagtctcggtgcgaggcctcaccaaaccccacggtaagccaggctagggggcccctccgcctctgctgtttcattaccttttttaaaaaattcacatgttgagaatgtttcaatgcctttgcatattccgccttagctttggctttgacagctatatggggctcatcacataccacggtgcgtttaacccatgccctatagttggacatactaattatttcctcttttttgcattttgatatagccagggcactatgcatatccttgatgattccctgaagaccgcttcttagaaatgacctgttgggctggtagtgtggccatagttctacaccttgagctcagctgccttccagaaagcctgagccagtttatacccccactgcagtaggaagaccatttcaacaaccctaggtgttcagggcatttgtcctcaaggcctgtggaggtgattcgcttaaggtcatcgactcaggcagtaccagacttgggccttaacccaagtccctctgcccctggagcccatattctcccctcctgtgaaaatcaggaactgggtggaaagggccctgcctgggtttctgcacgagcagtggcgtcccaagggtgggtggtgctgcagctgtccctggacagggaggatgggctggcctcagaaaccacacgctcccaggtcctcatgtcagtccctaggaccctgcagtctgactccatgcttgtcaggggccaggcctgccccagcactgcatggtggttgggtttaatcaactaaatggggtgggagcaagaggaggaaatgtaaaaatggatcaatctaggctttttagtgtaaagataaagtaaaaatggacatgccacatacctcgcccctggttggtttctgagacttgttcactttccaggtggcctctcacctttgcccaggaagcctctaaggccaccgcagcccgtgccaggatggccaaatgggatgcctgggaccttggctggggtgataaggcctagccaggtgggatgtgccagggtcctgagatcacagctcgtcccctctcagacctggcgcgtatcagggctgtgggtggctggggtagggcaccagccttcctgcagctcatctctccaggcaaaggctggtcctgcccatattccagatggcacaactgagataaccagcatggcacctggtgccctggctccctgcagaaggtcactggggcccctttctgggcacacatcccggggaagcagccccagcgcccagagcctctgcagccccagcctttttgcactgagctcagagaatcttctcaggaatccctgaagccctgtctaccccggcagttgctaaggagggggccccatggcctcagcctggaatcccctgctcgctcgcagtgcgcagcacctcccacctgagccccataactgctttgaagaagagcctggcaggggccatgcttaattctattcgaagaggggcttggcagcagggggcttccagcactggaggagagcccagtggagtcggtgcagtgaaaccatacgggagccctgagctgctcctggacccccagattccacagttgggaccccactaggactcctgctcctgtctggggaccccatctcaatcacgtctcttccttccagctcccagcccagggttgtgtacacagcaggggctcggttatggtggtgggaagcatcacactgggcagcagcctgcttcttgtgcgctaacctaggggatgcgaggaggacccagcctcgtcacagtccgttcagcatttattgagtgcctgctgtatgccttagtcagtactgggccctgggaaagaaccgagttggactagtcctgccatcacgagccaagagcctcaggtgtgagctgtggctgtatgatcttagggaagctactgaatctctctgtgcctctgtttccccatctataaaatgggacctgcctgaagggtttggtggggatctggaattatgcccgtaagataccaactctatacttggcacatagtagatgctcactacaaagccaccatgcaccttgggaactgatggccactctctgtgggtgggccagagtgaggatttcagagagaggatttcagagagaggatttctcttgagaggggaccttcgtgctgggtcttgagagatgcataggagctcaccagctgggagggagttccatggcagcgtcctgtcagatggctgtcccccaggtctgcagttcttcaggccaggagctggggtggaggcacagaggaagcctgtctgagaattacagtaactagccgaagaggcagctctgccccgggcgtgcaggaggctctgaactgatgtttaatttggcatttaatgaagtgccagttagtcgtagtggtgccgtggtctctgtgtgaacagcaggcagcaggcagcgggatctgcacaccacgtggcccctcgggagccgggagaagtgtccctgggaagggaggtgctagggcctgagtctcctgtcacgttcccattgtccctcatggtccccgcgtgaaagatgtgcaaagtggaggatgctggaaggagggcttcagctttaggggaggctgggaggaaggtggatgtgtgccccgtttgcaggtgcctgagggatgaggtagcttccctgggggtggcttcccaaggaccactcataggtgtaggtggtcactacgggccagtggagagagtggggtggtaggaacatgggggcaattgtgggggtccctgggggtacagagacgtagggagggaccaggtggattcagggtccctgggttgttgagtgccttgatggtttgggacaccagttcttcccctggagtttaggagaggccctgtgagagccacgaggactcctccagcctcggttctctagaatgggggtgagcatccacctggccacaggttacaagtggctaaggggagtggggtggccctcggggatggtcacacatcattcactgtgggggccctcttgtgagagcgcctcctgccctgactctcacacctcagccccacatcaacacctacccaccgggtgggctggggccaggaggacagaggctgggccccagccagccgcaaagcagacctggcagtggcttcgaggcctgagtggaaacatggattccatgccctcggattccgtggggtttacacacagcacaggatggcagcctgcggtctgcagggggcccgccgctgactccgtctgggcccctccttggtaggaacacggaggcccggagagggtcagtggctcgtgtattctggcacagggagccagcagcacccgggcctggctatgctgcttctcttgccaagcccctgaggtctgcaccagaccctgtccctaggggaactcaccactctggtctcgtggtcagcaaatggtctggacaactggagccttcctgtgttgctcattccactgtaggcaaactgctttgcttctgtgtgcctcagtttcctattctgtaaagtgggtgtaatgatagtatctacctcctagggttgttgggagtagaatttggtaaattaaaagagtgcaaagtgctcagaacggtcccagcagagggagggctagatgagctggtgactgccactgttattagcattatcgtcatcagttcttgttgttggcattggcatcccctcgaggtccggttttgggctggggtccctgaggggaatcagtccctgtcctgctctcatctggtgtagaataaagaagcgtctcatattttgtcccaaggcctttggcctggctgggtgacctcacgtggacacacgtggcccatggacgcttttgctttctggcctgattctaacccagatccttctgcaaccagccttgggaaggagggcagagtaggaagtccctgagctgaagggtggttgtagtccccttggcatgggtgtggctgctccaaggtccccagtcctgccctgctcatggtcccagcaggtcagattcgggagcaggaggaggcaggaatggctcactggggccaccaaagctggagaacacagggcaggttggggggtccatacctcccagctcagagcgatcactaaggtggacatggcgggaacagccctgcctctggtctctgcccctcccccaggcctcagtttcttattctgtacagtggagcatggatcccaggagcctggagacagcagttcccaaccaggccttgaatccctgcagcggggctagacctctgcatcttaacacgcgccccagctcggaggaccccagagtcaagacacctggggcttcaggggccagccctgtcctccgccctcaggcagctcactgctcttggaggctcaatctcccctccctcccttccatccttcatccctccttccttctttccttccctccctcctccctccttctttcgttccatgaagcagctgctctgccaggcctcagtgactccaccaccaaacaagagccaaccatgtgctgtccccccatgagcccggggcccttcctgggagtatctggggctggcaccttcacctagaggctgtgacttatacccgggctgtggggaggggtgtcccctggagaccggtggtatctggccctctgaaatgtcctcctggtattcagagccctccctgtgcctttcctatgggctgtttggaagcccaaggtttctcttttctgaatcgcttaacacgggtcagtcaggaagctggagtttcagccctgggggcatctcagggagtgggtgcagcccccctgttctactattgggaaaggtgaggcccagagacagggaggagctgggcctggagttcagcctcccagcctcgtctgaggccagggagcactcatggaggaaattggccccaccactgggcgggttatgccatctgcctgtgcccaccttcctcatctttaaacagggccaatgcgacctgcccataggatggagggtggtggcgagtgggaggcacggggtggggctggtggccgttaggactgaatgactagtgttttctcctcaggaaggcaggactgaaccaggcaggctggggtgcagtgagtcctcctgcctcttctctgaaatgcccctgtgtcaccctctccttctgtttcctctgcagagccctcaggactgcccccggaccctgctctcacccctggcacccgtgcctacgggtggctcccagaacatcctggtgcctctggccaacactgcctttttccaggtaagtagaagccaggccagcgccgggtggggccaggaggaggccggggagcacgcaggccactaactgcccccatgtcctggtgtgacccctgctctgggcccactgcagtgctttcgcacctgtgtgggctttgcttttctttctctgagtttccaccttctgcatgaggaagccccactctgactgcacggggctgcaagaagaggaagtggtgagggccaggccaagggggacagctgggggccaacagctgccaagggaaagccagtgcccccaggctctcctgccccgtgccacagccggagggtggacgctgccctatcctgtcctcccttagcctgagctgtgaccctggacacacccacccaccgccgagcccactgccccgtgggtggcttccatgtcttccctgcagaatgaccagagaaccccttggccaccccattccccattgtccagatggggaagatgaggcccaggaaggaaaagtagatgacgccagatcacacaacacagggctggacttgtgcttagctctggactccccaaccagtgctcgtctttgcaactagccccgcccccaccatctgggctgggggttggggacgcagctcctttctggacccctcctggaggcgcgtcctgggtgggaagcgttgacgagtcctggaggcgtgccagccacccccctccccacctccctggaactcgccatctgttacttccatggaggagctgaggcccgtgagagctgtcacacgtggtggccacgtgccgggcatctgggatgtgtcgggaagcctcgtggcaggggctggagctctgggagggctagggtggggcctgccctcagccctcaagccccaccctgcaggagttggggcaagcgcctccaggatcagccagggggctgggtgggtgggcaggatggctctgcccctgggccgtgggcgcctgggatggggaggtgtgagcctgacttgagtcctgccgattcttcccagctgtgtggtggggcagcctccactctgaccgagctgcaggggcgcctgccctcctgctccccagggcctgctcctagaacactgaagtcaggcccagcggtgggggcctgtttgctgagcctacaccctggggagctctgggacgggccgggtgtgctgttctgaggtggctgaggactaagaggagggacccatctccagctcagcatggcaggggacaaaacgggcttttggccccgtcagcagccactttcctgtgttagcttccgggctgggaccccagaagcagggaggttgacctgcattctcctcagggtgtcacatctgccagccacagggacataaacaggaagctctgccacgcagctggctgggtgcttggcgtaatacacaaaacctgagtctgtttactcagcaaatatgtattggtgctgctcctgagaaggccagatgagcctggggaactgagcctcatgacacaaacattattggatacctcctgcatactaatgatagcaagcacatattaggcccctaccgtgtgcggccccttgaggtacacaatctccagttttcccagcaaccctattcccattgtccaggtaggaaaaccaagcctcagagaaggggtcaacttgcatgaggtcacatagctgggacatgcagaggtggggtttgaacccaggccagggctcttccagctgctttctgctgcccttgggggtggtgtcagagcggccgagccctgaccgtccccggttggcgaggggacaggtaagcagccaggcaagaggctaagggtgatgcctggcacacagggatgggggcagctctaggagcttcgtagtgccccagcagacacctgaatagttgctgctgagggaatgaatgaggatcaagtgaggcacacccctttgatttgagggcagcatctgggaaggcttcagaacagggggcttttaagctggatcctgaaggctgtgttgagctttgctgggtggtagaaaggaagacaggtgttcaggcgaggggagggctcaggcaaaggccggggcaggagagtctggccgtgttgggcgttggggcacgtctgagcagggcctggtagggcaggatgggaggtgggaaggctcgaagagcaggggaaccccgctgggagtggagccttaggagctgaatacaaggcccctgggttagatcactggggatgctggagaggcttttagtggtgctgagcgcatgaggccaaagttcttggcattcctgcactgcttgcctccctcaaacattggacgtgatggccaggaaggggattttgggggacgggacagcccatgcaaaggcctgacagttcgaccaagcccacctttcccagcaggagcccgtggtgtcctgctggagttagagggcaatgcatgctggcttggttctcctcaaacccgcctcccactccctgtttcccacagggtgcagccctggagtgtagttttgggctggaggagatcttcgaggctgtgtgggtgaatgagtctgttgtacgctgtgaccaggtggtggtgagtggggtgactccagcatgggcggagggcgggcctgcgttaagtccagatgctgtacccctcaccccaccctgcctctctctaccttctggttcccccatccccagcagccccaacttcatctgcctccatgacacccatccccagcagagccccaggcattgcccatgccccctatgctcttttctgcccttttgcagctgcacacgacccggaagagccaggtgttcccgctcagcctccaactaaaggggcggccagcccgattcctggacagccctgagcccatgacaggtgggcacccccacccgccccacatggcctcggggcctcagtgcagtgggtggggctcagccttgtgcgactcattccagtggttgccccaaagccgcagatgtcccaccccattgttctccagcacacacacagcctcatatcccagccctgccatgccatgccaggctccaggccttggggtctccgtgcatagtttcccctgccttcctgggcctgatcgtccccataggaaacaggacacagtccctctgcagagcttgtaaggacctgatgagccagggctcgcccaaccttgagcgtggcatctggggtgtggtcagctcccctcgcgtggcagctgtgcagttgctgtgactgtctgtgttgggtccactctccaggggctcctctgttcatggggagtctcaggcatccctggtggacgtggtgccctccagattcccaccatgaaggtcccagaacggccctgcatacccaaggtcctggagaaccctccctgccctcctctttgggctacttggagggtttgaagccccaaagtactcatagtccacattactcagggatccccagcatcctagggccccgccggggttgatcagacccactgaggtctgggtgggatctggctttaccacccacaggcctcgtgagctcaggcgagtccctcctgtctgagcgtcagcctcttctctgtaaagtgaggctgacctgaggctcccagctggagtctctgtgaggggaaggaaatcaatgaagcaggggctgcactgtgctcagcacaggccccaggggtttggggaaggggctaagaacctcaggggatcctgacccccagaatcaggacttcctctgggtggggcaccacaatgatggggcgcagacctcttgacagttgttgtgtgtggagggcacagcggtgttggggcatgcaccgcagagcggggctgaccgagctgccccgtgtctccccagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccacgcggtaagcatgcccagtggaggcacgtggcacccgcactccggcacggcgcatgcgcagtgccctcgagggtcccacttcttggggacccaaacggcacatacaccgacacatgggtgcagtatcacctgtgaacaaaaggaagtgctctgcctcacagagctgatgtttcagtgggggaggtggacagtaataaataaggaaatgaataaattatagaaggcattggaagtgtggcgtggaggagacaccgagggctgaatgttgttagtttcaggggataccatgatcactaaagccaccaatgacatggccaaacattgctcctggaagctgacctcagcatcctccaggagaccccctaagtagcgtccccaggcccacgtgggctcagtaatgcacacccacatcctccttgccagcacagtgacctgccaagtggccacagtcccagccccacctgagcctccagaccttcctctaagcagtgggtctgcacggctgtgccctgctgggtgcctgtgactgtgggcagaagcctgctggcctgcagcctcagatcccattcgcccctctctcgggtcacctggcagattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagtgagtagccacggtgcccccacctaccttctccagcagtgccagcctctgctctgtcctcctcactcctccctccccatcctctgtcctcactctgctgctttctggaagactgttgcttcgtggcctccaggcctgtgccgaagccattcccaccacacatcctgccgtttctgcttggggcatctgctttatccctccagctctggctctgatgcccactcctctgggaagccctcacaggctgccctagcacagcccttcttccacctaagccttgctctgaggaaaatcatttgcaattaaaaaggctggggctactggcatggtttagagatctgtgactggcccagaggggccgtaggaaatacgcgtgagcagagactgaactggctttccttttgggaggccgtgcatcaggcgtgtggaagagccgtcatctaccagcccagcagacgttctcatgatcagagacccttttgtcccacccccgtgtcttatagttgcagaactgtgggaaactgatggggtaaattatacatagaaggcattggaagtgtggcatggcgtggaatggggcgatccctgagcctggctctagggtggccgtgggggccaaggaccgctggctgaccacagcacctcccctcaggatcgtgtgtgtcacagggccagccccaggaccactctcaggtgtggtgaccgtgaacgcctctaaggagggcaagtcccgggaccgcttctcctacgtggtaagggggggctgcagcccactgtccggcccgcccagcacgcacactcccgggggctggcccgaggcccaaacgcctgccttcctcccacagctgcccctggtccactccctggagcctaccatgggccccaaggccgggggcaccaggatcaccatccatgggaatgacctccatgtaggctccgagctccaggtcctggtgaacgacacagacccctgcacggagctgatgtaagcctctgggcctggcccatcccttccagcccagagaaatcaatgggcttgggggctggcgggctggaggtgacatccttgagccaagcctctcttgggtcttcattggctgtgtcccctaagccaagccccttctcctctctgagcctcagtttcctcagctggtaagaatagtaccagtaattggaagaagggctttgtgccaggtatacagtagttgctccataagtgatagctgtaatgagaatggtgttgattgcacacacacagatcttctggctggcccaggggtgtggtgagtggcaggggtgtggttggagtctgttggcgaaacacctttgtctttattatgcacttattgtgtaccagaccccactaatgggcattgctgggacaccaagaggagcacaacatagacctcaagggaagggcagacatacccacgggaagtaggaacatccagtggggctaggattgggagaaaagtcagtgccttcagggatctggggagagagacttcaccagggttggaggcgggagagaagacctgggaaggcttcctggaggaggtgggatggggcggaatttggaagtgtaaggaaacagctgggcactaactgggcagaagatgagttgggaccagtcaaggaggccttgaaccccaggccaagtgcgtggacttgtgccccaggtctcaggggcattggcggtgggtgagcagcagaaggcaggccctgctgataacctgctgctccccccaggcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcaggtgagactggcaccccgcccttcccccaggctctctggggctgcaggtgcactgataggttttgctgtcccccgcagtggcggcaggaccatcacagtggctggtgagcgtttccacatggtgcagaatgtgtccatggccgtccaccacattggccgggagcccacggtgaggcattcgggggcctgatgggtgggagggggtggcccaggcacagccagggccctaactgaccaggcctcctcccactgcatctctgtcccctcttcctccctctgcctctgtgtctcctcaaaccccactccccaccgtttctccatgcccatctgtccatcctgcatcccggcctgggcccctggctctcctgcaccagctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacgtgagcaccaaaggggccggggtaggcgggggcaagcgagccagcctcagctgtgggcctcgggagcacttccccatgagcatcctccccctttgcacccacagaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacagtgagtggatggggcgccggagcagggcagacctggccccacccctggcccatctgccaagcatctgcccctcacccagcacctgaattcactgagcgttttcacgctcaacagctcagtccagcaaagcagagctttacatccccacttgacatatgaggaaactgaggcccaagaacttagtgacttgcttgaggtcagtgatgggccccatctggacctggaccatcagaaaccataagaaattgtccctgtcccccttggcgtctatcctagagcctgggctgccaggcaccatgtagaggcaggggagcaggaggagcagagaggggccagaacactatctccttgcatgtctcctgggatggggagctcactctctcccaagcagcgtgtgccaccccaggatggctctgactgggaaagctttctttcacctgcacctcagtcccagtcctgcactctgagtcctcatacctcacctaccccctggtcccagggcagccttgcagatacttggggacagcagccaggccccgtgaactgcttcctcttgctcactcactactcctcccaggctgtaatgataatcacagccccctgcattgagccacctctgtgccaggcccaggaccaagggcttgacaagccctcatttagccttcccagtgtccccaggaggtggacattgttatctctatgttatcagtgtggcacctgaggctcagagaggttaggtaatttacccagggccacacagcaagtgaggagcagaactagagtataagtccaggaaagctacaacccccttccccaacctctgcacagatccaggtagggaacttcaaccagaccatcgccacactgcagctggggggcagcgagacggccatcatcgtgtccatcgtcatctgcagcgtcctgctgctgctctccgtggtgggtaaggagccccaccctcaggacaccttggagggcaggcttgccaccttgccccagcccctctgaagattggcagatgggagaaggcaggatgggatggggcacagcttgaacaaaggcttggccatgggaacaggttaggcacccagaggttgggggaggtgtgccctggctccagcaccaatgggtagaagatgttaggtggccaggggatatgctaggcccacgcccaggtccctgaatctcaagcagagaaatttggaaccatgttctccagtcaatagagagctactgaaggtacttaagagaggattactcaggaaaaattaacctacatgtctggtgggctataccactgttaaaataatggtcaataaagtaatagactcgatgtagcagagaaactggagccatcatacgctactagagggaatacaaaaaagcgcagctgctttggaaaacattttggaagtttcttaggatgtgaaacatagaattaccctatgacctatgacccagcaattccacccctagctatctgctcaagagaaatgaaaacgtagccacacaaaaacttgtacacacgtttatagcaacattatttataataaccaggaagtcaaaacaacccaaatgtccatcaaccaataaatgaataaatgaaatatgatctattcatacaatggaaaattatttatccgtaagaaggagtggagtactgatccatgccaccatgggcaggcaccttgacaatattacactaaccaaaagaagactcaccaaaggcatattgtatgatgccatttatatgaaatgtttagaatagggaaattcatagagacagaaagctgaatggtgattgccagggactagggagaacacgaatggggagtgactgctgcatgggtatgggtcttcttggggcagcaaaaatgctctaaaattagtggtgatggttgcacaactctgtgaatatactagaaaccattgaattaggccaggctcagtggcttatgcctgtagtcccagcactttgggaggccaaggtgggtggctcacttgagcccaggagttcaagaccagcttgggcaacatggcaaaactttatctctacaaaaaatacaaaaattacctgggcatggtggcatgagtctgtagtcccagctactcaggaggctgaggtgggaggatcacctgagcctgggaggtggaggctgcagtgagatgtgatcgcgccactgtacttcagcctgggtgccagagtaagactgtctcaaaagaaaaaaagaaagaaaagaaaccattgaagtatacactttaaatcactggattatatggtatgtacgttatttcacaataaagctgttttatttttaaagtgagtatattcaatgcagaaaatttttggaaaaactgaaagatgataaaaggaaaaaatacccatcattaataccctgtgtatttttgtatcttccctcccagtctcttttctgaaaatactatatattaatagatattttaatacattatgtatatattcctccccaccccaggaaaggttataatgtaatattgctttgtaatctgcttttaaaagtttcttaatttacaagtaacacctggtcattgtagaaggaatagaaaatgctcaaaagcagaaagtaaaccgaagtcacccagaatcctcccacccaggaaagccactgttaaccactatttcacacacacgtattcctgtttctttttttttttaacggggctagacaaattctaacagagctgtaacactacacacttctttttctaaggacgggtcatcaggcattgctttgctggccattccccaagccctctgtccacgggagagctccccgcaactccccaccccccaccccaaccctgcccaggagggaggactgcagggcctcctcccacaccctgcccagaggagctggagcggaggccagaatacagcaggcgccaataaaggctttccaaagggcaccagaggcctgacctgcctctccactgcccgcagccctgttcgtcttctgtaccaagagccgacgtgctgagcgttactggcagaagacgctgctgcagatggaggagatggaatctcagatccgagaggaaatccgcaaaggtagtgggcggggaccctgcagggctgggcctcaactttccctcctaggggatgggttctcgggccgctcacggctgtccgtgtgtccgccaggcttcgctgagctgcagacagacatgacagatctcaccaaggagctgaaccgcagccagggcatccccttcctggagtataagcacttcgtgacccgcaccttcttccccaaggtcagcccgagcctgagcctgccctgaacctgtgccagccacctcaaggcaactcgacctctctgagccctgccagcctatagggtcccttgagcagtgccaaacctgcacagctgtccgcagccgtcctggccacttgccctggcctgccacggggagaagggttggaggcagattctccactgtcattctctgctcacttgatgtttaacagtccatatggaagccagctgcagccccgctgtcctggccagctgggcctgcctctccccttttcaaggtggggcagaagcggccagggctgtcccaggccagcctctctccttcctgtgcctcttcccagccaggcttcccttggtctctacactccctcctcctgtccactggactcctgccccatcccttccatgcctctcatgcctccccttgcccttccagggtccactaccctcactctacctcctagtggtaccaccctctctcccctgtccacaccattccccacacagtggccaaagcaagcccatgtttgactacatcatttttcacgaaaccctccagtagcttttcccagcctcaggctaaagctcagactcccagcctttctgcctcagtttcccccattgcacatggagctgcttttgcttccccttaagtcttgtgctgtcttgtgtggccacacccctggaattccacagcccccaggcttggcccactgcctcttagtcctttatggggagctaattccgtgccagtttcccccagcagcccaagccagtgcccctttctgtgtgagtgacctttccatgccagcagggggtgtccagccccgctgagatgctgggggtctgcctctgcagtgttcctccctttatgaagagcgttacgtgctgccctcccagaccctcaactcccagggcagctcccaggcacaggaaacccacccactgctgggagagtggaaggtgagtaccccacgacccacacacagtgggctgcttcagggcaaccctgctcccccctgggtcccctttccagttcatctaatgcattgatccctgtcatgcggagttgggaggcatctgccattgtaaggtactgagccctccatcccaggaggcattcaggcagccattcagggtattataagtgctgcccccgcaggccaggtagagcagacagaggattgggcccccctgtacaccccactcaacctgcttagaaaatggaaggtgagagtcctccacactgggatgccaggttacctccaggcacccttacccttctctgagccccacttttcaattcaaccaagctattgttccctgtcacaaaggttaggaggcatccaccgtggaaggtaatgagctccccatcccaggaggcatacaagcagccgtcgtaagcactggctgttaggctaggcagggacactgggcccctctggacaccccatcaccagttgcttccacagattcctgagagctgccggcccaacatggaagagggaattagcttgttctcctcactactcaacaacaagcacttcctcatcgtctttgtccacgcgctggagcagcagaaggactttgcggtgcgcgacaggtcaggctgtgacagactggggtggggtagggaagaggagcctgtccaaggccacacagcatcaggtcctgggtcctggggctctggggctcttgacacccccatattccagcccttcctgggccgggatgcccaagaccttggctcacggggcacgatggttgctgtggacgtagaagaaggtggctgtttctccaggaggattctagccccactcacccctcgcaggacccacccacacaggcactcctgggatcgatgggcccggggatgaggcggcactgagaccctgggacccacagctcctagggcctcaaggtgcagttgacacctgcctcccgctcacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggtgaggctgcctggggacagacagagcccaggcgggggacgtggcagggactcagcggcagtgaccccacggcctcccaggccttccctggcaccctcaggccagctctgccaggagggagtgttgcatgagacaggccaggcccgtaggacctgttatgcagagaggggagccatggccccggggaagcctggctggcttgctgcaagggctcaacggatgcttggggcataacagaggttgtgtcaggggccttgtcccatctgtggttttctcagtcatccacccttccctgctctggattcaggagatgaaatcagcccctggctggcccttgaggctctcccagccctaggctaggcgagacgtggaaacaaaatacagggtggccagtgcctcgcagcagagctcagctcacgaggcctccctctgtctgaaggcttcaaggtggcttcctggagcaggcaaccctgtgctgagacctaagagagtgagccaggcgaggagtggtggggagggtgctccaggcatcgggtacagcacaagggcagaggccgggaggaggggatgttcgtggaaggaatagaaggaaggccaaagaatcttctggatgagagcggaggctgggaagagggtgggcccggtaaccagggcctcctgcactctgccagaaggacccccataagctctcttcgcagagcaagggttgcttagcctcttgtcctgtcccactgtccagctgccctatggtggcagaggctagagggctgcctggaggattgtgggagaaaggcaaaggcctgcctggagcccagaaccggggcctcggatgttctgttttttgttattaatttttgaagagatgggggtcttgctttgttgcacaggctggtcccaaactcctgagctcaagcaatcctcccgctttggcctcccaaagtgctgggattacaggggtgagccactgcacccagccaagatgtcctgggcttgagtccaatctttggcacagcccagctgtgtgactctgggctactcattgccctctgtgggccttggtttccttctgtcaaatggggcctctgcccctgagcctggggcttgagggccaagtagcctgggggagccccacggctcctcctgggggaagggggtagtggggtggagcagaggcagggcctgggaggggccattggggtgcctccgccttctgcgggctgcctcactgtgggccatcaggaaccacaagggccactgtggaccctggacctcactcccctggcttctttctgtggcctcagccaggccttcccctatgagcctgtttcctcctctaggaagcagggaatcagtgcctcccacgccccagacctggagaattggaccaggacttgggctggcaggctgccttcgtaatctttgccaaatctgcctaatactattatgtacttaatttttctttaaatcaatttttgtggatagttaagtaaaactatcccagtggaacacctgggtcccttgctgggcaatggccttgagaatcagctcatggctgtgggtccagcagagccactgcctggagggccacccttggagatgggcaagagcagggacattgagccccattcctcctgagactccatagtcatcagcctgcaagtggggtcgaggccacatcggtgtttcgggtccacctaaactcacacttgggggccccccacttagtagaaagtcacaggcttgggagtcagccgagccaggtccgattcctgccctgccgcttcccagctgggtgatcttgggcaggtcacttgccctctctgagcctcggcactgttggctgcacagtaagaatgatactccgtatccggaagggttgccgggatgatgcaatgaatgcacccacccacagctggtggtgtttaatgaacacgagcttagggtccgtggagacaccctggagaggagagtgttgacaccaggatccaaaaggagactgttggaggggttgggggacgggggcgtgaaggtgtttggcccaaagcatgggggctggaatacagagggggccttggccctgatacccccgtgcccctcaggagacggtgggggagccattcttcctgctgctgtgtgccatcaagcagcaaatcaacaagggctccatcgacgccatcacaggcaaggcccgctacacactcagtgaggagtggctgctgcgggagaacatcgaggccaagccccgggtaagtcggcagggcggggagggtcccagggctgctgtgtcgccgccaacggcattgacccagccttcctctgcagggccttgctgcctgggcactgacatagtgatggcagcaactcactgacctttctctcccactctccccctgcagaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttggtgggtgggaatgggggcagagaccccgtgtcaggcgcttcagccggggctggcccctgccttgacgggaaacactcctttcacctggcatgggtgcatgaatgtggggacactgagaggatccaatgaggccccctcagcaagaagctcttactctgtaggagacaagtcctgcagtgtgagtgaactacggacaacagcaaaaagccttcaggaaaggcttcctaattcctaaaggagggatgctggagtagggttggtttgtttgtttgtttttgagacgggatctcattctgtcacccaggctggagtgcagtggcgcaatctcagctcactgcagcctcgacctcctgggctcaagtgatcccctcatttcagcctcctgagtagctgggactacaggagtgcaccaccacatccagctaattttactttttgtaaagatagtgtcatgctgtgctgcccaggctggtcttgaactcctgggctcaagcgatcctcctgcctcatcctcccaaagtgctgggattacaggtgtgagccaccgcgcggggcctggagtgggttttataggagtcttggttaggccaagggtttcatcagcaattgtaacatgaacagccttgcagacaaggccatttccagagctcctcctctgtgccctccaccctggcaccttctctttgtaccctcacactctcccccagctctttcctgccctccccattttacagatgggaaaatggaggctcagagagaggtatggcttgcctcagtttacatggagagagcgagaggcctctccctatgtggctgggccggtacctacccctcaggcccagctccctgcccggaccctgatggcctgtcccttgtcccccagagtggttcgcctccagcacacagagctacatccttcgggacctggacgacacctcagtggtggaagacggccgcaagaagcttaacacgctggcccattacaaggtgcagccctgccccccgcccccatttccccaccctcatgcccccaccccaacctccggcctctgacctcggcctctcccctcccatcagatccctgaaggtgcctccctggccatgagtctcatagacaagaaggacaacacactgggccgaggtagtgcgggtgcacgtgggaagggagcccaggctgcgtgtggacaggggcttccatcccatgccccagtggggaagctgaggctccgagaggcagggctggcctgggctgaggcctccttggtgggggctgggcggggccagcctcctctgacccagtactgctggggcagggcccacaccaggcctcctcaagctgatttcctgcggcagctggagagaggccccgggagggcgggatgcagttccaggaggtctgggcagcagccaggccagaaggggggccagcatgcccgtctcagccttgggccatgtccctgcctcaagtgccccctccacaccctcagacgccccaggcacagcctcctggctgccaggcctgcgagcccgggatcctctgggtctcggggtccccttctaaggttgagagcagagtctcagtctctcccagcagcctgggaatctgggctggcaggagctctgggctcaggggtggggtgggcaaaggcacccacccccgcctgcctggggcccctcctcccccgtggctgcatcttcctgtttctctccaccgctgtccctccttccaagtccctccatcccgggtcactgtgtgtgtgtctttctctctctgcctcactctgtctcgctcgctgtgtgtctctggatctcacttatctctctctccgtctctcccagactcagtctccccatgcgtctctgcatctctgtctcattctctctgactgtctctttggatctctgtctccgtttctgtttctctctccatctttctgtctctgcttctgtttctctccccatctttctgtcttgtttctgtttctcactccatctttctgtcttcatttctgtttctctcctctcctctcccgtgtttatttattgtgtttttcctctcacagtgaaagacttggacacagagaagtatttccatttggtgagtgcccaacctcggccccgggggatccagcccctcagtgggtgtggccttggctttctgtggccctgggcctcttgggaaaagtgctcccagccctgcgaaaggctggggggtgggggagtagggatggggcccagaatcaggagggaaccacagcccttgtgtgctaagaagcatggcagagccagacctcccacaggcggccgaggatggggcctggtgcggacactgaccactgcccggcctcccaggtgctgcctacggacgagctggcggagcccaagaagtctcaccggcagagccatcgcaagaaggtgctcccggaaatctacctgacccgcctgctctccaccaaggtgagtccggcctcagtctcccctctgtgcagtgggtacaaggctccagccccagctccagagggtcattgctcagggccagctgtgcacccgcggctgggagaggggtgtgagttcttcctgtttcccctgtggggctggaggggcaagaggctgaaggcttagggtcccacttgaggaggcatttctcacagccaggaaaaatgcctgacagagacttctatgttagcccacgtaacagggtacagcagaggcccagagggatcagtgatgtccccaaggccacgtggctcagtggcagcgccggcaccccacagcccatactctggcacttccagttctcgactccatgtgccagtgcctcgattagtcctttcaacgcctctgggaggcaagtgagccagagaggctcggtgaccagcctgatgccatgtggcttcctcattcagcagcctggcatttcaagctccgcagagccaccaagggtgcccactagccctctgcacgtggcccggggctgacggcggccaccccactcccccgcagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacaggtggcgggtgggggggccgtgtggacttcactgtgccactggggcccctgtggcagggggttcagagtctagtcttctggcctcgcctgcttggggtcaagccctcctctgccatttcccagctgtgtgttctcggatgagtgacttagcctctctgtgcttcagtttcccctccactgtaaaatgcgacccatgttaatggtgggaattaactagaagagtgcccagaagcatggtctaggtgttgcccttactatcattctcccgcacccctctcaggtgggcaccatcagctccacttcacagataagcacactgaggctcggagaagcagcacctgctcaagaccacacagcctgggacagtagagccaggctcggccctacattatctgaatctcttacccagttggtagccctcctttgaggcacctcttagcttgtcggggtcatgcacccccacaagaagttgctggaaacccagcctgaccctcaggaagaataccaccagcccaggcgcctctgtgcagggcagcagcttcctagagctctgggggtacacatgcccaggctgctgagtcactgggtggcctgaggtgggggtgggggtgttgctcaccctctctggcctcttgaggacaaggccagagctccaggccctgccccccacagccctgccacagctgctctgctaatgtcggacttcctgctgcctgcaagggttcagggaggagccaggggtgcccgggggccggcacctggttctaatgagaaccaggacctgactggaggctcaggagggggttggggggtacagctaagccctgtagctcctgccttgctccagcaggaaaccgggctctcagccccactgcaccccagctggccagggataggcaaactaaggttcccaaaggtcacatcttgtgacaaggctccaacctcaggcccttgagggacaaagccagctctctcctccacaactgtccctcgactgcttcctaccccaccctaccctcactgtctttgtcaccctaccccacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggtcagctgttcccaggaccaggccaggcccatgcacagggccagagtggggtgccgaccatgggtagcctcctcgactctctgaggctgagctcagagatcttcctgggaggggaaccaaaagatctcaggtctaggggatgtgggatgagtgactcattcagacagggagacacctagaagccagtaccttccatcagaaactctgtatcgctgcagaccaactgcacatgctgcagctgtgcctggcactggctttgaacacaggcctgagaacccggtgtgggaaagccagtatgagcttggacaacctgcttggtcaggcacaacatcatctgaaaaccgggccaggctctgggcagtagcccctgaaagtcaaaagccattcaagcgagcattcagtgaaggggtgggcagaggggtgatgggtggctaggagctctgagattcatgcggtgtgttgggggcacacaaggctgtgtctggctttagaggttgaagatgaaagaggatggccttccaggcagagagaacggcgcaggcaaagacagggaggcaggaaagcagccggttgctgtgagcagggatgagattgtatcattaaagctggcactgcaggattggtccaggtcgtgtgtgaccctgcatttagcccacgcatttcagagacggaccacgggaaggagaaaatgccatcgctccactactactcacgtactgcctccgaaggcagggtgcccgtgactgacaaagaactgggagtgttcttggcacttctttcaggcgttaggagcatgtggtgggaaatattccactgagccagcactcaggcttccaggaatcctagccaccaagacctatcaccctgagaaggacacatccttgttacgtggaatgggctgcgtgcagtgaagagctggcatgcccgtgcacttttcccctgaaagaagtagggcccctccccacccacatcattgtcctaacagtcctggggaaagtaggcggggcagacagagcacagtgaggagcccctggtctggggccggctgagtgcggggacgttcagtgaccgggtgagactctttgggcctcgggggcctgctaaggtcacttatgtggcaggagggatgagggctcatccagaaaacgaccagatccgtcctttctccagcagccatctaacaccctcgctcttctctgcccaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgagggtgcggtggctcggcggcgggggatgggggcctgaagagctgagggatcgggggtcgggggctgggcctcaatgcctccactggagtaagggcagggagcgcagagggcatttcagaagtggctgtggcctcttgctggcctgcaaattcgtcatgcattttcccagagtttgaggagcgggggcaggagagcaccctctggatggagaggagattggacttcagggtccgggaagccgtcttcgtccatgggacttgaggggcctcatcgctgaactgttctgtgggggccgtggggagttggggattgtgtgcaagcagctggctttgctgggactaggctcagctttgaccgctgggctaacctcctccccatcctgcctccttatagaaataccagaatgagttcaacaccaatgtggccatggcagagatttataagtacgccaagaggtatcggccgcaggtgagtgccccagggtgaggcacctgccctcggggtaggtgagcttcctactcaaggacacacatctcagggtgcttgcccctaatggacggatgtcactcgtggtagacgttcaggggtgtgttctctcccacgaactgaggcagggctaccggccatggcccggctgactccgctgctcccctcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcggg

SEQ ID NO: 37656 - DNA, 5138 bp, Homo sapiens; identical to SEQ ID NO: 36716

SEQ ID NO: 37657 - DNA, 75186 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaaggtcagtattgataagtggttgcttaatgactccctttctttttctttttaaggaaaagtcttaagtttgggttgagtcgttatgttctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctactatatttcttatttttgtaattggcattataggcggagtattcctagtctgaaaatatgaaatctaaaatgctgaaaaacccaaaattttttgacacccaaaggaaattctcattagagcattccagaattcagattcagtggtcaaggggtataatgcaaatattccaaaatccagaacaacatgaaatctacaacacttctggttccaagcatttcagataaggaatactcaacctgtgtatatctaataataattttgggaaagtggagggtaagtctaatataagtatatttaacatgatttgtatggaaaaatgtagagagtaataaaatgaccacagaactcggctgagaagaaaccattgtttttataacctggtatctacctcttggtttcctctccaggatcgctgtggccaaagctgaaacccaatcctatagttagtataaaagtaaagggatttcacttcctttgtgggtagtgtcatttgtagcattaatgcctatagtctggttcgccttcatgagggggaagaaaaattcactgaatactttgcttaaatggaaaccaccttcattcaaaaaccacttattgcttattggagatggtccatacttgcgcttcaggcacagctgtgtctttaaggtttatcttctgttcggtttcacacagagacaagccttatgctcagctttgctgttatcagctttgtcaaataccggtttcctcactagtaaatcacacgcatttttcttttttctcttgtgtagtcttctttcttagggtctaagaagggaatgggaaggaatggtttaagatgggtgggcctaactgcagtagttatatattgaggagacctgactggcatcacaggatatttctggaagagattctgataccactagtaagctattataccttctttaatgttgccttattctaacacaagtgaataagacaatgagaacagagaaacagaatgcaagggtaagagctgcctttcagtattgagtagtaatagattgggaatattgtgttaaaatcaaggaatttattaatgatacctgaagggaagcccttttctttcccatacccagcccaaagggatacttatttcataaatgttatactttataatgttcaaataatatcttttattatattgttcaaaagccaaagttaatttttctttgcagatcaatcaaaaaaccatgactctccgcacatacataagtgattttatcaaccattgcagcacttagcagattgaagatacatacgtaatcgtttttctccaccaagttatatattttcaccttttattttttttaagttaaaaacgctttcttcagtagcctaattccaaaggaaaagtgatttaatttttccgagaatacagagctttacagaatcataaaaatagttgaattagagaagattatttaaaaggtggaataagggcaccttgtcaagattagttacaaaacaattttataaaagcagtttctaaacaaaatttgcatttgataattgctatcaggtgcaagtttctttggctctggtgtacagaaaagcaagtctttccttataggaaaagtcattttctctttttatatcctaaactattttataatgcttgctttctcatgtaatgtgatgacaattgagatttttagcagctttttcatttttctttaatacatggaaagatggagtgaaatgaaaatttttagcagaattcaagaaagagacccatgataatgtgcataaaagtattagagcctgaatataaatgagaaattagtaataactgaaagattgaaaggagagtgttgggggggggtcatgtggggagtataatactaaacattcaattttctagaagtgttggtcttgtattctcatttaaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaactttttgagagaaagagtcaaaaacccattaggaaatcttatatacggcactgtactttcttccaatacattttgcatgcagtttttaggaagccctggcatatagattgaatgaattgttttaattggataattttggatgtttttggacttaaatacattcagtaagcatggtctgagtccttattttgtgctggaaagcaaagataaaagatgaaatcaaggctcaagagccagcatgccctgagatgctctctcatgcctctcttccacctttggagctgtgctttttctcctctgctagtacagctcttcccctagacatctgcctgactgacccactctcacttctctgctcaaatctttcgtctcatggagtctggctctactcacgctattctatgctgggacctacctctctgcttttgcaaatcattgattacttaacccacgatatcgtttacttattacgtttattgttcattgactgttccctctgttagattttaagctccataaggggagagatctttgtggtcccccattatcctaagtacctaggacagtgtggtagtttcccaacatgctggtaaacaggtgctgctgcagctcatcctacagctatttcactttctgcattgcttttgaaattgaccacgtgctctgaatgtcatgtgcagtcatacaaagcttaatggcccatcttgttttagaaaataacagcttatttgttatccacatccttcatctgaggcatcctgccttggccttaaccattgcctggtatgtctccagaactctttattttcttcccagggcctgggacaggtagttctgctggtgggaaagtgcattaagctgatagtaccttcagtcacttaagccaagtgagtagaggggctgtcatggtcagcgaatatcctcagggcaaattctgtgccctttctcccatccttttatctccttccctttgcatgggggctaaaattgccaatatgaggatgacgttttattttatttttctacaagccagtagagccctatgttatgttcttcggagagaacctcttccatgttttgtttggataaagagtgtgctgggtgtgcaaggtgggtgttacatgtcctcgggtgaggcagctattgaaaggcaatcttatggctctttctgctttagcttgctcagatcctggcatcccatcccgctacaccaaccccattcagccagggtcctgtattttctcttgtacacaacgaaatgagttgattgaaaatggggatatagggatatgggaataaaaatatattcctctgtcatatgtaagccatccagtggggctatttctcaagacagtggttttaactcatactttgagatcctttaattaaagtcatgctaatgcagaatatttagacgggtgagagtctgtgcccatgttagtttgtgcagtgcagtgaaacctgctaacacaagagattacttactgcatacccacctccatcctgacctgcacaaccctccctggctcctcctgcagcctctgacagtggatttcagctggtttcaaacctaagacataaagcatgcatttgacatggcttacgctaaattttgatcaaaatcccttttaaacagaaagaaaaaggccaccattggtgttggttttcatggtttcccaaggcatgttattgttaaatttttcacattcagcatttgagtgtcccttcatggttgttgttccctgtccagaaagcagggctgcaataaatcacaaacattgactacactgtacagaggtcacagaaaatagtgacctgatcccaaattacacacctctgctgagcccgttggtcataacctacgctgtctccttgaggcaaatagtgcttgtgcaagtaatttgctttgcttcacaaattcctgcctttacgaattctgttttctttcagaatatactttctcataacattcttcactcttccttcctacttaagtctttgctgtgaacttggaggtttgtcttgttaagcccaagtgatggggaaaaccacccaatttatggtgctgactgctcattctgcatctatcgaccactctgtttttgcgagaaagttgggtcagttacaggatcttagaagataagggcctttgagctctgtctctaacttctgaccacaagaaaagttcatcaggacattatggagatttttacccaggcatgaaaatttaagtgtttgccctctgtgtttcagtaggaaatgaaatatatttctactgaaatataattgattaaagagtgtgtctggaaaaaacaaatgtgctaattattttgaataaaatcagattagcctaaccacttagggtcacagaatatgtcatttgcatattaaattacttattgcaacacagttcaccctctcatgagcatttatattctcaatacattcttgattttttaaaaacattttttctgttaactttgtttccctaaaaatgtgtaagagaaaggaaagtagccctaattagcgatttgtgtatccgtggttttttgaaaatgaaattgacaaaaagagacaggatgctcacttttattgctttttgcaggagggttcttaccctgagctggcctggccactttaggaattcacaggcacgctctgaggggcctgtgagtagggaggctctcttacccagaggggagaggaaggcatttctccctccttccctcagtctgttatttgaagggaatcacttgaactgctctcctagagctgcggtgacagttaagtccagggttgcagaataagacagtatttgaggagaagaagctttctgccaggtgtctgtttctgcctctgtcctttagaatcacagggttatggtaggcaagttatattttcttatttaagtgaaatgtttgttcagatgcttttgttaaggcttctgttctatacacttctttctgtgttcttttttcaaaaatgggaaaagggtccagtgtccttatatgtatatcctaagtaaagccctcacacacctctgattcaaataggagttatttaattagagggagcatattttgttttctggcaactaagttaatgttgatattctaatacaattttctttgttataaatatggaactctctatttaacttgtcaatagattctttgataaatttgatgtcagtcttctctggtttctaggtgatgcatctttgtctacaacaagagacattctgattagtaagaatttcttctctgagttagaaaaaaaattagaaattctgaaattcaacaacaaatgctgacttacatctgctaagtagcacccaaaaaggggagaattttttacctatggcaaataagagtgccaaatgtgacatcatttacatatccatgttttgattagtaaaaaccaaacagatgttagcagtacagctggctcttgcatatatgtgtatctttgttgctaacagatttccatggggaaggatgtagcactggtctgaagtctcagataggagaagataacatggtgtgatagcttgaaatgaggagcataattgcatgatggattatatctgaatgttttgaggtcttgagtttatagcattcgatatcaaagcagtccttaggctttcaatagaggaggacacatggagggggacaaagtgaactagaaatgggctttatttcaattgcttgggtatagtgtacctaaaatgtcaagttgtttaacagaatatcagactactttataaatgtgttattccttcttaccaatttatgtaatattttatttttactatgaaaattccatgcagtatacaaacagtacgtggaattgtagtagaaacattgttaaaatataactttgaattaaaaacaaaacatggtatacattgttatataatggataacatagtgtatacattgttaaaatatatccttgcaattaaaaacaaaacaaatcagctgcaaacctttgtttaattatgtatgcagaactttctcccaatggctttataccacctaaggcatggctgtgattttcaggaataccctctctggactgtttcttgcttggaggtgtttgcgatgtatttgtatttgtctgtctatctattctcagttggtagattatgtaatgcctatagattattctgtcctgtcacagtttgattcattttgaagttataactgtgaatttattacagcgtattgcaggagacgtaatttgatgatcaaatctgatatccaagatcgtaaagaatataggcataaatgaaatataaatctgtgatatattatttgaatcagaaattccacattgctttgctttctataaattccttaacgttctagttccagtgttctctaattgtaagatgagaagctaaatgctgtctcttttgagtttcagcagtttttgttttaatccttctcttcccaatcagaagaactgtcggagaaataagacccagaaaaattggttctcactagtagtgtttccccaataatgcaacccagaagccctgtatatgagaataagggaatgtagtgagaggatttatgcagagaaacaacctaggatggttggaaagatgtacttacatgacctcattgcacgatctgattggagactggtccatggattgtatgggattattgcttatgaaagtgcccacctggtatcaagtttttgcagatgcatgcggtgtatggttttaagacatgtttcaccagtgtgaatatttaggctctacttctgttggtgggcagttagcaattgctggtatctaaactggtttgagacttactgcctcatttgaacagtatctgtgcagtagcgctaaactcgttgacatgatctgtactgagagttcctacagatttgtttcatatatatttgttaaattttccaaggtaagtagagagtgatggttataacatttgtttattcagacccctctaaatctacctaagaggtaacatgttagcataggcattagacaaggctgcattgtgaagtcagagtgactgtctggggttgtcactgtcatcttccaagctttctcctaaagaagaaaattgacataatgctctcagacttggcacatgggaccagtgccacagcaagcactggttctagcctgctactggtttttggtaaaatgcagttttcagaactactcaagggtgtaataagattaatttttatgatattagatataatatgttaactttttagctattgttaatcttaaacactgatggctttatttttattctatttaaaaaaataatttttgaggccaggtgcagtggctcacacctgtaatcccagcattttgggaggccaaggtgggcagatcacttgaggtcaggagatcaaaaccagcatggccaatatggtgaaaccccatctctactaaaaatacaaaaattagctgggtgtgatggtgcatgcctgtaatcccagctactagggaggctgaggcaggagaatcgcttgaaactgggaggcagaggttgcagtgagccgagattgtgccactgcactttagcctgggtgacagagtgaaagtgtctcaaaataaataaataaataaataaataaataaataaataaataaataattttcaatgcttaagaattttttatcagtaaacagttcatttgaatttttttttgcattcttgtttcccaactatagaaacatagctgaatatttgtggcatcattaatgcataatttcaaagcattttacacattgttaattaaatctcaccatgttctttcaggtagcaaaaagtaagtttatttttgattcagaagtatttgaagaagttagaacaagatgattttattgctaaataataaggaatatctgtggagtaccaaggaatgagatataatgaatttggttagagtatatcaaagtacatattatagtttttgtcttacacttccctgtgggtctgtttaactattgaaaatgtcttcttcaaaatgaaccttaaacatttgcaaacttactctttgctaattattctgccaggcatttttttttttcttttttttttgaatcttgctctgttgcccaggctggagtgcagtggctcaatctcagctgactgcaacctctgcctcctgggttcaagcagttctccagccacagcctcccaagtagctgggactacaggcacatgctgccacgcctggctaatttttgtatttttagtagagacagggtttcaccatattggtcaggctggtctcgaactcctaacctcaggtgatccacccacctcggcctcctaaactggtgggattaccagcgcgagccaccacgctggccctgccaggcattttatagacatttttcatttgacgctcacaaccaccctgcaaagatggcatattataacctttttttgtttgtttgtttgtttttttgagatggagtctcgctctgtcgcccgggctggagagcagtggcacgatctcggctcactgcaagctccgcctcctgggttcacgccattctcctgtctcagcctcccgagtagctgggactacaggcacctgccaccacgcccgtctaattttttgtattttttgtagagacggggtttcactgtgttagccaggatggtctcgatctcttgaccttgtgatccgcccacctcggcctcccaaagtgctgggattgcaggcatgagccaccacgcctggccctataaccgtttttgagatttaaaaactgaaggtcatgtgattgtgtaaatatttaaaaagtgatcatattaaaaaatatcatagtgatggcacattgataagattcaagaacattttgggcaaggcaggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagtattacaggctctccatcactcagagcatcagaaagtcaggcggtgaacgcaggagatttttctctcaggctaaccaaaaccatgttgaaatgaaaaccaccttggaactggccttttcatctcagactgccaaataactagcacccaagtggatcccttagctcagagcagtcaccaggcatgggtaggtctttccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgccaaaaaaaaaaaaaaatagtgcattgattttagtagagttttgaggagaaaagatggtgacttaagaacttactgagcttcctccttatatgttatgtggaaaggcaattgagaggcattcgttgataagcaggagctcaggaaagatacactaaacctcttgttcacgtgggagtacctaaaggttgcctttttattgttaagctttataatttaaaaaggtgtaaatttaaacttaattcattttggttaacttcagtaattatcaaaataataaaactataaagtatgtatcttctaaacacctagaaatatatattccaaaagataggcaacaaagaaagaataaaaataatacagggaaaatgtttactatatatgactactttaaagaaatacagacattaacatatgtatgtacgtatatacacatacatatatacatataaaattgaccatatacatatatttgtgtgttcaacacacgcattatttttcaggtactgcactaaccttttattccattgacttgttacttttcctaagaactctgtgacactggccttattatacctgttttaaagataaacaagtttagttagagatggcccaaggtcacacagctagtggaggagctgggatttgaccccaaacagtctgactgttgacccaatgctcttaagcaactgtgcaatacagcgaaaggggcgccgggggttaatgttcacactgcttgatgctgctgacttccgaccagccacaaggcaccccggagccaaaggcagatgactccctggcttgccagtgacgtgtgatgcggtctgatatgacaaagtgagttaaacaagcagatttttcctctcaggaaacagacacaagaacaactgaaaagaataaagcagatgtgtgagttactattccttacagcaaaagaacctcatcagaaccgcaggctggaaagaggtgattacttttaaagggcagttcattcctcctgcatgttggaaactgtggctcttaactggctaaaattttaactttcagtgtagccctcacttggcttgtgcttcttaatgttgtagataacattatagatttatataatattcaacttttatatatatattacttatatataaatgtttatgtataaatatatatttgtatataatatgtattcgtatatgatatgtagtaaatgttatatttaaaccatcatatagaaaagccattattgggtacactgtacaaatctgcctttataattgagtgtactgttctactaaaagcagctttagagaaaggattgaaagccagctctttctacttcactagccttcattgtttggattggcattatgtgtacagttatattgtaactgtcacttgtggtctaatcttccccttaggggaaacttgagaaacctggtcagctttaacatttagaggaagtttaaacatattggagcataaaattcacagttgtttaactgaaactccagttcttgtcagaccacatctctccagcccttctgtgattggaatcatctaactttggccctcaataaggaaaactttgacaagatgcaaaaaatgtttactcttgttttctttgccaggaacctgagtctgcagcagactctgagacctctttgcctaccccaaataagtgaattgtcactgtaactgttttttatccccataactgctttcggtgaatgccaatctagttgttacatgcctttaatattttgggtaattatgttctttaagaatgaaaatattttttccttccttcctttcttctttccttcctggttttgttatagtctagctgtgagaccagttgcctttcatatattctagaagagaaggatgaggtgagtttcacagtgatctttttccaaaatacaaaaccactgtcactctccacttcccaggcaaccccactcattctattttctagtgagggttttgcttagatgatgacgagtctcttgattcagtggactcctaagggaccatctttcaccagcaccaaatgctgtttagttcacatattgaaatgttttaaattataacttagcaattgtagttagtaatcttcacattatattgtctcacatttaatgtataatttcctaagagaaggaaatggtcctggtgggggtcaatagttatagtaactattaataatactgatgactactagttaatagtaattaaggcctcctaaaatgagaggaaaaaaaatcttttgtttataaggtttaaaaagaagagttgatacttaatagttttagtaaaaccccagtgcatgttcgattaattttgttactttattctgggcatgtagttgaataattacctgcatttttgatttgctgaaaaggtggtggttacaattttttttgttttttttttttttacagtactgtttttagttcattacattgagatgctacattttccttttcttaaatacatgcaagatgaaatgttttacctctgagatgaaaaatttgaaatttctttaatgtgactccttactaacacaattgcaggcaagcattgaacatttgctttgttccaggcaccatgtgctgtgtgctctacctacctaatctcacttagtccacttagtgctatttgcaggttgaggcttagaaagaaaaagaaacttgcccagagtccaacactagtagctggtaaagagctggtctttgcatgcagcctctctcacttcaggatgggtgcttcccagcaccacactgtaccaccctcaagacgagttgcaggaggaaaggaacctctagtggtattaactaaatcttagcaagtagttgcctgtaaattgtagacttttaaatacaatctcacatttctgtgatctttacccatacaccagttaccttcaaactaatttaagaatcttatagatattaaaaatgcttgattggccaatatctcatttctgtcaaaatcatgtactagaagcatgtatcaaatcagagacttatttatgacaatttgcacacacatttggataaaatgcatcaacttctttcaaagtttacttgaaataaaaagggaagaatacgaagtatcacaggttaaagcaatgccctcattccatttaggcaaaagtgttgtgctatttgaatagtgttagtttgagaatatggagttgtactccttatagcaattccaacctagaaaaatgtttgtgttttaattgatgggttaggcaaaaagttaatctttgcatagaggaaagaaacagctctgacttagaggttttggggctagaacatggatcaagtgtctgaagtttttcatgtggcctcaagttgaatcttggtcagagaatacacggtggtcaaacttcacaccatagtcataatgtatgaagccaaaagaaaagtcctagttgctgggtgcttccattatatcatcaacctgggtttaatgattttattggaagcacgacttccagtgaggcaaggcagtaagccccagaagagaggccttccatgggtagataggaactcaaatgctttcccaggctggacccaggagactgtgtcagctactgtgatatggcttgccaccaggacagatcattctacccgtctaaggagttagggtatccccaagagctgtgatgggaggtggaaattcacacctgtgaaatgggaggtatgctgagttgaacgggatagcccaaggcctgtccatgaactgagccatggccaaggatttcttaattctagaggcctccttcttgagcttgccttcttttgaacttggccctcagtgtctgggtaagttggagcgtgactatccagggaaagcccctggtttgtatttagtcaagttggccagagaagactggatctaagcgggaataaaatttgctgacccccatctcagaggttaacattttcatttgtgttttgcatgactcattttaaattacagtgctctacaagtatagaaagaagccttcctcttcccaccgtccccagacaccacataatggaaaaagcaagaattttctgcataagcaaggccttaaaaaaaaaaaagccagcctctgatgggacttctttcctgccagaaatcccactggtccactgtcgcaatttttacaaaaggccacgatgaaagagtaaggcccattttgagccctttgcttctgtattatgtgaaacataacttgtatgtttcacatatgttcttggtatcagaagaattgttagtttttgaacatgtaaaatctactagggtctctgactgttaaagtataattttgattaagaaaagatttgttccactgctttgattagacacataaaactttgaaaagttttgatgttctgtttcctgttttaaaaaaatatgtcctctcctatgaactctaactagatgagaggattttcctcagagaaaattcagccctgggaagaaccatctatggaggtcataacctagaaaattcttcaagggaagttgcagtgaattaaaagagggcggagttagaaagtcctgttctaccaaatttgtgctaatagttgcacctttctttctttcccagaatggtcactggagaaaatgtgtaaaccaactgcaaacaagtttatccgttgccacctttcttttcctttagtgacagttcaattcgttaacctgaaggagctactgtaccatcaagactagctcccagcccagggcttcagcataaagcagctgctcagttaattttggtggatcacgggcagaaacaagttacctttgggatgcagattctgaatagtctgccatgaaatgattaaatgaatgagagtgatgaggggctacttaattggactatgtaaaatggctccttaagcttcgtggacaattgagtaatttcagtttcctctcttcactcttgtttacttcctgctcttctagcatcaagtgttaggtattctgttctcttacaatgagaagattaaacagctgtagtttaaattaaagcattaatttggagtgttctgtggctacattaattatattttctactaagattaaattgcagatggatataagcagcaatatatgtttatccagggcaaaccagaattctgttaaccagccatccttggtgactttttatttatatataaaaacctttttaaactgaaataatgtaacttgatttttccccccagttaggtagaagaaaaaataattggatgcagaaaacagttgtatggagcgtatttgcataggtacaggacttgagtgacagaaaattccttttatttttttccccagtgggatttagcaaaaagcatgtgttgaaagtctcttgactaaatggatcataattaaagactttgggatttatttatgggtattttaattagaaacattaagttcactcagtggtccttgtgaaaacttttttctaactgcttattttatatcaagtaataaataaaatttctgtgggtatgaagatgagttttagggccgcctatttctctaggaccgcccccccgccccccgccgccgcttcagagagcttttctctttctttcacctattaaacttctgctctggacctcaaaaaaaaaaaaagagttttagctgtaaccacattgtaattcgtgctgaatatatgaatgctgctgttcactgaatagttaactggttatatcccttgttaatttgaagttttcttccttcgttttggaatgatagttataaggcaacatgcattttagaaaaatgcacttgtttgaacttctcagatctaatgtgactctgtgggactagatgttaagaaaccatatctttaactgaacatcatctatgatattccatctcataacatgttccatgagttttatggacaatttctaagaaatccaaagtagcatgcagttttatcaacctctctgcatccccttggcacaaggaataatttttctgttattgaggggcaaaacagaggggtaaaggcactcatacagttaaatgccagattaagtcaggcatccaagtcactctgctttgggttgattctctgagactcagctggctgacttcaaaaggacgaaatagatttcaacattggaaaagaatacagtatagaatatatgatgggtcttgttagctatctcttattttctaatccaaagagcctcctagttggaggaaaaacttgaactacataagtatatcagcaaattttcattatattttataattctttattgcattatacgtgaatatatttagcagtggtagtacgtcttggaaagtttaagaatttagacaaatatgctttttttttaaaaaaaaatagttgagttttaaatatgctgtttgggtccttatgagcatgtgggagatatataggagaaagagtttgttgctgatgttatagaatcaccaatgcagcattgcacttttgttcttttccattcattgttcttgcttacatggagcacttgcaaataggctggacgtctcagagttctgaacaatgcccttggctaaccgttagtcctaattgctgtgactaatgtgctgtgtgacctaaagacggtaacatacttaaccttggttttctcatctgtaaaatagaattgatgacctctaccaagccaaggatttcagtgaggcactcaaaaataaaaattaaaaaatacatttgggacaaacatgaaaaaaattactttttagacttaagcaatgcatttaaacctgacgaaaatgaaaggaattgaaattgtttagccacagaaaataaagaccaaggaccaatttaaacagttgaaaattatatgaagcagtgttttatggagagtagtaatgaactcttcttcaccttttttgaggctgtccaaagaagaaatgaagttagattattgcagaattacataagttagtaagcatggactgaccagttctttctaagacacatacttgagtatttattctcttcagttgcaatgaaggtgacagtgaatttgctgaatagctgtgtacatgtttccccaaagagaccactggaataaagttttgtttcttgagacagtttccattgcatttataagtcttgtcccttgaaggatgttttctggtaaacacctgtattctttttacattatatatcttcattaccgtacaagtttggttgtgagccattccaaagtctttagtatgctgtatgggtgtattctatactttataccttatttggaagtcataataatgtcaaaactatgcctagccatccccttccctgcagagtctcttttgctttgtccacttggtgtgtatattttttttttttttttttgagacagagttttactcgtcgcccaagccgcagtgcagtggcgcgatctcggctcgctgcaacttctgcctcccgggcccaagcgattctcctgccttagccccccaggtagctgagattaccggtgcccgccaccacgcccagctaatttttgtatttttagtagagacagggtttcaccatgttagccaggctggtctggaacgcctgacctcaaacggtccatccgcttcagcctcccaaagtgctgggattacaggcgtgagccaccgcgcccgtccatgtgtgtcttttttattttttgttttttgagacggagtctcgctctgtcgcccaggctggagtgcagtggtgcgatcttggctcactgcaagctccgcctcctgggttcacgccattctcctgcctcagcctcccgagtagctgggactgcaggcgcctgccaccacgttgtgtgtctttttaaaagatttccaggacttctttttcctttacaaatccaaaattgcagtagcttaataaataacaaatattttggttttatgattactgtcaaatagctcattagtaagagaaaaaaaaaaatgctgagccttaagaggggagaggaaaggcagtctttctgaagctgaatcctttgcctaaattgtcttagcaataaatcttgccacctattggtaaaaaggaagaactaaaactaaaaggtgtttgccgttctcacaggtagttagtagtgtgatcgaaatagaattctttcagcggtgcttttggataaggggcttggaaatatgtgatttgatatggaacttttccctgtgctttgaatttatcatggctcatctctaagtcataatagttttttgagtagaggaggtatgctgctctcatggtctctcttaaaattatattttttgagatagaattccattttaatagatcagtggattttaattggacacattttagaggcttgattgattttgaaaacatttttcttttttctttctttctgtctttctgcctttctttccaccacggctaactgcagtctgaacctcctgtgctcagttgatcctcccgcctcagcctcctgagtagctgggactacaggcgtgcgccaccatgcctggctaatttttctgtagagatggggtttcaccatgttgcctaggctggtctcaagtgatctgtctgcctcagcctcctaaagggctaaaattataggtgtgagccactgcacgtggccttttttttttttttttcttgagacagggtcttcctctgtcactcaggctggagtatagtggcatcaacatggctcactgtagccttgacatcttggggtcacctgatcctcctacctcagcctctggtgtagctgggactacaggctgaaaacatttttctaactctgttgttagtttgggctttccttcattccagcctctgaaatccattatttcctgcccaacgggacaggccagtggtgacgttggcctttggtgccagggcctgtttttccagatcatgggcaccatacaaagataactgccctaaacggcatcattgccccagagtcattgaatgtccttaaggtgcatttgataaaacaaaaacagttttttgttttgaaaattctcaagtatttccatactgggaaaatgttctttttttttttttgacagggtcttgctctgctgcccaggctggagtgcagtggcgggatctcaattcactgcaacctctgcatcctgggttcaagcaattctcctgcctcagctgggaccaccggcacatgccactaagcccggctaatttttgtatttttagtagagatggggttttgccatgttggccagactggtcttgaactcttgacctcaagagtgacccatctgcctcggcctccgagagtgctgggattacaggcatgagccaccatgcctggccaacaatgttctttttaatggtgttttccccactatctggatagatatatgaattcagttactaagatgacttagatttaaatataaaacactagcatagcagtttttgattcttaatattatcttaaatccacctcccctcattgtcctctgtatctaaacacccttcaattcttgagaaaattaagattaccaaagattagtaatctatttgtgattgtgtgtgttggtggacatcctaacaaatttatgaataaagccaatactgttttgttagtgtccttattttttctttacgtctgttcatatttggaattctaaggcactacccagataatcatttgataccctttgttggcatgacatgtttggtcaattgttttggcaaaattatttatccaccactgggaactaagcactgtaacaactaaagaaagaggtcatacaagggaaattggaagaactatatgttatttgtttcaatttttatgtagtacacctatatatgtgtgcaaaaaaaatgtaaactgttacaaagcaacatattgatgaatttaaatgagtagagcataataaaagcaaaaaccaaacagaagagtggttggagtgaggccataataaaccaagagatattttctgaaggaagtgaacatgtttgcattttccagcatactgctatggatgtcagcgttaggctaatacatagtattgcagcgtgattcaaaaaggtgagatagaggggaaataagatagcttcataaatattaccaaggaatttaagacatgagcattttatgtagggaggttgaaatgcattgttataatcaggctgtgtaatttccttctgtcaagacctacccatttaccagtaatgataccttctttctcttctatttttgtctcttcctttaggaaaaggaatatatgcttactcattatttaaaattcagagtcattttcctgttccagttggttttgttcctggaaccaccaaagaagagtagaattaggtgcatgtgaaacttttgtttctgctttttctactcaatcaacttttatccctttttaatttttactctctcaaccatcagttctatatcatggtatctcttcttggtctttttgtattatatttccataaaaccagatgtacggggttgttaaaatactgcctggacatattatctaccctgcactaagtggtcctatcacaaaatccagttaaacacacattgaagtatttaaattgtttcttttttaaataacatcatattgggcattggacttcttaactaaactatttctttcactaaatgacattggttaattcaacaagccattgtaggaattctgttaacccagtagcttctactactatgttactatggtaatgacttagcttcccataaagctgcatttaaataggtgtttatagtcaccaattaccaggtatttcaagtactctttgaaaggggcctgcttgtggtggggtggggggcgttaacatagatactttctcagtcacgtagccatttgaagtttttcaggtagaagacagttgatagactatttggtgagcaaatgaataactggatgaatacccatctgggaacccctaaagaactgaagatagttccctggccatcactgttcacagtcatctattatgtgcttactctatgccaagtgttgggctggattctggggtcaccaaagggaagagaaaattttcactgccttgagggtagctaaaaacttaatggagggaagctgagagcatgagcgagcgtgccaccccagctgggtgagcggcacaccttgggaacagctgggagacccccagtggtgtgtgtcttccttcgcccttagcacttgctcctctccagctcactgtgtttcttttctctctggggtctaaggagcttaggcttcactgcctgctcctcagattgtgggagcaggagcagagagtgggtgcctgccacgggacagggggtcctagagacaggccccagcatgggaaggcagtggaaacccatgcattgctctctggcattgccacacgtcttctgctgcctgccttccagccctttgcttttccccagctccgtcagctccttgcctctgacatcagtgatgaaagtcaggcgtggggggattagattatttccattggccttgatagacttagacatataatagaagctatgataagtgagttagttttccatgtttgtttactgaagtttatattaccctttatgtcaccaaaacatgcccgtttgcagtcattgccaatgtagtcatgcaaaatcacttgagtgaaatagactttggggatctaatctcaggacctaaccaccatttataaagcttttttggggaaaatgtgttctggatttcgcacagccagcttacaaatgagctttggaaacacaatccacatgtaagttggagacttcctattattagcattcagccctgcgaggagagcccttgctttgttagcaggcctatgtgtcctcagccctaagttcctaaaaccagcactacttgaggagcttgaattggtgctcttggagttctttagattagttatgagacttcagaacctgcttaccagcagtactgagctcaagaggaagcctaattcatatccttcagaagataattttaagagagtgtgtatgttttcgttttgtgaacaaaggaaagttaatctggtgctccgtgtctgttttgtaattccccaagggagaaggaaagggagggaaatgattgatttccagataggataaaaaccagtcagcacacaatgggttactgccaccgctttctgataaggatcctacttcaactatctgaagagattcttcaaggtggaggatacagtggttatattagttactctcacccttgttattatggaaggtaaaattcctggatcctagatttaattttaaaatagtaatttaataatgtctggtggaaacctcttaaaaaaaacactttgcagcacatctctggtagccctgtgcttgagatgacttttaggctgccagttcagaagatggaagatataaactgtgttgatgagttggtttttcagtggaccctgttaggttccttttttaaaaaaataataatttttataatgagtatgtcttcgtgagccctcacaacccttgaagtttttacttgtttggcagaactaagggcactgaacgtttgtaagccgttcactaacacttacaggaagggcataaaagggtgctcaagtcagtctgtaggtggtgggggcggggtggaaagaggggattcctgtaggcctggatgaatcagccactgatttctgatggtagccccagctgcaaaaaagtaggaagctttttttatggacagaactacaactcctttctttcaagtttttcagccttttcacacttttccattcttcagactttgcaagtttttaaacaaaatgtttgtatttccccaaaggaaatcacacagttgactgcattatgagagggaaaggagcaaactctgtctcatctgaggaggggctcagatcaggagttgtgtagggccctcacccggttgggggtggtggagccttggctgtgtgcaggagtgactgttcttggagatgttctggttggatcatgagtttgggcttggaaagcactgcctcaagttcatcagcaggaatgaggtagaattcactacttgctgtcttaagacctttctgtctgccaagtgtttgagcaatccctcacatctcccccttgaactaaagagcaacaactggtcaagagcccagcagggatgaaaaaggttggccccttgcatccttcatctgctgtttagactaagggccgcattgtagaccactctcggccatgctgtcctgaacccgaggatcagcagaattacaggcccaatttcaggcagacgtgagcttgcatctgatgacaggcaagtacctacatgtgtctttcattactccgctgccttaggagatgctgtttaagttggcagatatgcttatttgaaagcaaagcttgttgctggtgagattactgaatttacaaaaaaaaaaaagtggggggatcagatgccaagggagagggaagggagtgtgtagcatttaaaagtgtggtgaagccatcaagttaacaagaaaaagtagaataaaatgtggttccaatttgttgtactgggctcaagatgataatattgcaatagtaaactgtagggatgtgtgcgtgcaaatgtgattacatgtgtgcttgctttctgaatttcaaaattgtagaagttattagaagttctaattttagttcccaatttaatttactctgatagtaaattagtaattttcaagggatttactgataatcagaacaaagatttgcaatttctaggacagatccccaattttgggggtgggaaggagctactttgtatttccctgaaaccttgagttactggggccgaacatgtagggcagatattgaatgaccaatcctaatgctcttagcaactttgctaagtaaaaccccgctgccatccagtggcaattggctatacggcatggtagctgtaaaatatgcccttttctgccttttctccctcagattccacctttctcagatgctcccagttttttttcccagatggcacctgacacagtacttgacaggaaaaattgactttatgtctggcttaggtaattcagggcaagtgtgcatttatttaccttgtctcttctcctagcaatactaatttttatctacgttgcatttttattttctccccagatttgtcataacacacatactttttccttgaatatttttgttaccttagctaaagaattaatgcattgtggtatttctgcttgtcatagttttactttagagtagatttcgcttatatctttgtatttatgctttgagctgtggtttaccaatttcctagcatgtttcatgacacttatcctacatttcagacaaggatttatgtgtcccataggattcaagctggacttggagaaagagccagctagcaaatggaattattctgacttgtgaaaggttccagccttttaaaactaggctctgagaaataaaaaaacaaatattcttgggaagaaactgggtttgtgagtacttggctagaaattttaggaaaggaaagaacatttcctctggcctcgggagcacattcaatgtgaaatattgctgcctttaaaagagccaaacttaaatttctatttggatcatttacttgacttaaaaataaagggatctatttttttttaaggttcagaaccctattttaaataaaatgacattctagtaagtcaggcaagatgcccccaacatgagctattaattaaaaacagccggaacttctggaggtgttagcaagtatctactatgagcttggggattggcgaaatctggtacaagttagttccagctgcgcacatttgccttattacagttctttatgataaattaaatgcatgcttcatacatcctttggtgtagtcatattctctcagcacttgactaagcaggtggaaagcttatttagtcataggatgactgaaaacaatgaactataaacccatgtatatccactccaagaaaagagctaataaatgtcatgttttttattttcccgtggaccccctttttttttttttttttgtattttataacctttccagaatcttgagtgatttttaaatgtttgccctttggtcataaatgcagcaagtaaatgtgagtctgcacactcgaatgttgtataaatcagttgaccagtcagtgttggagcaaacttctcaggattgctctgtgaactccctgttctctggcagttgccaaatacaaagataaaccaggagagacttattcccaagaaaagaatgattctgcatccttaacttacatataaactgttgagatgtttcattgttttgtatggtcaagccccttctcttgttctctctcttcatcaattagtatggaaaattggaagtttactgaaaagagtttcgaatcatgggattttagatttgaaaaggaccagagggatcatctactcttccaacaaataaaaaataaaacccccaaaggaatgaatgatccatggctgggacattggaatctctctataaaggagaaatcatattaaggtattttcatcttaggcctctaaccccaagggtatctttacaaagactttattttagtgaagccttcaataaacagtgacctcatgtcaagaattctaaagagagggttatggaatattggtttgatattaaagtcattgttatcttggagctggcctgaatggactaataagtggcctgtcaccagttgtaacttacttttacaattttaatgtgatttaagggaagacactcttggaaatgcttagttatggttcatacccataatcgtgtttcttttaggtcttaaaattttatataatacaggggagtagattgcatcagtacagtctttttctttttttcttttttttttttatgatgcaaacaaagcagtatcttaaattaaatcaaggtttcttaaggttccagattcttattcctaaattttccactgagtaacctccaaattcttctcctgcctttgtccctagttgacacaagtcaggccacaattttttttctgcaaatggacgagctgctgctcagaggctgcacttactggtgagagatccttcaagggaaatgaatctggaatggcctggaacatttgtctttgggttgctccagggctttattagagcttctgagatttctaagtaggtgatgaaatttagcagcatctgattttctaaaatgaccaaaggagaattgtttcagtccctgatttgcaaagtactcactttttggtcctctcaaaatttttgtcagataaagatttttccgtgccatggatataagaaataacccactcttaccgataaagggaagttagtgttgtaaaggaacaaatggtgattcaggtttgggagactttggaggtattcattctccactaagctatatcccaataccatcattatctgggtcagcctccgattcagcctcatcctgtgcttcagcagtggggtaaaacaaatgtcacttgttagctgcttcttcatgaccttcatagactatgcattaatttgaagccctgcccccaaaaatagtgcttgggggggaaatgagttagtgattttgtgaagataatgggagttgaggaaaacacttaagtttgcttttctgagctctagcttcattttacttctcagtctcagtatttaattgtctccactgttttttctaacttggaaggaaatcagatggcgaaagtgaaacatacggctatcaatgtgaaaaagctgctccctatagcactggaattctcttgtcattaatagctcttgtagtcgacagattataatatacagagtcataaatgttcttgttgtcatttggaaaattacaaattcccaaaaagtggtgattatttggggctttgggtctgcaagacgtttcacattaaaatgctgataatatcttcaaaaaccacagagccatgggccttgcaggcttggtaactgactgcctttgtggtgtggttttattctttctactgaagcacctggttgaaaggagtgggatgctgaattcataggggcgtgttcacaaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactctgtttttctctttgaatatcaaaaaaaaagtataaaaacattttgtaattttttatttatttatttttgttgagacggagtctcgctctgtcgcacagggtggagtgcaatggcgcagtctcggctcactgcaagctccacctctcaggttcacaccattctcctgcctcagccttccgagtagctgggactacaggtgcccgccaccacgcccagctaatctttttgtatttttagtagagacagggtttcaccgtgttcaccaggagggtctcgatctcctgaccttgtgatccgcccgcctcggcctcccaaagtgctgggattacaggtgtgagccaccgcacccagcaacattttgtaattttttaaagggctacataaattcaaggtattattgctgtacttcttttctgttaccttatgaagttgattgttgttgaagcaccaacagtatgcatacatgggtatccagaatgaccatctagtctcagttgtgcaaaattcactatgtagtctcatggattgagaggggcaattagcaagagtgtgagataatggagaacaaaaaataatgccaagctgggttaaaaaaaaaaaagtttgggaaagaaaaaacaagtgctcaagacaagcctcctatttttcagtttggcctagccctagccctattgaagaaggttagtacattcacctggccagttttagctaacttggttacctggcaagtggcggggatgcagtacattagtacttgtcctgtggtacagagcatgtgtctcagggtgtggccactccagggagagggaagacgtgctttatggggcctcctcagccatcactgtgatatgtgccaccaggaacccaggacctttcatggtccagtctgaggtgggagcaccacagaagcaagagctgcctggcccagccaagcccagattaccctaaaatcttactgcttttttcccttcagcattttaaattataggagcaagtaaaagtgtacataacgcaaggcaatctgaacaggtggctgatagctgctccatccagaggaagagccatgaagttcccccgacccacacatttcaccctgtcttgtctaccaaaaatcacatgaaaatgcagacataaccatggaggagtaacccatgaacaaagggctggtaattacagtttaatgctgttctttttacccctttggctggctggctgtgcaaaggcaggccccggtaattacggtttaatgttgttctttttacccctttggctggctggctgtgcaaaggcaggccccacaggggagtaatgtatttgtgacagccagttggggtggggagagatgggctgtactacactttgaatttattatgttctgctaatacttttactcctatgctggaaagttatgttttccttcctttgttagacaatttttgcagagtagtttaacattttcaaacatttactatatatagcacttttaaaatccaggaactgtcatttccaaagaagattccatgtctataatattaattccctgtcctctcctcattgcctttttcagacatccactgtagatagcctctgttccccaggaactaacatttccaaaggaaactcccttgcctataattccctgttatcttcttgttgcctctcctgaataataatttttgattcagtaccttttagctatttataatgttatcgtataatctgagtttgggaactgcttgccacttccagtttctgacacccaaaacacattttatgcttagagaaaacaatagcaccctgactttttagaagacatagttttcccttggggatccaaactggaagcagatatttgagctgtgaacacattttttcttagaagagtcaattaggagctgggttgaagcttcagtctatgcacttagagtcaggttttaggaccaagagcaagcactgtgggcacctgttgtaagaaaacatctgacagcacgaggtgctaaattgcttcaaaatcctccatagctcgtggggatgctacctttttagtaggagtttgaagcccagaatgcactttatattataaccaacacagttgaaaaataggttccatgttctataagaatggattcattaaactgcatgttctggaaaaaggatgtattagagactttgaatttgaggatcctgtgttatatacatctctgagccatcttatcaggaagaaaagcagctccttaaggtgcctgcctcttcctctaatactatgtacatatttcgacctctgccctctttaagttattttcatttgtcttgtagccagtatcagacatgttaatgaccactaactttgtaaatgaaattattgcagctcataatgtcaagatgtgaacctaagcaggccttaggttttctgacttaatagccgaaccataccagtctttccctgatcattgaaccttctgtcttctgcagtcagcagaccgtctctaatgagaggtgcacagacacttttgatgcttattttaagggaagccagtggcagatggagagccatcagatgaaactgttattaatcacaccatttctgaagctgttctgactccacaccctgcattgtgacaaacgccaggatgccaagttcctagtattgcagcaggttcttagtacataacaaacactatcagtgcccccagctcaacttcgactaaatgccttccaatagagttaagctgtttttatctaatacatgctaacagtaaaaggacacagaccctcttatttgaccctcttagcatctaaggaatatgatactttttttctttatacttagctgtgtattcaaagctaacacattctctaagtaaccaagttcacactaaagaaaaattgaaggccatcctctaaagccatgctgctcagtgcaggagccaccagccacatggtcaaagccacacagagccactgaaaggtggctgctataaattgagatgtgttatgagcataaaacaagagagaaatgaagactatctgcttaataatttttatattgattatatgttgattatattttggatatgtggggttaaataaaagattaaatttcaccttttgtttttgcttgtgatgtggctactagaaaatgtaaaattacatgtgtggcttacagcgagaccccactatttacagggcactgaaagtcattcttcctcttaattcctcatctaaactctactcattgactattttgtgtatctgcatcttttcttccaaaatgaatgatcagctgctagaaggcatgactatggaaacagtgtatcttctactgtgatttttcaagagtgaggaagtttggctatcaccatgggcgtgaggagaggggttctgttctcatttggtaaacatacaccagatatgctaaacatcccatagaatatcttagacaaagaaaattacagtaagtagagaaatggatcaaagagtggctattcttggactctctactttccaggtctttttggctagagaactctttttctaactttgttgcctggctcttggcagtcaatgtccaaagtagtgcattgagctgccccccaaaaggggcacagtttgtaaggaaaccatatgccctatgggacctcatgggatgacactcagttagtacataaggatctcttggaagggagctgcctttatgtcctctaaaccaggtcatctcttatcagttaaatcctggtgctgactagtacagctatatgagcctggacaaatcacttctgagcctgtttttcctctctgtacaatgacaatgatgatagaacctttcttataatgttatgaaagattatattttctgagataattttagtaaagcaacgtagcatagagcctgatacatgttaagtacgttgtgtatattggccatgattattattggcttcttggtaatgaaagcatcaaatactaagggcagcttttagtatattatttctgatcttgtgtgatcagaaataccacatttttgagaatgtattattttccaaagaattaaatgactctcagaggggaatggataaacccacagaggttctggaaatggagcagtttcctgtaagtatcatgacttccaattaagcccctttgtctgttttatccctgtcacttgtactcactgtgtagatcatgagctaattttgcttggactctcccctcccgccatctcttagagcccagcagtgctgtgcatgcatgggttaaaaatttcaaactgtccaaatgaattgcatttattggcaatttaatgctgaaactcaaagagggaaaagaggagaaaaaaaatcaaagatgaagtggaaagacaagggcccttggatgcagccggacagaggttgtaatatctgctctgccaaacactagttaagtgatcttggtgtagtcaccaaacctcttgagtctctttcccacatacaaaatgaggttgatgtgtttcacaaggctgttatcatgactcaaggaaataacctaaatgactagggcagtgacagttcacctctctctcttcatattgctctcaatttcatgatcttcttctccccgcaaccccatgatttatagaagccaaattacgttctctgatttatagctgttgtaactttggaatacatttaagaacatggaattagttgtcttttgttagatccacatacagaagtcacagaaatgttttcatcattttgaattttactgttcattctggcaaagtgaaaatgtataccaaaacactattttaaaccacctatcccctgggttagaaattataagttagtgtagcccagtgaagtataattaaatgttgccattctcccatttatttaacttccttccctccatatttgaagtaattttcgcttggtgccaactccagtcattctccagatgcctgtgatttcttccagattttcaacacacagtggctaaagataatatagaattattttttaagtaatttgtgattaaatgtaaatttagtaattttatgttgggacatgtgatctccttgacattttctccaaaacacagaatttaagcactagaaatgattttaggacatctagttaaaccattaccacttcactgttatgacagtgaggcctggagacattaaatgttttgcccaaagttaccaacatgttgttggcagaaaaatctggaacatatggcctcatctattgtctaaattttttctactagtgcacagtgccttttcaattgctttttatttgataatagtgacaatcataaataggggatttaatcaatactcttttaaaaaaaaaagtcacagaaagaaagcaattgtattgaaaacccctttctagtttttccagtaggttacattaaatggccccaaaaagtaatttatgggctaaaatgaatgtcttcagaaggctaacataaaagatgaccaacagggggaaacctgaaacagccttttaggtaatttgcttaacttctagcccttttaaaaaaattactcaagctcatgttagagccaacaaaaaacatctgttgttttatttatagccacaatttctaagaagcatattctatagcagatgaaaaagtagttgacagcttataattcataaagttactgaggcctaatctgatagaacaaaatgtacaaactccctcccgtggttcagaccctatcccttccctttctgctgaagacagaaatggtgcaacagaggagtggagcataggttattacggttgttaaggaagaggcgactctgagatgataatgcagaaaggagtaccccgcagtgataaatgattgctttcacctctgggccatccaccagcctgagtcactgctactttttcattaacattgtatggactttcattataggaagccaacattttgctgtgttcaatctacagattgttaacagcgtatttccatcaggaatctaaagtgttaattaaaacgactgattgaatagttccctctctgagggaagcttttagtttgccccttcctttcaccagttagctgtagtctatattgacataactttctccctgctgactcttaagcaattattagaattcactcattactcaaatatcacctctctgtatctgttggcttatttctgagaatctttttgagaacatgaccaggcttctttctataatttttatatatatatatatatacacacacgcacacacacacatacactacatatatatgtatgtagaatacatatatatatctatatatgtacatatatatctatatgtatacatatatctatatatgtatacatatagatacatagctatatagatacatatctaatgtatacatgtatacacatgtacctacatgtatacacatgtatctgcatgtatacacatgtatacacatgtagatgcatgtatacacatgtatacacatgtatctgcatgtatacacatgtagatacatgtatctgcatgtatacacatgtagatgcatgtagatgcatgtatacatatatacatgtagatgcatgtagatacatgtatacatatatacatgtagatgcatgtagatacatgtatacgtagatacatgtatacatgtagatacatgtagatacatgtatacatgtagatacatgtagatacatgtatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtatatagatacatacatagatatatagatacatagatacatatatatttatatatgtacatatatctacatatatatctatatatacatatatctacatatatatctatatatatatttctacatatatatctatatatgtagaaatatatatatattctacattttagttctgctatatctatagggccttctgtatatcacagttttgtgtgttgttgtttttttttaagtgcattggtttggcacaaataactatagtactatttattatcctgagcttttttgagaatgtagtgatagggttcaacatctgcccaaattgacccatctaaaattataattctaaaaccataaccagaagaagcccattaatttctttagtagagaggtgagtagcctcttgtttatttcactactgatcatagtctattgtgagatatgaagatgtattagcccaccagaattaatcacctttgtctgaagtagtgaaagtatattgcttcattttgttaaactctgattccttacacaattgttaaggattgtgtttacttttatctcaaaattgttaccttttaatatatatagtcttatatcagtgatcttttcaaacttttaaaatgaagtctgaataaatattattttcttatgcatttcttctgcaccagctgatagggaattttctgtacaatgttttcaggcctcttgcctttcttgcctttatttttctctgcaattccacacacaggtcattgctttcccttcctctccctttttgatcatggatgcttcaactcccttcatatatttgttaagcatattttactaagatttcattttgtgatgcttgcaaatatacattacaaaatatatatttttaaaaagtgatttgaagggccctctgtccatctgatgattaactagaagagtcttttgtaccttgctaaaagtgataagttagccagctatatttagctggataaaacccattacatccttggggaagaatgtgctttgtttagctttatgagaaaatatttaataaatgctgtcttgaaaatatttagcctggctgagtgagctggcaaggcttcaatactgataaagcagaggtgatggtgaaaagctggcctgccagtccaagctcaagttaaaaaaatgcacctcttgtcactaagggttgcaactgtcgccaagtgcttgtccatcagtgtcacgtaaagattttttaacctcacatatggcatcatgcagtttgtctgcctaaaaaggcaacctagattcacagagtggttacaattggctttgaagtcccatctgttctgtaaaatcctagctttatttcttactgctggtatgactttaggtaacttgtttaatttttcttaatctcagttttctcatctgtaaaatggggacagtgataatttcttagagcgttgtacagattaaatgagattaaacgctgagcagagtttcttacactaagtgttcactacatgggaattaatcagcagtagtagtgatttgtaatcagcctaacattttctgtccctccctaactcctcccaccccacaggagatacaaagagcaaagtcctcttgaatgtggcgaggtaggaaaggctctggcatgggcatcaggaggcctgggtcctcggcttgaacttcctgtgggaccttgggcaagttgtggctcacataatccctccccactcatcagtacacagtgcacagggcagcagagctcctggctgctagtctctcttttgatacctaattcgttgtggtatcagaccaaatttgatatgatagctagacccgccggtccgtcagtatcatttggggtctggtgtaagatcagcctgtgaaactcaggcatgtaggcaacaagttatcagtaagaaggtcaatcattgggattctgtctcccacaatggtctggattttctctctgtggctggtgggctcagccccaatccttgctactcaaagtgtgattgtggtccgaggaccggcagcatgggcatcacctgggagcctgttggaaatgcagaatcccagactgcaccccgacctcctgaatcaggctgttaatatgtacattaaagttggggaaccactgcctcaaactactgcccttgggaatattctgacacgcagagggtatttatttactaaatacttacagaatttgtgtttgacattgacattttctagacaaggttccattcctctctttgggtgtagtgtactgatgtgttaggtcagggttaccataacaaaacaccacagactggtgtttatgtctgtaccaccatagacatttagaaatctatttctcacagggtgccagtgtggttgggttctggtgagggccttctccctagcctccaggctgccaccttgtcactgtgatctcacatgggaagggtggggagaaaggtctctggtgctgcttcttataaaggcactaatcccatcgtgagagcacttgccctcatgacttcctgtaaactcagctgcctcccaaaggcccatctccaaatattatcacattgagggtcagggcgtcaacatgaatctggggggaagggacacaattcagtctgtagcaactgacttccacatctgactttaaaatgcatctttaaaaaaaatgtgctggcagataaatatgtaaataaagcaaatatgaaaatgttaatcgtagaatctaggtgaaagataatgtgggcgttcactaaacaattctttcaacttttcaggatatttaaaaatgtcagagaaaaaaccccctactctctatagttatttaaaaggaatctggtgctgcttttttctccttatttccatccaggctttcttaagagtgcttgttcggtctggctggacaaacttgcctttttggcagtttctctctctctacccactcactttctccttggtcagccagtggcctgcttctgcactgtcagtgaggtcccagcctggatccaaagcttctttctggtctctagtctgccagtagcatctttctgtccagttcctctccatccccctgccctctcctaatactaatcaggggatccttcaattgcttgtgacatcgcagcttctcaagttacattttacaactctgctttattatttttaagcatttctaacatgacattttataagtttgactctgaaatttatcatcacatgtaagtaggaaagaagtgtctccacaagtttgccctcagccagagatagtgtggttcatctggaatgcccctgcctttctctggttattaataggggctcctattgcttttccatttacagtgttaattatctgcatttcaaagtagttcataatgagagggaatatattaacttgttatttggggaggaagtacaaaaactgctattatcaagatcatttaacttgagcataatcagaaagtattaaggttattcccttgtgggattgaccatcagatatctgtgtgtttcataacacccttattgcagataccttttaaagaagggaggcttgcaggaagtgttgggaaacttactataagcttctttccttgactggcacttgtatactctggcgcagggaagacaagcccaaactaaatacataggcattacttaagagctttgtgacattggacaaatagtttccttgcctttaaactggggataatagagactatacacctttgaactgctatgaaaaataaatgaaaatatttctgtaaaatacttactgtgggaatgtggctcctagttgatgttcagtactaatcattcattcagcaaacagcctaccgcccactgtgtgtcatggcctgtgatttgtcttttttctttttgggggcttctgggtcatacttcgtatgaaatctttcttagcacaccgaaagaccaactttccttataaatcattggcttcaaaaatcctgtggactcaggtataaattatttttctggtgaggagaggaggaaatccctttcttccccatttacatcctgcctagctattttaatttgctgtacaccgtaaattgtaatcttagaatcaaactccaatttaggtgataaggatcacaattaattaggctagcctgtcaaagattaaatgtaatcttgcatttcagttacctcctaactctgaggctttagctaagcccgtcagaaacaaagctgttaggtctgcttaggtttaataagatctttgcctgctgtttgttttctataccagtctgttgtctagaaataaaacgaatggacagaggatctcaattccctttcatttgtttttagctgtgcagcaggagagataaatgagagaagataaacttaacgatattaaagactaattaggatatctgaggagatttgcaaacttctagtttaaatctgtcggcaactcttttaattccctcctgctagttatctctgaaaataatgtagttatggctgaagatttatttccacatctactctttgtactctcattttcagttgcgcatactttttttctccttcttcctccaaaaaaaaaagctcttgtttcggccacactcaatataatttagcacacagtcattccaacttcattttgtcttcacattcagaaaactgaagtctaatatctcaaatatattagtattgtggtccttttggggaaagtatgataaattgaaaatattttggttttgacttctgaagattttgagtattgtttatatatacaaaggcaaaatgcaaatatatacaaggcaaaatgcaaatgtgcttccagcttgcttccttagaaaagtattgagaacagtctaagtatgataatttctggtcttaaaacctgcaattgcaatcgggtatttccataatctaaacaataataaagattacatgactaattctaacaataataactacctattagtttgtgctttctacatactgggcacgatgcctgtcatgtttatatatatatattatttaatccttattactgcacataattactcccattttacagatgaataaatgggattcaagttaactaacttgcccaagactactgaattcagtaagtggcaaagcaaggattaaaacctaagcctctttggctttaaagctctgcttctaatcacttttttactactgattaaacagatgtgtcccaaaattaaggaagtcatcgttgttttttttgctttgtttttgcttagtcaaagagcacaggccatcatttgttgtagtgtcacccgtaaagcttaataagtttaaagttcagggtgttaatcattacaagcataaagtatgaatatgctttaaaggtttatttaagaaaagaattgggattagatttgcccaccagaatatacatttttcacttgaagtcctgagagagattcagacagaaacagctttgactcagcagcagttagcagacaaacatcttgatataatactgatccacactttgcatatacactttcttttctttgtattacatttttagaggtaagtggcagtttttcacacacttccaaactgcttccatcagtaatgaaatatttggcttgggcagcctctggagtcccagtgtttcagcttaaactttccagtgggccctgccaggcactaacttcaaaatatctttttttatggtgaatgcctccagaaggtgcaactgtgtggtggtttcattttgcacttcataacggtgttggcatcacttaatgcaaagaatgccactgtctcccacacaccgctggtgcccaaggactgtcgaggcctgtccatgttagtggtttgggaagggctgaagtttggagagaaggctctttttctattccatgtgattggctgtcaccagggcaaagggggaaaactagaacgagtggaaaatgcagcatcggatgtgtcatcaaatattcttcctacaacctgggacacctagttcattggtgttctggtcaacattgaaggctgaatcctcctttcttttgaaataatgcgtgtcttggattcactacttttaaacctttctgctgatctttatccttttcttcctaagcaatactgatttctttcaatgaaaaatgatttagctagtgaaaaactgggattgggttgtagtaaaggaatcaacaaatttgcccagattcttaagagtggagttggttctccacacttatacactgtgctacagcaagcttcacaaccaaaacccattacttattcaggtataaaaatcaaaagctgaactgtaatgagaatttaaatgtaaactgttggaggatggtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctatttaaaaaaaaaaaaatccctgtaaaatttaccattttaaactccagttgcaaaatcctgatcagctatgatgattcatacatttgagcgataaagcttttttcaatattacaaattcagtggggagtcactcaatacattacaaaaagagtacttacacttcctagtacccatgtgtatttttttttctttttaaagcaatctggtgtgccttttgagaaaagttccagtgttctcacagatcctgacttggtgtagcacagtgcttttcagaaacttggtccaacacctgaatgagtaatgtgtaaaacatataatgttttgtagctcaggatactgcaggtaaactaacactttttgccgaaaaaacattgaaaagacaaaggaaagcaaggaagttttgcttttttaaaaaattttttcaagcttaatgaagaaagagctggaaatccttttgtatggagcatttgccagcccagcaatataacaacttttgggtgcatatttcaatcacaattagatgaaatctttaattatcatttaatttgactttcatatttgcctgcagaaatgattgtgttgataagactctggaatgagacaaacctttattaagtaattccattttcagagccaacattaaagttttttttaattaaaaaaatgcctgtgtaatttatgagaaaaggggaagaggaattggcatgttggttgcatgagagttgcatggatatgtatttactatttaatctttagctttttgagatttggggtgtgctaagtcttgttagtttgaggggcctaaggagtgacacaataatggatcttaataaataacacttttctacatcatttctctacctttatatttcccttctattatatatgctgacaggatgatatttcattgtattcagtgtagaaggtgtttgtgagagaggatacttttgtgagttgatattaaggcaaagggaagtggtttataatttatcagaggaaatgaaatggtgtgctctttcattttataatatttcttttaaaattttataatgcttttaattggactgtgaaacctttaagacatttgtatttgaagtgcttttcagatatatttacattttaacatacagggatttgagagatgtcattgctggattttttcataggatcacccacatgaattttcttatcaaaagagtatgtcctaaagcttatttctaaccccaaacaggttactagcccattcctggatgttccgattctgaagatttagggtggtacctgggaatcagtatttctagcacgtcctccaggtggtgcttagctctggcaagtgtgggagagaccagagagaggtgaagttcccacccagccctctgcacagtgactggaaagttaatggccagtcgtttgtgcttctatgaaacctaagatgtgttacagtgatgttgcagtaggacaaagtcactcaggaaatcgagtggtaaacattgcagggctttgagttcaaatattgattagctctatgttaagatgccttgtcttcagggatagctttagagtgggatctctaacacaaagctgactcgggaatctttcatctgccattgacaaaatttgcccttgtgcaggcaagtaagactatactctctaattttatgggcactagccacctatggttgtttccatttaaatcagttaaaataaaaaattcagttcttcactgggaatggctgcattttactcaataaccgctgtggctagtcattgctttatcagagagcacagctgtagaacatttccatcatcacagaaagctctaatagtgctactgtaggattttccctcataatatagctcttctctttttatcctgggtagttgcaatggctaatagaattaggtggaaagatcatgcatccatctatgtactgcacattgcatactgaaatctgaaagaatgtttttgcaaaatgacttaatcatacttctctgagatcaaaatttaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggggggggaggatcacatgaactcaggaagttgaggctgcagcgagccatgatcacgccactacactccagcctgggtgacagagcgagaccctgtctcaaaaaaaaaaaaaaaaaagaaaaaggaaatttgtttaccatagtatatggcttctaataaagagctatactggtaaaatctcacagaaacaaaattgcaaatatttagtctttctcagattatataaattattcctagaaaagactgcaagcaatgaggctaataaacaggttgtacttatattttcataatgactttaatttacctttattttgcagtttcacaaatttaagatgaatatatttagctccctcttctggcataatttgagaatttttttgcttacaatggtcttatttattttttttggactgagaataaggttatcaatgtaatgttgaagaatgttatttatgagtgtcatccagttagattttttggtatcattgtaaatggttaaaacgcatgcaaaaagtttacgaaaacaccacattttaaaaactactaattgaccaaaaaatacataaacaaaggctttgacaaagttatacagaaatttattttgatatcaagtgggcagtgatcattcatattggcttctggatctgagactcagcccatacctggcatttgtgaggcttggggcaagaatgcaaaaagaggcccaagtaccctgtgcctaagtatttttgttataaatcatgtcaactgttcaataaaatctgtcccatcctttctaggcagttatttcttcctaatgaccaggaggagagatctgaattcaggttcttgggctcctgagagttctgccctagagtgtggtattatggggagagctggatcctggttcatccctggcttctccctgcacatccaaactcccatccatcctgccactccccccacctttggggcccaggggtgtacctagacaggggggtttgtcctggggagggtggacctgggggaaaggccataagaggccatttagcaggaaatcctggagcattactctgagtagaccctaggtgagaagcagtgggcatatcactttggcctggaaagtgcaaaagcccagagcaggggttcttcttgctcgggcctgatgtaattaaattattttgtacgtccttcattgtggtctaatgcattcaactatccaaattaaatacaatggtgggattttgttgtttgcagctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcagtctataatttctaactctagattatcatgtagtttccatatggaaactattaaattcttcataatttaataaatatgattaactttcttcttagaggccagatggttttgccaaaattatcaacatgccaggtaagattaatagtaggagttgacttccaagaatatttggtacacatctagaacagatactggatggaaactggaatgtctctggcagcagcctcacaggttctccagagagctgtgttttgcatacatggtctgtggtctgttttgtgtcctaggtctggaatgttcaactctatacagaacacagagctccagcaacctggcagaattacgacagcttcttgattgtggtgagtgtcacagagctagaaatgcaaatgggaaagacaggtcttggctttctgtttcaggtaatgcacacacacaaaattgaatttaatctatgcagtgttctaaatttaaagggaactcaaatcatgtacagttctccctgccctgttatggtaacagtgcaaacctttgaaatttttctcctgagttgggctgcaagtgtgtgcacgcctccctgcaggcatgttggtcatcatcatagccatcaggccctgggtcctgcagaggagagaaaccacctcttggtgtttctctcgctctgtgtatctaccatctttccttgaccctgaatttggctacatctaattcatctgaatcaattaaaaaatatttttaagcctatgtcacttaagaaatgtctcttctgacatcctttttcttttattacctttcccttccattttccttttccgtttccctttctttctggcttgccttctttctttttttgtgttgagtgcattaagtaacatcacgatattgttatgttcagtggtgtgctgataaaccaactctctaggaagaaaaaggccctggtttgtagcatctgcccatttttgtggcatgaatattcccaccggggcttatttcaagctaaccaacatgatgtcactggatgtggaattgggaagaattgaggacagtttgttaaataacactaattaatttagccaagagggctttagtaccccaaacacccactccctcctttggcatagatgaaaaactacaaatcaatttacttgccagcattccagcaagtcatcttcttataaatctttcaagatccttcattccctcataacgcttaaaaaaattatatactgcctcacatcattttaactgaaattaggtgtttaagccaaaaagagtgaaactcagttttggactccgtcagaggtataattgtacaaagaatgcccacatgacagtaaatgagaatttgaagcatgaggcagtttcaaaatgaggcaacttctgagacttttagaaaagaggtttttttggagaaaaggaggagactagacctttatcagtatcagtaaattcttacacttgaaatgttctgaccagatgtttcaaaagttaaaaaaatgtttaactccatttttcctttgtacatggaaatcagttgcatgcgaacagagcatatcctctttgctgctctgcctcctgcacttcccacagagcaggtcattagaagttaacatgcagaacactcaaggtgaaaaggcttgtttttcggtgtttctgacagctttatcagggctttaaggaaacgctgaattttgtccttagccaattgaaatgaagacacatgtttgggtcagaaaattggtcaaattatgaacacgtttagtcacaggaagagtttagacatcagagcccgatgaagtggaagttatttgagaaatagtggttaggtttataatgtgatcaacacaaaatgatgcagtttagttatttaaaaaaaaaaaaaaactcttcacaccactcgtgagatagagtcaacaaccaagattcacgtcaatggtacattttgaccaacaggtttccttccccagtgagatcaaaacacatagaaaactggtttcatttggagtctgtgctaaaaaaaagtgaaatttgtgccccaccccaaaaaatataaataaataaatgatgtccaaacttgggagtggatctgccagatctgtttccaactcaaagatttttcaatacataaaaacattgtataatatcctggaggaagctccaaaatagtcacttacacctaaaaaaaaaaattatggcttttaactaaccttgtgaattaccagtctttgaaaaggacagacatggcagacaatagcccacttttattagcacctgttatgctagttcatccatacattaactttgtgatgtatgtcctagtaactttaactcaccagaaaagaaagctgaccctcaggtaaataatttctttcacatttttcagtgccttagtggctaatttttctgactccaaaagtccttgatttttttctcttttttaattttgccctaaaatgaattgtttctttgtctcatgcaagttttaatgattcagattttcacctgacagtttttggtttcatttaacctaattcaggctttcttagccttggtactattgacattttaggctggataattctttgctggaagagtgggagcttgtcccgtgcattgtgggaagcttagccacatccctaacctctacccatgaggtgccagcagcattctcccccagttgtgacaatcagaaatgtctccagacattgccagatggctcatggcagagggcaggatcccactcccactgggaaccactaacctagggagagacctaaggaagaggagactccattccagggggagggagggaggagtgaagggttggagagtttactgggtacctgtcatgagtagactcagtgaaaagtgaggtaggagagaatgcaaacacctccaacccagacctaaagattatgtagctcttcaaaagtcatcgcatgacaggtaggaatagctaatggaagagcacgttaggccagtttcaatgcagaaaaggattcttagagagcagaagtcagataaatagaacagactttgtcactagctctagtagaatttgacataaggtaaggttacccaaagacctgcataggataattttattcatatactatgaaagttcttttgatatacctcatgtgttggaaaagggctttgatgaattaacttcacttgtggattgagccttctagttcaatccacaaacatttaacacgttgtatgtgctggacactgagggatgccagaagagcaggtgacagccacagtccctgcccttgacgtacctcggtctagtagggaaacacataatcccacactatgattatactccttgggaagtgtcttgttagaggggtggctcattagcactgcagaagcacagagggaaaccctgcctgagggagggatgtgtgcatatttattatcttaacgtttatactgcatcaccaaatgttttatcacatattttaggataagcaaattcggtaatattaattttccgggcagagagacattagatgaaacatgcggggcaaagtgtatgggaaaccagaagcacggccaagagtggtgaccatagagaattcctatagcagcacacacacaattttatttgacagtatttaattatgctcacaattgcattaccttcaacgtagatcctttatgcagaggatctactacagtggtattgcccctcccacacttgttaaacatgtgatatgtctctggttggttgtttgtaggacatttaagtgatttaacacttcgcctcttcaccttttaaatttaataattcttttcctcaagttgacctatccatatcctattccagacctacttttcttagagctgtgtggttgtgtgactcactttcggaacgtcggcctacctagtggggcaagtttggtttatgatgatatgtccaaggaatttttgtagtcttaggctcaacctagaatgatttgtactgtcatattccattcaaggttatctaggatactaccttctcccactcatttatactcaaacactttgcagtaaactttcatacttcctcattctctcctaggccacagcccaatgcagtcaatcaccgagttatatgaggtctcgataatattttgtacatttctaactgcattagaattcagacccccatcaccttgattcagagaactaaatctggtagttttacttctagcagcactcccttccaatttattcttaacactgtcattagtaaagctgttacaaacgtagtatcttgcccatcagcccacctttgctccactgagtacacaagtccccagattactttcctcaagttatccttcgcattgctagtgtacatccttcagcagcagccaaagtcctctccttttctagaggcccatggtcacccctgcccccagatctttgtttctagcatccctttcttctgctgggcattgtgtctttttccaacccaagtacttagagtgccatgcgtagtgagtgcctggagggtggtattgattagttttacccccattattggattgcttgacctgtttcccagctgagggatttactggacaggtatgctcatcttattttctgagattgtctgatatccacaggttagattagtaatactcagacagaattagggagaaacattctaaaaatgttcaaattattttcatggatattcttgagattggttgctaaaagtctgtagtatcttactgttgaatccatcactctgttggtgacatttacatgaattctgagacatatcaactcaagtcttaggaaatctgggaatatgcatttttaaatttttcctgttgaggttttaggaaacatttactatatgactaaccattcctagttagaacccttttcagtcagggcagaaccaccctcagaggatgttaggaaatgtttgggttctgtattcgtttgctcaggcagttataacaagttaccacagactgcgtggcttaaaacgcagaaacttggccaggcacagtggctcacacctgtaatcccagcactttgggaggctgaggcgggtggatcacgaggtcaggagtttgagaccagcctgaccaacatgatgaaaccctgtctctactaaaaatacaaaaattagccaggcgtggtggtacacacctgtaatcccacctactcaggaggctgaggcaggagaatcgcttgaacccgggaggtgaaggttgcagtgagccgagatcacaccagagatgcactccagccttggctacagagtgagactccatctcaaaaagcagaaacttacttctcgtggttctggaggctagaagtccgagaaaaaagcatgtttggtttcccctgaggcttctgtccttggcttgtagatggtcacctgctcactgcatcctcacagcgtttctcctctgtgcctgtgcatccctagtgtgtctctctctgtgtcctcatttcccctcctagaaggatatcagttacattggattagagtccactctaatggcctcattttaacttacatgcagtcactttctgaggcattaggagtttgggcttagaggggtgggacagaggatggggtaggtaaccactgaagatgcagcccaattcagcccataacaaaggcattattttttgttgccccaaagtgtggaggtctgctactggcatcatgggcagggggtcaggcatcctaagtgcttgcaatatgtcagagagacctccacaggaaaaattgttctaccccaaatgcccggagcaacccctacaagaagtacggctaacgaatactttgtgtcttgtatttatcctcatattgcttccttatttttttttttttttgtcacatgtgagtcaaattgttcagaaaattagcccaactgatgtattctataaaataaatgtctgaaatatttcttaaattgtttcctagatacaccctccgtggacttggaaatgatcgatgtgcacgttttggctgacgctttcaaacgctatctcctggacttaccaaatcctgtcattccagcagccgtttacagtgaaatgatttctttagctccaggtttgttttttctcttctgggaacctcattgaacatacatggagatgtagaggtgcttgtatatgtcttgcatatatagaaatagtggttagaaaatagtagtaataacctgtccctcccccaacaataccacctcaaatttcctcctccacccaagcatccaagagaagacccagattctcatttgcttgggaagcccgtctgcatgtcagaatcagaaatggctcattgttaacctattggtcttaacaaagtttgtacgtcaatgaaggacacggtcttccaagtactagtgtcagattcaaggaactgggactagaatccagtgatgggggatgttcttgtcatctttcctgagtggccataacagaatgtgttgagggaagatggctctcagttttaggagataaggttcagttaagtgctttggggacaggaaactggttcgtaaccttcaaagttaaaacctgtgatacttatctgatgctcctctgagttagccaatcacacttgaagctgctcaatactgggtaagttgctgccagcacaccctgaacagcttgtggtttctttacacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccaggtaagtgaaaggagacaaacatgtattttggggtgatgagggtagtcctaaatggattggtcatgaaaatgtattctgaatatactactccagagatgcatgtgcagatgctatcacacacattcacttgagtgtatataaatgaaaatgagtttgcttttagggaaaaggtttctaataaactctctttcttacagctctgataatactgaaaacctcataaaagttatagaaattttaatctcaactgaatggaatgaacgacagcctgcaccaggtaatgctttttgagcatttaacattctctcattgttcattttttagagccttaaaaaatgatggctataaacctcctttgaagtaacacagcttcttatggaattacagttggtagtaatatgttaccttgtgatttaaagaaaaaatagctgagtggtagtgtatatgttaattattatccgagtttcaacatttgtggattttaaattatcttggttttaggtgagagtttggagagttccctgtacccttcaacatttatgcttcaggttgttgaagagatttatggagttcattttagttgttgacatttttgtttttctttctaatacttacaaagtaggggatttataattactatataatttaaagtattttagaatgtgttttttggaagtgggtatgctgagaaatgcctgtcaaaataaacattttcaataatgcaagcagtatgaaaccagtgttccctgcagcaagttcgagcaagccagacacttctttgaaagcaggctgctgttcagttagccatttaacaaagcaggaaatgtagaccatgttagcaatgcatttaatttaaactgatgtatttttcttctaccgtggaaagtctaaacaacctcattttgctatataccagttaaaagttagctaatcgacactggtcatttagaatagtaattagggtactatacgtgtgaagtttcaggaccagtaaaaggtgttgcttgtagtcttaatttatgcctggaacttaaaatgaaactccatgaatatatttattataggtaatatatgcagattaccatatttatctctgtatgagcaggcatggggactcagtttcatcttcatgcaatggagagttaagttgtgctttttcttaattgggtattgcacagccaggcttggttacttgcatctggatggggcagcctaagagaggccagggcctagactcaaaacccacctgcagcaggtaggatagaggatagggtaggtaaacactgaagatgcgggtattgggaaaggtttatgtggacaggcccaaaatgtaccaaaggtgagagagaggtatccggtatagtagataaggcaagcatgggatgttccaaatcacagcaagcagaatgttttaacaggggtgcccagaattctaggtaaactacgtcaaagaagactgtcaacaggtagggactaggacttcagtccaggggttggccaaaaggcttcatctcgtgtgagtacacaggtcactgtgaatggatttgggagctctgtgctggtgttcagaggctgcctttggacttagtggaaaagaattggggtaggggtgtggcacatggcacttaagttgaggtttatgttagagactaggtagagctggaccctgctctcagtgaagggctagtgggtagtcctgatcttttcagtggccactcctctagagagaggagacacatggaagccaaagccagacagggtttgacagatacccacaaatgaatttatcacatggaattttggagaatttctactacacaaggtatagcagaatcagtggtagagtttgattagcctgactggtgtaaactagttaaacgcctttgttagtttcatcctaattccaccaaagtaaaaacgggtatctgcactattttcataatgccacccggaaagctgtttgatatgtcaaaggaccctacatttctctgctgagcaattggtgcgcctgtttcaaaggaggattagttccatcagctctgctaaaggatgacaaagccttgaacatttgctagatcatcccagtatttatgtggcctcttaaaaaaaattaaatccaagtcggttttaaactctagtttgagccgttttcccaggaagtttgtgtgatttgtataggacctttggaattaaatggctgttttagtgtctctcatgtgtgcatacattgtactgcccactccaggaacaaaacgtccccatccagaacatcttcgtattcaggaatggctccagtgcaaatgactgctatggcagcctgggttgaagaaatgattcttaggcctggtttaaaaaatgcaataatttcttagagtccttcagcattgccacagcatgtgctagtaccagacagaactttgaaagcacagcaccttacatctccagcgaatggccatttacagtaacattgttgtgaacacaaatgagtacctgaatgatgtttaagggagacaaaagcaagactctgttatagggcagatagacagcatttctaattattaccagatagaacttgaaatgacaaagcttatgatgtttgaggcaaagtatcagttcaaataagagccattagcacatagtatctaattaaatgctaggtgggagtacacatactctaagtacaaaaagaactttagaaatgcagctggtgactttctagggtaatggagtagacagaaaaggctcatagaagaaatagggcttgaaatgtgccttgaagaataggtacaatttgaataggcaaaggagaaatagcattttgatgcatggagtttaaagacttattcaaaataaattacacagtacaaaataatggcttggtattttacaaaagcagtacatattttaagtgatagtatcacaaaaaacatcattttagagttgaaagcattgtccagctttaccaatttggacatgaggaaaccgaggcccacagatagaggttcgctctgtgctacccggccagtatgggcccaaaccgggtctgcccaggagccgcctcctacactccagcccattctatctgccatgccctgctgcctggatttttggaaacttcgtgagcaatgaggctgcttttagtgtccaatcaaaaactcctctgaagtttccagcatgtaataaactaaaaatatgtgaaattagcccccatgggtcacatatagtaaacaaagtcagggcaatgtttatacttttcaggataaggctccaaatcactccatgagctgtgcagtggaaaaaaaagtgggcttctgactcaaatagatctggattggaatctcaactctctcgagtaactcagcttttccaaattgttttccagactgtggaattgggttaatgcctctctcctggggttggtatgagatttaatgaactgataatttctctgctatctatcgcatcaactctagcttttgaggccttatgggagctgtcctcattcagcaggtctgattccttcagtccacccattcctcattagttgtgtgaatcctgtcaggcctttttccttactgacgccatgttcccagccagcagagctacggcctctaggagcctgtaggggctaaaagggacacttgggaagttgccaccctgatgtgggtacattgcttggagggagaaaggtgcctttgtatgaatatgtggcttggtgaatggagcagcctagatttcatcaccactcctccatcttgcctaggtgcctttgcacagtgcacaaaatatgcaaccatacgtcgctgccccaagcagtgccatccactttatctgcactcaagtaggtccttcccgttttatatgcaagttaagtcgacccattcagtatgtttatgcctttaagcttcctgtcaccttatgtttaactgtctatagtttttcctattcatctgcttaattacatttctaaagggtaggggtaaaggctttttctccttttgagctcttcctagcagagaactaggtacagcataataattatctaaatttttctttgataaacttccaactttcaaagaatagtaatacatcaacacatctaatacatccagcaatcctgggaaataaggattctcctcatttacagagggaagctaagatttggaaaaggtagggcacagagtaagctctctagactttgttgatagtttgctgttctattttgttactaaaaagtcttaacttgtcgtttggctttcaatatttttttcttgaatcattgtgttatctttacccaattaatgcttaggcaggtaaagtagatttctgtaggcaaaccaaggtaaaaataagtctatttaacacagggtgcctttgaatgaaacccattataagtgtatttacatatttcagatttcatggatatattcagaaatattaatgtaatataattgaagtctaatattgcaccctcaagcccagagtggaaaataaatgactctttctaccccttgcccttctacacctgtcaaagttaatttttaaccactggcacattgcaaaacattcatcctgaagagcctgattcataaatcttgttttaaatgctctgggcttggttctcaacccagactaaaggcaagcactaaggtagagggaaatgacattcaaagagttttacttgtctctgatttaatttttattggtttaaaatgtggtctgacattagagggttgcttcaaaggtgaaaaatgaaactttgaaaaattacatgtttgtagatgcgtagaactaaacgggcaagccacactaggttttgtcaaacaatagttttatttgtgtcctgagagacacaggtattttggtatgtatgtgtttaggaggggtatatagtcagttttacttttgttttcacagtgcagatgtctctttgtctcaagggacaaagatctgagggagaattgcaggggggactactttattctgctaagcagtggggatgcctttatcagaaacctggtagaatgtgtcagagtttatacatacgtaaacctgggcttatttatatacttaaatggatgttttccttagcataatgtcagttaagaccagtggatatggagcaaataatttgaattaccctaaaaggccctctgttctaagttgtcttaagttaaaattatgaagagaggtattcattttacccttagatgaagattttggttaatttttgttgtctattctttttttcatggtctttgttcataaatgatgtccagaaaaagaagaagttttctaggttgaaagctgcttgtgcaacatttgccacttgatggtgacttgtacatatgaaatatagtattcagtttgtaacttttgaacagtttaaggatcaagagacattttcctaactatatctgctgagaagtgaaacaatgggctgtatttgcctctgaaatgagttttacgaaactttgaggaaagggagaatgatacatattgttttaaagaatccagaaggtaaagttagttttccagtgtgtctaggcctttgaggtcccagagaaatgctgacattaaaataaaagttttcctacaacactagcagcttcgtgaaaactgtacttttgatttactaattagtgagtcatatagatcaagtgacagtaatacaattatgtacattagttggtgtcaaatttggacatacgaaatatacagaaagttgatggttttctcccaaagcaggaattactgattcagttctaccagcagagggctcccttttttaagctaataaagaacatgtgtcttgcagatcactttttaaacactaaaattcaacgggaaaaagattcagctcacactttcctaatataataggacctctttggtagatgattgtacatattgtgagaaatttgtttaaggcaaagtttttccaatctatttcaagactttctatacgttgagagagtactgctttccagtggcttattttcttctgaaacagaaaatatactggtggacttaacagagcattttaatcttagaaggttttgacatgaaacatcatgtgaatccagacaggtatgcttaggagactgatgtttccaatgtttctagctttagaaaggctatttttaaaagtagggcaagattatgcagctcaggatgcaagggtattctctgaactaaccatatgtccctatgatcagatggcagattcacttatagactgttatttccattgggaaagtttttcaatattatatcagttgcactaaaggaaagtttgtaaaatcactttcattgtgggtttaacagcactttccagatatttcaagtaaccctgaagctagttgctgctgttggcctgtgtggactttatgtgaccactggatcactttcccatgcagagtatgagggtattattgaaagaacctatgtcttcaaagggaatgaaatgttttgttttaatttaagcaagctaaaaatagaaaacagaaaaaaccagagttttgttaggggtgtgaaattttttgcatgtggcttaaaagattaacttcagttttgtccatttttttttacgttctctagcaaagggaagtgaggagcagggacaatgggtagagaagggcatttgaaaccatcagaagattgggttctagtcttagggctataatcttctgtaaaccacttcacctccctgggtcagatttcgttttcccctctatggcatgcaggaattgattgaagtgaactctaaattactttctggtgtaaagtttggtgatttccctggataaccttaaagctatctatgctcatgcaactgaaaattttcttagatcaaattttaattaaatagtagtcagtaatcccaagtctggtccattgccactttctcaaataaagggcaaacatccgcttagaaaggtatgcccttctctgcccttctatcctttaccccattagctggcacataaacctaatgcagagacaccttttaattagcaggtcatatggccatttaaatgcgagttgcaatcgacctcataaaaatagccgcagtgttgttttattctgaatcgtcacatgatcatggagtatagtatgcatatggtgtggggtttaatattcgtccgaggatgccctcctactacttactattgaacatttttgtaatctcctccctgcccgagttgctcacaagggctttcctgttacacctgcagggctgtctgtgctggtgtgtgggaggaggtgcaagaggtggacacgagcgaggcgctgtgttctgggttgttccaagaggttcaggcctttacaagtgaggctttgattctattttttgctgaactagctcagccacttcctgtgtttggctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaagtaagttgccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactg

SEQ ID NO: 37658 - DNA, 75186 bp, Homo sapiens; identical to SEQ ID NO: 37657

SEQ ID NO: 37659 - DNA, 125522 bp, Homo sapiens
ggatgctgcgctccacgtccacggtcaccctgctctcgggcggcgccgccaggacgcccggggcgcccagcaggagggtgagtagcgggggcgggagccgccgccgtcccgttcccccatcccggccgccccctctagaggggactagggatgggaaagctcgggagccagcacctggccccgacgccccaccctgggctcaactccccggtcctgtgccggctctggcagtgaccctcccgcttgaggtttcagggggcccaccagctggtaggagagggcttaggggactttatggaattcccagagatttcctctccttcctgcctttctgtcaagccgagtttattggcggcaccagtttaaaaatgaaggaagacatttgtgcagtgtccctaccttgagactcaaaagtaatgaatgtatttaaaactcaaactttccttcttccattaattaaaagaaagatggggtcacttgtgtccactagtgatagggtatccactagtgatagggtaattctggagtggggttagccaaggtgggcaaaccagaacagcagccggccgcccaggagcccgactgtgtgggactccggtttatgtaaaccactttcttctgtctgatttaaatattagcacagtgacaacaatggcagcactgaaagcttgggacagcatctccagggaaggtttccctttggaagtgctgtttctttttgatctttgtggcatcttttcccatctctccagatgctctgtaaaagaaatgctccatctttctaacacggtcagcaccttagagccacagccaggggcttggcttgtggctttttagttcttccatttatcatgatgttcaatacttatcatttggtacctctttgctctgattgagacttctgtaatcgtgtttcctcaagatttaaacaggtggttaagtccaaagcaaaacccccactggttctgtctgcgtgcaggcttggacctgcttatttgcttttacatgccttaagcgagtgatggtggtcaccttataagctgtctttcttagctctagaagaaaggtgtgttactcttgggcatgggccaactgatggattctggggtgtgtgtgtgcgtgcactcaccagacacttaggttgtgtacacaggcgcacacacacacacacacacacacacaccccagaatccatcagttggctcatgcccaaggttgacagaactccagttgtccaatcattagcatcatagagtaagatctacattgggtccaagggggtttccaaccacagtcctggccttactctaagttgggtgtttgtatttttctatggaaatctttctcaatttgaacacaattgcaactgagaaagaatgaagtcactgaaaagctaaccctgagccctgagaggatcatatgtgtgaccagactgcatgaattgcatgaaattctctgtaacttcccttccagaggtggggattagttggggtacctaacctaatacggtgggttgatacaaatgtgactagtatacaaataacatttctgaagattttgggtcaaacgtttcctttggaatatttatttaattataggtgctttgctgtcggacacattgtgacactcttgaaaagactttgccttttgaataagatggcagacgtattttggactggagaactcagggctcgggatcaggccattcagggctgtcctgggtacactggtacttgtttctggaaggaaggtatctaaagggtctagggttctgcccatctttatggtttctagctctgctcatgatttgcagatgttacaagtactatctgtgtgtgtgctggggattgtgtgtgtggtgggaagctgtgagatgttgattaattgatttattgaacattcataaacctttctctgtgtggtaaagggctggcattggggtccgccctacctgtagaggcagacattttcccaaactaacatcaaacaaagtggtgatggttatagtggggtgaagagtttacaaagttctgtagaagctaaaataaaggttcttcctgaggcatcaggggaaggcctctcactaaaggtatgtttttttgagatggagtctcactttgtcatccaggctggagtgccatggcacgatctcggctcactgcagcctccacctcccaggttcaagcagtcctcctgcctcagccttccgagtagctgggactacaggcgcacaccaccatgcttggctaatttttgtatttttagtggagacagggttttgtcatcttggccagcctggtcttgaactcctgacctcaagtgatacaactgcctcggcctcccaaagtgctgggattataggcatgagccacccagccccgcctactggtgatgtttgagtttaatcttgcaggatgagtagaatttgtaggggaattgacattattgggatactgaaaggaggaaataaccatctcaatggaatacttggcatatataatcatgtactgcataaccacattttggtcaacagtagccaggatatatgacggtggttggaatggtaggctatctcatatcgcctaggtgtgtggtaggctataccatctaggtttgtgtaagtgcactctatgatgattacgcaacgacaaaaatcatcaaatgatgcatttctcagagtgcatctccacggttaagtgacacatgactactttatcatgatggcaaattggacctgctttgggacaaaatacctattgtttagaaaagcaggaacgggatgtcctgaaagtaaaattgtagaccaaataatcattggaagtgtacctttcattgaaagttgttcagcaaatactgtattgttctgttattcctctctgatgatggacaagtgatggtcttgaacatgttatccattaaaattgtatttctggttcatccaaagagctcatcaaattgggtactgcaggggaaaccagcctatgtgggtccagatattcaagccaaccagaagtggtggtgacagctgacactgagcagggactcctgcgagccagctgccaagggttatgtggctggctggactgccaccagttagcctttgttcaatggctgccacctgcaatttgtatttccttcttatctgaaatcacctctcaaggaaaaaaaaaccaacaggtggagagagtaatttctgtcagctgataaacaaagctctgaaaggcatttatggatgccaaccagcagaagttgtgaaattaaaaaaacttccttcaaaccagttgtgcactaaaaatagttttatctatggcaacagcaggaagacaaattgactggagaataaccacagccagaagatgaccttggggaatggggggaaacgattttaaaaatattgaccttgcttcatgcttttgaaaggaattttataaatgccagttagtcttgctaaatgggcctttgaaatggaaggttggttgtgtggctgggtcgtgtgctttgcggggaaggcatgtgttgctttatggcttccccacaaagcacacaaccgggtcacacaactgacctttcggcacaatacttactgccgagtatttttggctaagctgttctgatcctgggctgtggaatgatagatctgtcaaggatcttctccagcaccttgctctcttgataataaaagactgttggctggtgttgctgctatcgtgacccgtcactggcacagagaaaaaacaaaacccaacaaggtcacaggataggactatctcctagcctgcccttgctgatatttctttctatttggcaaaggcttcctctgttaaacactggaatgggcctgctagtcattgttccttggctaatgtgtccctctcccatgtcccattgctgcctgactgggctaagttgtgagggtttggaaccaaggcgtcctctgggctaagggcagggcttaaacctgtgccggtcaaaaatgatggttgtaggctcagaaaaagaggtgcccagctctatgcttttgatctttcacattgccttgtttgatagaggatgaacagacctgaattctggagactcgtaaggaaacttgatttcccctagacatttatggagatcccatggcttttctacaaaggatatggaatgtgattttgacccatttgtctctgggggcactgatggagtgctgcgtatgaggtccctgttgtagtttacctatgctgtgcatccatatctgaacaagagacctggaggctggtgtcactaagccctggtcactggggaaggctttgaagtcaattagcctcaaatgttcttgtctaattgagttcaaggagctgtgggcccagggctgactaactagagaccatgttaaatatttcaacccaagatacttctcagcactcatcatgccttatggtcttacggaattccagtacttctccagcacacagaagagcaatacagtggtgtttacctctttccctctttggtgagtgatagttcctaagtgtcaaccacactcctggctctttttcactcttaaaggccggggtgatctttctaaaatgctaaatctagtctcctgactcgtctgcttcaagagcctcctcagtactgccaggaaaaagttcacactccttagtgtagcatccaggccctctggtttggcccgtgcctgtgctgtttcccctccctatatgtggtcttctcagatattccaaatcgtttgccatttccccgagctttcgatgccgttccttgcctctttgcttttcttcatgtttctcctctgatgagtgttgtctcctctaggaagcctgccctgaaacctcaaccctccttctcgtgttcccctagaggcctgtgcatgccaccattacttgcgtcacctgtgattacctactggaagacagggcttaggaaccacccctccccaggcctggtggaataggcagttaaaaacagaaatctcaccaggtcctacgtagaggagccacagttaacattgaattggcaaatggaaaaacaggaagagaagccttgggttaaatccatcccatcacttctgacccacctgggcaggaaacgggtgacaaatacatgggaatgctggcccaggtgaggaggttgacagttctgggaagtcctccaaatattcgagttgcctcatcctgctgcacagttggagcttcatccctttggttcagtcagtggttctcaaccagttatacacagaatcactgggaggcttaaaatagccatgtcgaggcctcatcccaaaccaattaaatgggaacatcttaaagtacagaaaagcatgagtattttttaggaagcttcccaggcgattctaatgtgcagcaaggctaacaatatttctttaagcattactcccttctatagctttcttggaaatgcagacactcctgggacagtgttgcagaaaggtcccttgagccttgtgggatgaagggcagggtggtgatggggcagggagggggagtcctcgcactccaagtcacactggcatctttgtgtgccttcatccacctgtgttttctctctggatcttggcgtttggggcacattgtgtgcctagtacagaacacagccacagaaagcaggaatgttttgtatgcctctgagctaagaatggttttcacaggggcctgcaaaacctaaatatttactgtctggctctctacagaaaaagttcgccccaccctgatgtagataattgggctgcaagttcagggccacagcagagccaagaggtctaatctagatggggcatacactgttccgcatgcagcctgctgcaggctcctgggatttgatccttgtgctgagcagagagtgtggggtctgttccccctagccacacttacaagggccccaccttttatcattaaggggagctgggcagggacccacagtcacaaagtggaacaggcctgagagaaatgtaaatgcacttggctaatttccttagggaaatccatctttgtaaactggcaaacccctgtcacctccctgaatcatcttctccactccctttttatttgagatagatatttttcccctgggtgagccaaggtgcctgaagttgagagcatgatgttactggatccgcagagtaccccgtaggtgagacccaggccctcatctccacaaaagggtcagaaacaaggcctgaggggacccatgtagctccccaggggccctgagttgccaaaaagggttttgttgtgctttttcttgtggaggaaacctgaatgctacctgtccctcccttgctatccttcccaggggggttggtttcaagaaagtgcaaggcactccagggagtttcaggtatattcttactttgttttagttcaacctagaaaaaactacaaaacccaacactgagcgagcgcccatcatgtgttgatactatgctaagcaccgtaggggctatattaagtggtgacggtacaaagcttacttgatcactccccctatgttttcccttccgtccattgtgtggtgcatggaacactggaggcactgaaaaatgaccagttggattattgaaatgaactcagatttgaatgttagtctcttcctccaaagatttgaatgactcctcattgtcttctgactagagccagtgcttctctatcatgcatttgtagattgatagttcagcccctatctgtttgtccatttgcctgtcctacccaggcttaggctgcaggttcttattcttggaacttgccgacatctgtgtgtttggcacagactagaacgccttgcctgatagctgtctgctgttgttatgatggtgggttctccaaacctcactgacctgtaaagtcctttctgtccttctatacccagcttaaattgtatcccgagggtccttcctgagggactttcccatatattcccacctcccattaagattagtgttcttcttcctatattcccatgataataaagaatgtttacagagtgcttaatgcgtgccagaaattgtcctaagctctttacacacattagctaatttaatcctcacaacattcctaagagggtatagtattgttagttctttttacaactagggtaatggaagcactgaagactaagtggctttccaaaggtctcaaagctagtaggtgtcagaaccaatactggaagccaggaagtacatttccactatgatttaaccacaaagctatcctgtctctctacaccttgtattggttattccaagtgttcttgattgccttgtttgggtatatttctagattatgtactccttggaggccagcatttttttttttttttgccatcgtcgtaccctcatagtccctaaaaatatttcacaagtaataggtgctcagtaactgagtaataaagtatgctgagtccagcttcctgctttgatctcctggaaggaacccttgcccccagggacagctggttcggtagcagtggtgttcagggtaggatgcagttcttcgcattgtgcataacacaagccctgaaccagctgctttgggaacccctgggaataaagtgccctacctgcctttcaggcactgccaagcctggggcatctctggagattgtgtatccgagtttcaggagaccatggagatcagcctcgtaaaatgctcggaggtaaggaatgctgccttgatgttactcggggagattttcccatggggagattgcggaaggtgaatgaatggagggaggtagactgtactcggacaactttatgggtggttcaggggttactgtccttagtgcttctgttagggattcagagtaccttttagacctttagaatgtcccccttgctgctcctgaagcagtcctgtggaaggattagtctctttctggatctgtctcttcccgacatattttctcccagtctttgttattactataactactattattattttaatcaaaaccttacatatcttaacatcgttgccaccaacacagaaatctgtttccttaagaatatcttccgcctacatctacacaagttatcagggtatatttaaaaaattaaaatgggattattcttaatgttttgttctgcaactttctttcttccccatggccatacatttggctatcttgtaaggaagatgtgtgattctgttctaagctgggtttaaattgctcctgaacagccagtccatcagtgggtcagtgtttattaaagaaaaactagctttgctccttaatgttttgatcaaagcacctctgttgacaagagtaaacttcagacagggtgctgcagtagcctcaagcgcctgctgcaactgccaaatgtctttgaggtcatatgttttattttacaagttcattttattttatgcattctgtttaccttgtggctttgtatacctcagggtattgctcagtgtgagagcttcatataagggttgcccagctcatcataggaagtgtgttgaggaatatagatgggcagatgaagaatgggctcaagccaggggagggaccatctaacttttgagtgattggacccatgggaccccctttctgaaaattatgaccattaaggattacccctctaaaataatcaaccaaccgaaagtcatcacttacagtgttaatgtctctgattcattgaccaaattgttattttcatggaaacaggactgtgaggctaagcaggtctgtttcattttgaagcatataggatgatgataatatctagataatagtaaaaatatctggctgggtgcagtggctcatgcctgaaatcccaacacatttggaggctgagacaggattgcttgagcccaggtgtctaagacccatgtgggcaacatagtaagactctgtgtctacaaaaaataaaaaattagccaggcatggtgatgcatgcctgtggtcccagctatttaggggcctgaggtcggagaatcacttgagcccaggagattgaggctgcagtgctatgattacaccactgcactccagcctgggcgacagagcaagacccagtctcaaaataaataaataatcaaataaaaataaaaatatctaatattcatagaggcttactatgtgacactctccctttatcccattttacccttgagattcagagagattaagtaactttcccgtagacacacagctagtagatgttggagcctgtgtatgtgtgtatgtgtgataggcatatatgtacgtgtgtgcacacttgtgtgtgtgtgtgtgtgtgtgtgtgatgtggtgcaggagaaaaggacttccttttccctgcagaattatgcatggactagacccagcctaataggagattgttgagcaccacaggtttggattgtctctgtggtctgagttacactttgatgcttgtgcaaatgtcagactggtttcaaccagtctgaggggcctggagccagagagttgcctttctctggagggactcaagattccctactcaagatcagtgttgttgcccaccaggaaagagagctacctggtagtatggcttggtttctttttggccaacatgactgacggtgagctttgaaggttgcttgtaaagttggccccacaagaggcaatgatagccctgggggtcaggccacatctgattccggggtccctgggggatgatgcttgccaagaggaggatgaggatggagagggatcttgaaaccaagtcatgtgatttaaagaactggggttgtttcgtccagaagaaaggaagttcaagggacaggaggactgcctagaaaaaggggaattagtttgcagtccgaggacaaccctgggtccattaggtagaaattctggtgtaagctcagatcagcaagttagaggtgcctggtagcaaaatgcaatgccttggagggtggcaatggtgtacgtggaagtgctaacatgggtcccaaacctgggctccctaacctgttcatggaaaatgaacaggttggtgccacctgtcaggtacatttttgggtgttgggtttcttcaaaggtgggcaggttgaactcaagagatttttgacattccctctagccctgggcttctaggctgcagggtggttttgctaagaggccaccctgtggaccagtgcagatctgtgaacctgccaaccagactgggacgggggtggagaggatttgtttgctagggctgccatgaaaactaccacaacgccattggcttaaacaacagaaatttcttgtctcacagttctggaggttagtggcccaaaattaaggtgttggcaaggttggtttcttctgaggtctgtgaaggaactctctgttccaggcccttctccttggctgttgatgggtcgtcttaatgtttatatgatgatcgccctgtatgtgtgtctctccccaaatttcccactcttataaggacaccagtcattttgatttagggccacacttatgatctcatttttacttgattacctctgtaaagaccctttcttcaaataaggtcacattctgagatgccaggaaggcggtcaggacttcaatggatgaattttagagggatgcaattcaacccatattagggagccaacagcactcccgcgaactgagcccacatggcatttcaggcatgtgatggggaccatgagtataagagctaagaaagtaagccccggagactgcctgggttcaaatctcagctctgtcatttcccagccatgtaacccttcagaggcttagcttcctcatctgaaaaatggggcaggtaagagaatctcttaccataggtttgtggtgaggcttaaatgaataaatacctgtaaaacacttagaagatgcctatacatggttagctattactattattactgttattgtcccctcgtactacagattatagtagtccatttttccctctgttgagtaggaaaatgactttgcccctaagtcacccttcgtcaacagaatatgataaatcacacaaattgtagcttctctcactgagtggtataatgcttttttatttttaacagaaatggtgcaatttagactttaaaaaatcatttaggaacctttatccgatatttcagtgaaattttttggcagcctttaataaactgacgtgagaatctcagtgactagtgacaaatattcatggtgacatagctaattaaggagtcagatgtcttaccaaaactcataagcattatattttcttctcctaagcctttccagctaactgtcttacttttagtctgtatccaacaagcagggacagcttttttttttaaattgtagcaatgtacttgtgagatttaccattttgaccctttttaagtgtatagttcagtggcattaagtgcatccacactgttgtgcaactggcaccaccatctatctcgaggatttttttcatcttcccaagctgggattccatgcccattaaatactaactttccctgtatccttaccccctggtcaccacagttccactttctgtctctatgattttgattactcctggtacctcatctaagtagaatcatacagtatttgtctttttgccactggcttatttcacttagcatagtgtcttcaaggtttatccatgttgtagcatgtgtcagaatttccttcctttttaatattgggtaatattccattgtatgtataaataatattttgtttatccattcatctgtcaatggacatttgggttgcttccaccttttggctattgtggataatgctgctatgaacatgggtatatggacttttttgaaaaaaagttgtgattaaacatgtacatgtatattgtagaaaaattaaatatataggcaagtagaaagcaccctcccttcccaatagagatatccactgtgtatattttggcttctttccctgtaactatatttttgcctatacttgtgaaatgagatcattctatacatattcttatggaaactgagccattggtaaagaaatgtttgaaatagatcaagtgatttggtagtttccttccttgagccccagggtggtgggtgcctgtgctgtaccaggctggcctggtactgtgaaggtaaggctggccttatctcctctatggctcctgtatgatcaggacagtgttccccaatggaagtaggggaaatgggctgtgagaagcccaaggtcatctggctctttctgccccaaatgctgactcctaactggcctctcctttccctctcttctaggcaaatgtttgcagactacggctgaccgtacctcctgagagtccagttcctgagcaatgtgaaaagaagattgagagaaaagagcaggtaaggtatctccgaggcaaagccccaacaagttccagcctctatacccttaacccactctcccatctcctaaccaggccattcccagaggctgggtgtctgcacctctgttgaggagaaggccctctcaaccttcccacctcatctcccgtcttcccagaagacagagagctctccctagccggctctgccaccgacgtgccctgctcttgtttcttggtgaacactatggctttgtgttaccttgaagctgcagggacactggtcttagtgacaggtgctgtggcggggaacgtgggttttcctgaaacagcccaatccagttgcttcaaagggcctattgtgagcagctggcggggctggaacctttctcagcagcttggagcagcagccgggggctctgctcccgcagaagagaggaaaggctggcaggcaggctggtgcagggaaagggcactttcttggctgggggtaggaggcattcggcaaacatttttgtgacagctcctgtgctaagtgctgaggccgtgaagataagtatgtccttgccttgggggaatttgcagttttctgggtgagacgatgatgtgatatttcaggtgttaagatccagccctatatgacggaatctgggaacacagagaagggaataactgactgcttgggaggtgacagtgaagttggaggcttgaaggataaagaggaggtcctgctgacctctaggcctgtggtcctggccgacccattttactcattcataattatggggcacctactgtattccaggcactgttgtatacagtgggaatatagtagggaacaaagcagtaaaccaaatctgtcatccatggaacttatattctagtgggacaagaatggaagtaaacaaaataattaagtacattttatagaggttaggaggtggtaagtgctgatggagacaaagtaaaagaaggggtaggggtgccaggaagtaggcagtactttttcttgagcatgtattttatatgattataaagtaaaacaaaataaaatgatataaatttcataaatggagtcataacatagtgacctcttgaaatacaagcttgctttagagttaaccactaatgtggtcaactataaaaaagaaagcttctcatcgatggctaagtgtttgataatgtccctaagtttaccataggtctctgtctctccttgccctctcctccccactttctaccaaggacagagagctgcctgtgctgatgcaaatgatgaatgccagggaaaggaagtagggagaaaagcaaatgaagttctgactagagaaaggtgaggagtaaaattgctgatctgcctaaaaagagtggatgagttccactaaaaagatccagaaaaacagctagttctgggttgcagaagggaaaagatgagggggatatgggacctctggaaaataaggtttcactcagagatgaatggggtcctagtaaaggacctagcagccagtttgaatgggctttcactggccaaaatgggaacagctggagcatcaaaaagaataatgacagtcatggcttataacacatcgaatattaaaaaaaatccatacgtttgtagtgataattggagaaggggagtagaggcacgagatcagaggataaaatagggaaggctcccttttttttatagaacactagctaataagtttagaaaatctttgttttgtaacctccaggtatactcatcaatagatgcaaaaataagttggtgaaagattattgtaggatattctcaaagtatcaccccagcggattactgattctaaagggacagtaccttcacagtggagtaggcaggcagccagcatttcaaccaagtgatccaacctaacttcaccaatagtggaacgagctgatgttacatgacttctgaggtgattcacctaagaggtgcacatcacatatgtaatattcatgccaaacttgtttaactgaatctaataataaggaaacagaaaaccaaaatgtgggacattctgcaaaacaattggcctgaatccttcaataaattcaatgttatttttaaaaaagatgagaatttgttgcagataagagactaaagagacataacattaaatgtaatgagtgaacctggattagatggtggcaaaaaaaattatataaaagatagagcacatggacgcaggaaggggaacgtcacactctgggggactattgtgggatggggggaggggggagggatagcattaggagatatacctaatgctaaatgacgaattaatgggtgcagcgcaccagcatggcacatgtatacatatgtaactaacctgcacattgtgcacatgtaccctaaaacttaaagtataataataataaaataaaataaaagatatactgggatgactatacaattttgtatatgaactatatattacatattattgaataaatgttaattttcttgtgatgatggtactatggttatgtagttgagtggctctttcagcttctgtgtagctttgaacattctccacagacaaagtttgggagtaaaagtcctaagcagagagtggaagtggtcaggcttcagctgctacacccctgctgatgagcaggattgagtggggccatctgtcactagggagtgtccccttctgtcctcactgctcctctccctgcctgtcccttttagagctaatggcttggtccaagacatgggtctgggctgtgtccaggtgctcagagctgcttagaacactttttgaagaagtggcctaagctggagtgagggacaggacaagggcctggtggcagtacctgttggtacagacggtagaggaattggggaatatagtcttttggagttagacccaagcttcatgccttgggagatgttcgtgaaaggtttctgagtgccaaaactggggtggtaggggctggaggaccctggagggtctgtaaccactgaagaagaatcaagtaatcccaaggaaggagcctcgtgtgtttagctgtgtcaactggagtcaacaaattgtgtgtcagtttgcctatttggcttgaatagtgcttttcaaacttgtcaataggaccctcttttttaaaaaaaaatcagaatgttttactgagccctcatatgcaaaccaagcaaaagtggtactaacgggggcccaagtcctcccagtctccctttacccctcagcccccagacaccctcctgtggttgcttgagaactccaaggccctgaggagcacaggacaggcactgctgggatagcatatgcaccaggatacttcttacaccaggtggaccaggcgtgcagtctaagtgcctatgtgtggcacattggtgactcactgcagaagaactggggtagaggggaggagggtggggctgttgtttccctagggatgaagtccttgggtggtggcagcccttgaagtttctaggggtaactgggaggctgctctgagtgatttcgtcaccatgtcctggccaggttcctggcatgagtcactgagggccagggccatgcactgtcggggagactctgtaggggccacttccttggatgtggtttcaacatggcttcccctccttggaacccatggaattgcaagaggccaaaactctggatgaccctccctggtcacgtaactttggttcctttgaaggggcttcttctgtgtgcaaaggccaggggattggagctggctcagatatgtgagtagaaagttgtaaatggcccgattgacttctgttgcagtgagacttctcaaggatttccagggccctgttagagccgcacatgatgagggcagcctgggccttccttagtctttcacactgttctgggaggtgtttaatattgcggggatgccacgatgccatgggacagctggccatgcatagaggctgctgccagttgggccattcttccgtttgctgttctccagttattggagaaaggaattgctcccaatgtgggtgtgttgtggatggcgtattttgcccatttccacaaaggtgtgtttggaggctgctggatgcaattacaacagagtcagcaccttcttatggagtcaagggtttgtggggtgtatttggaggtttcctatccctaaggcagatgccctggctgcctgttccttttagtccttcaggagacatcaactgccccgacactgctttatgctgaccacagatgagctcccaaatgcacagcttcctcatctttaaagtagacacaacaatgcctggtttcaaattgtaaataagctaatatatgcaaaatgcccaccacagtgtccggtttataatatggattaaagaggtaatgactaaacactgaatctcttccctttgaatgccaaagccagtggccctgggtctttgtttttacccccttagaccttctggagttattctcctgcctgaagctgcctgtctttattttccaaacacatagcatctcttccttcctcataacccttgctgaggccctagccatgcttggagtcccttcactgccatgtctcagtttatctaagtcttccctgtccttgaaggctcagctaaaggcccacttcctttctgataacttcccagacttctatgtgctggggtggtcactcttcccttaacctacaggacacccaggctgcccctttcacttggcacctagccacgtgctgctaagaactccacataggtatagatatatatttttgcaaaatttgtatataacatgtatgtaggcacatacacacacacagagaaatgaggttgagtctttttattctctcttcccaaagcctaggtggctgccttgcacatagtaggtgcttaatgaatgcttattgattatgatgattgagttttatattagcttcctagggctgccacagcaaagcatgaaaaacgagatggcttcaataaccgaaagtattctgtcacggttctggagttcatatgtctgggatcaaggtgctggtggtgcctcctctgaaggctccagggggagaatttttctttgccgcttccagctgctggtagctcttggtaatccttgccttgtggcagcatcgctctgattttcacatggcattttcatgtgtctgtgtccagattttcccctttttatagggacaccaatagggcccagtctgatggctttctcttaacttgacctgctctccatataattcctaggtactggaggttaggactccagcatatctttttgggggacactcttcaacccataacaggttctttgaggaaatcaccttgaattatagtaacaactcagatgaattagctgtgggcttttatttgaatattgaacattaaaaatcattaataatatgggagggaggatgctgattagtttgtgggcacaaattacatgttgagaaattgataaatgtagaatataatgtttataaacaggctgaacattcaaattaaaattggtaatagttttgaaattaagtacctgttgttttcaaagaactctctgaatttatgtatccatattcttatccatagtcatgtgcaacagattcctatgtgtatatgcagggacacacacacacagacagaacccacaccagctattgcagacttagcatattgaatcagggcctcactgcacagttgaattttagggcatctgatctgagttgattctgcgtctttatgatggtaaagtcctttgcaaatagataaaatagcttgaggcagataccgttttaaatagctattaacatcccagctttggaggtgtccttcagtgacctgttgtttttaaagaagctgttttctctctagatctttgagaatgctgagtgagagagagagcagatgcgtgggtatggatgtagagttgggaactttcataacccaataaaatgttgaaaaggaggaagtccttgccagtaggttttatagtcctctttcctttaaaagccttggatgaataagcctgctgagttctcgtccttggcgtgactgtttatacaacctcgcgggctgttgccaagtgagcgagtgtgctgccatgattcagagcttcaggtgggggccgggctgccctttgtgacagcacaccagggactctgcgtgcccctcagagataacagcccctggaggatggggagagacctagagtttgagtcccggcttcctcatgaacccctgtggtggttgggccagtcaggtcatctctaggggtctttgctgcttcttctagcaaatagaaatgttagtctagagccagtgtttttccaaacattcctttattcacgttgataaatgtggaagttctattggtaaagcagtcaaggtgcagcgggtggagctgaaataagatcagggctatgttggctgcctccatcaggcccccaactcttcaccctacaaccttgtcagacacggaggaggagctgggaatagtgtctgaaaacccactggactatacaactcttttccatttttctaaccttctgagactttgtgattcactacccatgaagagaaaccaaggccactttgggggtgaatatttcgctgtcagagccactttgacaactgtaatgagaacagcaaaaagaccaagaagaaggtggacggacagacagactcattcagatagacatgtagagttgagtaggaacccatatactcaaaaatgtaaagaaaccacaccaccaatactagaaactcccagtatctactagtatgctattagcacactaggtgttttgtgtgttttattctgtgtattctttagactgcccactgaaattggtggtatgatccccattttagtgttaaggaccctgaagctctttaaagtacagaaaataactttcttaggggcacacagctagtagatagtggatttgcaattccaactcaggtctgtgacgggccatgttgccatgggaacattgacttgcgtgccttctcctatcagagaaactctgtttaggatatttacattttatcagtcaaggttaccgaaggtgtgtactatacccctgggttccagaaaagcagttcctgatttttttttctcccgtgtattcttcccttttccgcgggggttattaggcctaagcaactattgtctgcgttgaagctgtgtactagctgcacactagtctgcatggaagctgtgcactagcggtacgctagcactcctatcaggctgctatcattacaaatgccactctctttgggacttctgcttggctagaagctttccttttccttctcatcttaagctttgaaaatgatcttttctcctgagtttacttaggaaatgggcactattcagtctgtgagactgtcagaaataactaaattagttttattttttagaaacagggtctcactatgtcatccaggctggaaagcagtggctattcccaggtgcaatcatagcacacgattgccttgaacacctgggctcaagtattcctcctgtctcagcctctcaagtagctgggactacaggcatacaccactgcgcctggccaagtattttgataagccagaggtttcagtttttctgagaatatttatttcccaggctgtggaaaggccctttgggctcagaggtaatgttcatttttgtccaagaaagcaaaacagtgttaagtatgagtaatgacctgggccaaataatttgctgagatagatacacaggttgtacaagccagagcacattcccgaagtgccagcctctgcctgcaagatgggcagggaacccagtggctctgtgctcagcagtcccaggttagctgctgccctctggctggagaaaagaggtctgaagtaagaagttttggaaataacttggcttccagtctggaagtcacacgagtcacattatggcccttctcaaccatattggcagccaggatgtgtgaccagctgcccctcctggctggtggggcgggggactggctgtgttagtctgctattgtcagtttgatgcatgttgagctgcatttctgctcttatttcccctaagaatgctgattgaccaagggattttctttttttgcacagattaatcctcagtgtcaaggatgactgtatactccaaatattccatctttctttttcccttcaaaatgtatttatggagcatctatttatgctgggtaccagagatagagcagtgaataaggcagatgttgtccctggctttttggagcttgttgcattgtaggatcctatcttctcatttaagatttggacaatatcattggccttgttaacgcagactcttcaatggccagtaaatcccttaggagaggaatttaggctgagttagttttctgtagctgctctttctttctaaggcactggctgccagatgtatctttagggaggtcagccatagtatggggcctgtaggtagaatttatgctgtgagtactcacaggaaacagcttaatccagagattctgcgtatgtgttgggagtatggaatgccctttcagttaattttccttctttcctactttctttttattctacactttaattaagccttttattttctttttttttccgagacggagtctcgctctgtcgcccaggctggagtgcaatggtgcgatctcggctcactgcaagctccacctcccgggttcacaccattctcctgcctcagcctcccaagtagctgggactacaggcgcctgccaccacgcctggctaatttttttgtatttttattagagatggggtttcaccgtgttagccaggatggtctccatctcctgaccttgtgatccacctgcctcggcctcccaaagtgctgggattacaggcatgagccaccattcctggccaggccttttattttcaagcaaattctgtctagtattgtttcatgcccaggaggcttttaatagagtacattttttaaaatttgtttttttagtaccaagtagcattataaagaggcttttgatttttaatttaaatttaatttaatttaattttcttgagatagggtctttctctgtcgcccaggctggagtatagtagtatgatcacagcttactgtagcctcaacctcctgggctcaagcaatcttcccaccttagcctcccaagaagctgggactacaggcacacaccaccacatcaagctaatttttgcattttttgcagagatggatttttaccatgttgcccaggctggtctcaaatgcttggactcaagcaatctgcctgccttggcctcccaaagtgctgggattataagcatgagacaccgtgcctggccataaggaggttttaaaaaacttaattttggagagtttcaaacatacaaaatgagactggatcatgtaatgagtcattgatcctctctccagcaccagcaacctcaatacatggccaatcctgcctcatctacatccacgctgtataaggaaataaatatacatcatctgtatctcagcatgtttctctaaaagagactgtttcttaatatcatcataatgctcttctgcctaaaaatcaatacttttcttattgggaggtattttaaaggatacaagaggagagaaatttagccacaaacatcttgctcaacatatcagcttttttctttttttccccgtgttcagtttttgaccaaaagcatactgatattttataaaaatgatagccatctatgctcctagcagcttttctgggtatacatgttgtgaccggggtaaacattaactgtctgttcctccatctaagaagaataacaggtattcacttcatttggaccatatttatgtaccctgagtaattcccagacctctcccaacttctaaagttccctattcattcagcaagtatttattgagagactcattgcacgtcagtcactgttagatctgggaattacggtggaaaagaagacaaagtaggccctggacttgctgcaatttacagttgatagggaagcagggcttccccacacaaggatactgacatacaccaacagtcgctgggctgcagctgtggtgagtgtcgtggggaagtgctgtgagagtgaaccgagaagacctcaggggtctgaagggtcaggaaaggcgttcttgattcttgaggaagtgacatttcagcccagcagtgcagatcgagggaacagcatgtgtgactaccttgaaacaagaaggaggctggctcctaaaggaacagaagggaggcagtgaggcaggtgtggggttggggatgggcaggggaagtggaaagagccccccatcctgggcctgcctcttccaaatggccctgggacctgagagcaggctcttgggttcctacggctggagaccctgggatgctacatggagacgtgagttccagttgttctcctgactgtagcattgtagtgaaaaaagaactccaatttggaaagacataggcaggcacttgcaggctgttaccctggaagaagagaagtcatactatttacacagtagggtcattgtgaggattaaagaaaatatatattttattatatattatatgtaataaaatcacctgacaacaaatttcttccccctcctctttcttcagtaactttcttcttcacttttcctgtcagggaccatcagctccttgggctgcctcaggagtcctctcccctggtgtggctggtgctgatggccctgctccccagcgggtagagtcctggggccgtgcccttcctgggggcgttttatttagaccctgacatttacacaaatgttcaattcaaacataatgcttttttctttttgccaaaaaacattcaaagtctacaaaagaacataaaggaaaaagtgaaatctcattttcctgaggaaactgtcgttagagagctggattgcatccttctagatgttttacatacacaaacacacagtcttcaaacaaaaaatgaaaatttgaaatttatgatttttcactcagtgtatcttgatctctttctgtgtgtacaactttgagacctgggccactcgggagtgttccacagacttcattgttcctggcattgcttgtgttttccctgctccgtggcggcttcatctccctgcttgggccaggggcaggatcctctgtgtccggccacctgagttttcctgcaagccagtccacctctgaaagcctttgctttgcagaaatgcatttcaccaaagccttgtgttgtcattggcttgttttttaggaactgggtggagtctgtgactgaaagatcttgcttttgtttcctggtatttggggagtttcattagagcttttcctcttcctggttatatgtccagtaaattggggataagttaatgccagctcttgactctgctgcaagccatttaacagctcagttacccaaacttaagcacaaatgtaaggatagcatcagtgcctttggggcccagctgtaagggactcagggggaagcatttaccagaaacaagtacaaggaatcacagcttcttgcatcccatctcttcccaagtgtgggaagaagggcaagaagcaatggttgtagtattttcttactttttaaaaagattacattgaaacgaagcaaaacaaaacaaaaaacaagcaatatagaaaggtataaagaacaaggcaaaagtcaccctgatctctagcgcccctaccccatccatggttccttccttagagacctgtaagtttaatcatcatcacatagttttctagacctttctttgattttgcaaactttgaatgaatgggatcataaagtacttaaagtacataaagaacttactgttctgccacaatgaatgattttcaaatgcaaattaaagttttgtgtgttaaaaaatgctttgtgggccaggcaaggtggctcatgcttgtaatcccagcactttgggaggccaaagcaggcagatcacttgaggtcaggaatttgagaccagatggtgaaaccttgtctgtactaaaaatacaaaaattggctgggcgcagtggctcacgcctgtgatcccagcactttggggggccgaggtgggcggatcacaaggtcaagagctcgagaccatcctggccaacatgatgaaaccccgtctctactgaaaatacaaaaattagttgggcgtggtggcgcgcttctagtcccagctactcaggaggctgaggtaggagaattggttgaacccaggaggcggaggttgcagtgagccaagattgcgccgctgctctccaacctggcgagagagtgagactctgtctcaaaaacaaacaaacaaaatacaaaaatgagcccatgtggtggtatacacttgtaattccagctgacttggaagactgaggcaggagaatcacttgaaccagggaggtggaggttgcagtgagccacgatcacgccactacactgcagcctgggtgacagagtgagactccatctaaaaaaaaaagtgctttttttttttttttttttttttttgtgaatacatggcaagaatctctgtgtaaaggcagttgaaaagttagcaggacagcagaattacctttatggaatttgggtttctgtgctgtgggattgtcgaggtacctgggtcagccctagggaaaactgagagaaggtcagtttgtctgaagtctcagtccttgatcttggattttttcttacttctgtcccttccatgttgtggaggcacctactctgtccccctgcatctaaacatagcctgcagtatggggaggtgcttaatgtcagacagaatcacagagccaggcttgaatgtaggtgtgtgtccataagcaagttgcctaacgtctctgaacttcagttttctcagctatgaagtggaaaggacagaaaggacaattgctgtgtcatagagtggttgtgaacattaaatgtgattaggaatatttctagcctatagtaggttttcaacaaatcttaatttccccctttcctgcttgttaagccttcattctataaaggcgtgttaaggcttggacatgttactgtttctcaagggtatttgcatttcaacaatgaccaaaactttaactgaaggaattaagaaccagccaacaggactgggaggatccttttgggctgaagtcacaccacctcttcctggcttttcagaaatatttcatgaatggtcacaacaggttatgtactaacactacccccttttcttagaacttggccccaggaccagccctaccctcagaggacagtttggctgctagatgactgccagcctcaaccttgtgcattgtatttagtgatgaggttgaagtcatatggagaagctgggataaggggaaagacagcattattaagagcatgaggtttcaaatgcttgctcttcttactaggacaacgcaagtccgtctggtatctttgtgggaattactcttaggtgagtggacaggcccttatatacattagcaaacggtgctcttcctccggggtaaaagcagcccaagcctatgccaaatcaccttggtgaacagagactagatgggatttttgctccctccatctccactgccaggcaatgagtgctgggcacaatttgcataatcatacacagtgggcccgttattacaactgtgcatgaggcctaaagagtcattattctttttttcttttcctactttcttttagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagccatttaagagtttttgccccccacctgtattctttttgtagcatgcaagagaatggagttggaagcattgaagtgaatgtaataaggcattttgaaagaattcttagtgttatcattttggctggaaatgtttctgtgtatcttcatggtaatgttaaagtacagatgtaaatctgcaaggaaggaaaggttgagcttctgctggatggatgttactaggtaagtatactcaggagagcagatggcttcctccttccgtgtagggtttggaggctcttgagtggtttttctttattgcacttaccagtcccacattcatccctggcaagaggaataggaagactgtgggtgattcagatcaatcagttgggttgaaacaaatgctaggaagtcaaccacaatagactttgtccaaccaagccaatcaatgccatttccttgtatttagtagtttatttcctatcttttaagttacatgttcttttgagaaaatttgggaaatataaacatgtatgaagaagaaaataaaatcactcataatctcactattcatccagagcaattgttaacattttggagtattttcttcttctctctctctccatttcttttcattccatcctgtgttcccctagattgactgattcccctcttgaccaaaccacccagcttatatggaagaggagatggcctgctctgacactgatgggctcacattacagaccagtggcttagaaagtgcttgtaagaggcagtgtaggggcagggagtcaacctaggcctgtgagctcacagaccttgcttcgagctccagctctgtgtctggcccagcaagtcacttttgctctgtgcaggcttcagtcctcatgttgagattgtgggggttggctgggctttgatacctaaggttaaaaacacagctttgtgagccccattttattttgtgggttttcagataagatgcaaactcatgatgtcttcgcttttgtgtgagtttttaaaaggaacatttcttgttgaatttaaaaaataataaatgcttagcagaaaatatgaggaaaagccagcaaaattagcacgcatatacataatgtatatgacagccaccaaccttaaactcctagttatcccacctttcaaacataattttaaaaatttattttattgtatattttcgagacagcgtctcactctgtcatccaggctggagtgcagtggcacaatcacagctcactgtggcgacacaatcacagcttattgcagcttctacttccccaccctcaagtgatcctcctgcctcagcttcccaagcagctgggactgcaggtgcgcaccgctacacccagataattttttgtagagacccagactggtctcaaactcctggacttaagtgaacctcccacctcagtttcccaaagttctgggattacaggtgtaaatcactgtgcccggcctccagacataatttttaaccattcagaatattcaattcctgaatttcctgttaagaatagctcagacattttaattttcttgtatttttttctcaaggaaatacatagaccttcctcacttaaatgctccggaggtatggctcctcccttagtaaccttctaaacagagtccagagtcccacattgcccaagacaaaggcaggaggagatgttggctaatcctgagctgtggatgacatgtaccaaagacatgtgccaaagacctggaattaccaccctccactgtgatccgcaacttaaaactaactttcaggtccctcctgccataggtggcttcagttccatccctggcctggtcattgcagtatttgcctttgggagggacatgcagctcaagattccacccactcaccactgggagcagcacaagagccagctcagggccacacatgaaagccgttctgcctgcctagaatgaaaagttgtacctttaacctcattttcccaaaatgtttgtacttcatggcaagaaagtagactctatttttagaattcatgtggggaagtctgggggtcttgactctcccttcccccaaatctccaccaatatccagtaacccctaataaacatgctgtctattttaaaacaatgtgcttcaaaattaagccttccaatactatgtcctaaacacttacattctaaccaaactgctatctttaggcccttcctaaaacagaaattctggagtgtgctggagaaaactcccttgagacttcctgccctatttgagggttcctgagtactttccccatcctagggataccagaagaagggaggagacagggactgtttgtaaggtcttttgttgtgttttgaaagtttttaaggtcctgctagccctctgaaagtagtactgtagagaaacttgaacagcgtttgtgtaaacaagtgtttttgggatcacttgaacttttgttatatttactgccttgcgtgttattggtgattactgaggaactgactttcaaatttatgggctccccagggttcatattttacttccttccattccagatatttgattgctctttggcagtcagggccgatagagggaaaattagaggttgctttttggtttctttggtcctcttagccatgagtctgttaaaacacattctacttgtaaaaacatgtgatgggaaaagggcaaaactttgcccaactgtcatttgagggtgataggtgaatttcaacaaaccattttttcttcagagtttatttggctaattaatatttattatgatagttacatgtaattatatataattttatgtaattaatatatattagcatatatttgatatattctatattaatatatgcctatatattttattatgtatataaaatatatacataataaaattatatatatataaattatttggataattcctaactagtttctaactagttgttgggggtgaccttctcccttaatttcctgtcttgttcttaagtttatttttatgtggggtccttctttctttttcttttttttttttttttgttttttgagatggagtcttgctctgtcacccaggctggagtgcagtggcatgatctcggctcactgcaagctccgcctgccggattcacgtaattcttctgcctcagcctcccgagtagctgggactacaggtgcccaccaccacaccccccaactaatttttgtatttttagtagagacggggtttcaccatgtcagccagggtggtctcgatctcctgaccttgtgatccgcctgcctcggcctcccaaagtgctgggattacaggcttgagccaccgcacctggccggggtccttctttctttagagtttcttaaaagttttagaaatcttgtatgaaaatgttatggcttgatctctaactagtatctttgtgggctacaggtgagagccactttggaaaaggtgagaaagcgaatgtatggagactatgatgagatgagacagaagattcgacagctcacccaggaactatcagtaagtcattatctcagttgcttggagatagggaggcatggcaggctcagagtggtccctcagtggctagtgcctaaagatattagagtatctagtgttctttatcaatagaattacattttaaataaactgagaaaattttatcacagaatgaaatttattacctaaagggaaatttttatggtaagaataatcgtattcatattcaaagcattctcaccaaagtcaggagcaaaacaaggaagccagctatcactattattatttaacattgttcttcacatactggccaaacaagagaaataaacatataggtttaaacatggcataggtagatgtaaaactatcactgtttacaaactatatgattgtatacctggaaagctcaagtgaacatgaaatgatgaaagaaaaactactacaaacaagtaaagaatttgttatttgtagcagggtataaaattttatacacacacacacagaggatataaaattaatatataatatacaaagaggtttcaatatacaaaaaattcccaaaatatcatcaacagaaaaatactacatacctaggagtcaactataataagtggaaagaaacaccatgtgcttagaaaggaagattcagcatcataagatccacattactgtaccattttaatatgacccaataaaaagaccaacaggttttgttttttataagtggagtaggtgattctaaggtttatatagaaaataaataaaaagattgggaaaataatgggaaaaaagagcaacgagagggagtagccttattaaatgttaaaagaaagtgaaaaagcctcagagattgaaacagtatcatagtggcacataaatagacaaacatcaataaaaagtactccagaaatgtacccctgtatatgataaatgtagcatctcaaaaaaggaaggaaaatggactagtcaatatgtgctattgggaaaacttatgtgctgttggaagtcttatacctggctaaattcctaaagtatcaaagatttaaatgtgaaaaataaaacccaaaagtgccagaagaaaaatatgtgtgaattcatttatacccttgaggtaagggaatgccttttcttattatgatataaaatcccaaaaccatgaaaagaaaggctgataactttgacaactttgaaatgagaaactcctgctggtaaaaatgtcaaagtcaaatgaccgggaaaaattatttgtccttcgtatcacacataataggctcattttctgaatattgaaagatcccccacgaatcaagaagaaaaaagctacaactcataaaaataggtgaaagatttgtaacaggtaatgtatactaaaggaaagatggagagagctcttttgtgtatgacaggatgctctgcctcacctcatcgtaagataaatgcgggttaaaaccatcccatgatataatttttatctattagacccgccaaagtgcaagagtgggtcaggacattgttcacaggcctgtgggcaaagaagagggttgctgatgaaaatgcaatttgctattactcttacagagaacaattcagcattatcgatcaaaattacagatgtttagatcctttgacccagcaattctattcctagcatttattctacaggtagactctcacatatgaggaaagacataaggatagatttatttattgtagcattgtttgtaatagtaaaacaattggaaacctaaatgtctatcaagtagaggaaagtggacaggcacggtggctcacgcttatgatcacagcattttgggaggccgaggcaggtggatcatttgaggtcaggagttcgagaccagcctggccaatgtggtgaaaccctgtctctactaaaaatacaaaaattagccgggcatggtggtgcaggcctgtaatcctagctactccgttggctgaggcaggagaatcacttgagcctgggaggtggaggttgcagtgagccaagactgtgccactgcactccagtctgggtgacagagtgagaccctgtttcaaaaaaaaaaaataagggaaagtaagataaacgatgtatctctacaatagaatatatgcagttgtaaattaaaaaaaaaaaaaagaaaaagcaagtaatcccttgaaggggagatacagaaagatgtagacggtgaaaaaaagcaagatgcaagaaaatatgtaggaaaaaattgctaccatttgtatagaacaggaagagaagataaacatatcaggattgttctgtgtgtgcacaaaaagttactaaaaggttaatccagaaagtaactaacaactgtttctaattgggaggcagggtggtaactgagcagggtggtaattttttataaaaatataaaagtaactttatacttttgaaatgtttgcaccatgtgagtgtattacctactgaaaaatttaagaaaaataaccttcttctagtttagccaagctaatgcttgtagacatttaaaaaaatttattattaatattcccaaagataaaagtccctgtctatgtgacgtaccttccataagagttaatatctgtgggaaagaagggcagttacaacagtcatgcatcagagttcaatttatggctgggctgtgagattaagtgcttaagtaacacctagtaccttgattataggagtggggctacgtaaatatatctccctaccccatttcttgattataggagtggggctatgtaaatttatctacctagccccttccttgattataggaatggggctgtataaacatatctacccagcccattcccactggcatgtgggaggacatttgtgaaattctcacctgcttatggaaagtcattctgccatgactgtcagacaccaatgactgtcatcaaagccaaagaattggatttgcaatagatgcataaacaagactctgctcctcgctttccatcaccatctcctacacaccctcattttctcatgctagaattgtcccagaaaccctgtctctctgcctactggtctcctccttctccaagtcatcctacctactgcagccagattaagattgctaaattattgctattgaaacacactgctgaacacaaagctgccacatgctcctgggcctggcttgctgcttcaattctgtctccactccccagagtgcacctcctgctctgctgtgccggggctgctttctgctgctcccagaggccacatggggggccttccaccctcagtcctaactgtatctagcctcttaccaatatctaggtcaagaatggcttctgactcagacatgttaaacacacacacccaacaaagacagcagcaacaacagcagcaacaaaacaactctttttttttttttttaaatgagacggagtttcgctgttgtcacccaggctggagtgcaatggcgccatctcagctcactgcaaccttggctcactgcaacctcagcctccggggttcaagcgattcgcctgcctcagccttccacgaagctgggattacaagcgtgcgtcaccatgcctggctaatttttgtatttttagtagagatggagtttcaccacgttggccaggctggtctcgaactcttgacctcaggtgatccgaccgcctcggcctcccacagtgctgggattacaaaaacactcttgagaattgagtgagaccaaagcatattctctccatggtgactacaaagaacaaggtggctgcagaagttatttcaactgggttctagttctaggagcgccacttctgagctgtttgacagtgagcaaatcacataacttctctgattgttttcttccttacaaaggacaacattctgactcctgcacagtgttgttgagagggctaaatgagggtctgtgagtaaacactatccaaaggaaggtgattcttgcccttctctctggatcatgcagatgttgacttttaatttaaagctttactttagatattgttgaagtagatgtggcttctaacagaagaaagttccagcctaactgaagattgtcgtgaacgtgtagggattgattttgtgtgactgtctcctcgatctgtccaggtttcccatgctcagcaggagtatctggagaatcacatccaaacccagtcgtctgccctggatcgttttaatgccatgaactcagccttggcatcagattccattggcctgcaagtactcatctgcttactgctatgacagggcaacccagcttaatcaagagtggggactgtgcctttgcagaaaaataagtcacagaacatccttagctcatgattcagaattctttaagcagaaccactgtgaagactgtgcccagaagacagtgtaggaaactgaaggaagcatttccaagctgagactctaaggctttgtttttgctctctgaaaaggaaatttagaccccgagtttagtgtgagagatgttgcttgcttcaccagatacccgagtggtcctcagcatcagtgcctaaccccacacgtcagccctcttcctccagtcccagtgccacaggaagtgccacctaatcacagaataacacagacttcactaaggacaatctgtactccttcatggcaagcaatataaaaaaggcctgtaaacacttttttataattagaaattattttgtatcagaaagaatcatggatattccacgtcttgtagtagcagacagggaaacagaaagacccggtatcttatatttgtgaaaatgcatgttgttatctcactttgaggcattgttttcttggttgatttggtttacaggagctaacccttcaagtgcttcccattcttactcttacaagtcccctaacatgcaaattaatttgaaaatgttcaaagcaaagcattgtatgtatttgaaatagcttcccttggtcttcatttccaaatgtatgaacaacagtttttacctctcctccaaatttatttggctcttatctttttatcctcctctcaaaagttccaaaacctatttcaaatcctttctggttctatataagtaattttagataaataaattttcatgttgggattctccacttcccctaattctctgataacagttggtatggcagcagtgacaacagcagggctcggccactgtcctggagtgggtctgggtggcctcgtgtttggggtcatctgcgatgcccatttctggtggggcttctgagtcccacccttttcctggctctcttgagtgtatgccagctttcccctggcctcaggccaagccccactgggtctggtttgctcagcagcctttgttttcccttcctcctgtggtcgggggggcttgccaaggctccctttcctcccctttcggacgctgtctcattcccagcccaccagcaagggctttatctcacctgagttcagacttagtcggtatttgtactacatctctggtttttcttcccagaaagaaaaatatatttgccagtattttctggcaattcttgtgctttgccatctggccaacactctggcatttactgcagaggtcagctgtttgagctgggccagctctgacccaggcaccttgactgattcctagttatcatgcaggctcttagtcctggacagccaaaggagccttatagctaaaaccgctgagagaaacagaaagagagagacaaagagagagggagagggagggggagggggagggggaggggaggggaagggggaggaggaggaggaggagaaggagaaggagaagccatctcacagcaggaaactcaacctggtagaggaagagggctgatgcacggtgttaggcactgatgctgaggaccactcgagtacctggtggaccgagtctgaagagagctggcttcttccttatgcaagaccccagcctcttccactggcccactctgtccactttcattattattgacagggagaccagacccttggtttgattccatagaatgtcagagctagaaagaactgagaggatctcagttttatgaatagacaaactgaggccgacagagagaaatgacatgagcaagatgcctacctagtgacagagccaggattagaaaaatcctggtctcttggaccagagtgtaggtttttgtgtggatacacgagtagaatctgtgaagccagtggggctgggggagtgggtggctggtctaggtggtttctaaagccccttgaagctcaaatgttctgtgactccatgcttccaaatagcttcagtattttctttagtatctaatcacctccttcagaaattctttttcttgattcaagtaggtttaggagtgaaaggcttatattgtccaaagtagaggctgaggaattgaggaagcttcagagactgatcatctagacaagagcacagaggtgttagaaacagtgcccaacaccagggttttcacatcttctaatgtgaaattgtagatgactggggacacagtagaagatgactttccaacggcacagattctgtggaggccatttatctctaaggagagttaaccaagtagaaaccaaagcagtaaatagcaccaccatttttttctttttcttttttattatttttttagagatggggtcttgctctgttgcgcaggctggagtgcagcagtgtgatatagttcactgcagccttgacctcctaggctcaagtgatcctcatgcctcagcctcctgggtagctggggctacaggtacacacaaccatgtctagctggtttttaaattttttttgtagttgcccaggctagtcttgaactccaggctcaggtgctcctcccacctcagcctcccaaagtgctgggattacagtcatgagccatcacgcatggccaacactattgatttaaacatccttgcttcagtgcggcctggagcaaaaattacttgtgcggcttggagcaaaaatcacttgtctgcattaccaaattctgttccttagtacttctttattactacccttctctgcctaagggaggaaggtgaaatgtttgcaggtatgtgagtattctcagtcacattgtcactatcctggcaggcagtctagaagcgcagaagggatagctcttttaagaaaaaagggaggccgggcgtggtggctcacgcctgtaatcccagcactttgggaggccgagtcaggtggatcacgaggtcaggagttcgagaccagcctggccaatacggtgaaaccccatctccactaaaaatacaaaaattagccaggcgtggtggcaggcgcctgtagtcccagctactcgggaggctgaggcaggagaatcgcttgaacctgggaggcagaggttgcagtgagccgagatcgtgccactgcactccagtctgggcgacagagtaaggctctgtctcaaaaacaaaaaaaaaaaaaaaaaaagaaaaagaataaaaagaggaatatctctattctataaagctcgtattttgttttctgatttcattgtggcaatttgggaaatacagaaaaaataaataagaaaatagatacccatagccctatcacatagtgaaaactatcattcagatttcctcctggtctttttccccccagtgcataaacatatatttgaaccaatgcttatacatatttttcaaaatgggattatactatacttactattttcaaaagctgttttttttcccatgtgaaatgatgtattataatacttttccttggaaggactccattttaatccatttccatccatcctaagcagtggcaagtggtgttggcagcagctatgggatggtatgggagaggttttcagtccctccaagctacaggggcagacctcttggccaccatgggagacccacagtccctcacagcacagggtcccagactggcagttgctgtagcctaggacagctaccccagtgcttaatgataaggggatgccccagcatgtggtgcagcccatgtgttttcacgccaccggatctggttttgtttttattttcatcctcacagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggagtataaaagcctagatttattttctatgaacttttctcctctttacttctcccttttctcttcccatcttcaacctttccatttccttttctccattctcttcttcattggatttttttttttttttgagacagagtctcactctgtcacccaggctggagtgcagtggtacaatcatggctcactgcaacctccgcctcctgggttcaagcaattctcgtgcctcagcctcctgagtagctggaattacaggcacgtgccaccttgcccagtaatttttgtatttttagtagagaaggggtttcaccatgttggccaggctggtctcgaactcctgacctcaggtgatccgcctgccttggcctcccaaagtgctgggatgacaggcgtgagccaccgtgcttggcccagtttggggcttctccataaatgcccccattgggcatgcctttcttggcctccagtcccttcaagggctctttagacactcaccatggtgctgttgttatgtaactgagaagacgcttgggatgcccacagatctgggacgtcagaagccttggagatctcttccttcactgtttagattttctttgaggtcccaaggcctttctgtttggcttgacaataaagagctgaggggcacacaaatagctggtacttgggctgtaccccaagtacaatattctcaagaagaaaattggtgggtgactagggacactggggaatgtcccatttggccccctaggctgggagcattccttagctgaacttctaatgccctagaggcattagtgcccctcccaaatttaaactgtggatagacttcctacccggtgacaggagcagatccatgaatggctcctggagggcacttaataaattatatcttggatgaattcctttttatgtaagtctgtggtttgaaaattttgctcagcacagacttaggctatcttatgagtagcgtatccacatagtttattgctcaaagcagaatatgtgagggagtgaaaggtggtactattggtaatttagttagggagacaaactgggaagtgtgggccccttcacaggggtaggctgggtggggaagaggggctgccggtccaccgcccggtctctgtattgccgccctggggatctgctgccagttcacttggcctgccacagccatgggacagatcatctcctctgtatgttcacttctaatagggcagctcttcttttccgtgtaagagttactttctcagtaagagttacttggggggtgaaaaaagtttatgttgctaaaaaagcctgaaattactgatttaagtaatttttttcagcttaggggatttattcaatcattcagtccacaaatatttattgagtgtctactctatgtgtgtgtcctgttcagtcctgttggttccagaggtggcctgtcaccaggcatctggggacatcattaggctgcttggcaatctggctgcttccctggagtccaggcctttaactccagcccacagttgcctgttttagagactgatgcttgttttcatcctgacagtggagttaaaaaggtttctcctactcctcctattttactccccaaattgggaaaaaaaaaaaaagcttcaggaactcagggtatgttacatgacctggatgcagagtgaatgggcctccagggacagagcccttccagcaagctgtgcgtgcactgcaaatggagcacacagcacacagggtctctctcagctggtcataagctctgctcaggactttccactttggaacttcttggtgccaacacttacccagtgatgagaagggagaagtcaagggcgtcaagagagacttgtcacatcttggaaataacatcatgtaacctattgagtttgaagaatgcttcccttttccagagtttaggtatgcagcaaactcagctctctgcaataggcgataacctggaaggaggggatgagagcaaaccttctgcagcataaaatcaatggcgggaagtctgtgtgtgagaacgtggcctggcaaacaggaggcaccagccaccaccaacctaagccctgcccacctgcaactccactgactttttctcacctcctaagccaggcctgcttcagtactaggggtgccagcttagtgttccccatgctaggttggaatgtttccaaaagcaacatttaggaaagcacaagggtatggaaagggtgagtccagatttctcctttgagcttagctggtcttacctagaaactggcttggccaatgcaactgatgagattgcgtagagaaataagtttctaccttttgaaaaagtcactcatgtggagcatacctttgtcctgagaatgcccccaaaattcgtgtgaaatgccacttttatttttctgtggctctgctcacccctcttcctccctttccctgttaggtcttgctgtgtctctctgctgcagaacccagtggatgggctcactacctctgtgagtccccacatgaaatgtgcagtggaagctgccaattcctctgggccctgcaaaagctgtcgttctgaaatgagtctcgttgtaggtggaatcgtcccaagaagccaatgctgaggtgatgcgagagatgaccaagaagctgtacagccagtatgaggagaagctgcaggaagaacagaggaagcacagtgctgagaaggaggctcttttggtgtgtgtgttgtagctgccgatgtaaacttaccgggaattgttggttcattattgttggtgatgtatacgtagtagtgtttattcttagaggtgggtcagtagactcagccatgggtaagggatcaaggaattattcatctgctcattcactcccctcccctcttcccctctgcctttattcatccccgtctctactcagaatagccccttgtctctgtctctaaatacacacctttttctagctcatctgacaatttgccagcatctaagcaaaccctgggcttgcccgcagctgtgccctccctccctccatttggttctctctacctgaaatttcctccttccctatctttgatcttgcctaagctccctaaaagccttaaatgccactctctccatgcctggagtctcttccagtcatggagccagaaccattatctgtccttaggaagctcactcactctctctctgcttttactttggaattcttttatacctgccattagagtggggctgtgcgtctcacatcttggcttttccaggagattataagttcctgaaggcggggactccatgtctggctcatctgtgtccgtagaggcttaatacatgttctgatgattgactgggttttcttgttagtaatgagctgatgtattgcattatgggagaaggatctgggaattctgcattcaattccagatctggttctaattcccttacacttctggcaaatacagtgacattctgagcatctactcaatgttattaaacatttgtaggcctcttttacaccttttggatataaagacttaagggaaaaaagggaaaaaaatgtagtgaggcccattaaccagccacatgatgtatctttattcataggtgagaaccagaaccgtgaggttgagttcatgatctgtgagacactttcaggttccaaggtcatgttttaaagagaaatcgtgatctagcaaggcctgagctgattggatcccggtgagtagcctcggtactccatgcctgtacttaggagggtatatttcttttgcaggaagaaaccaatagttttctgaaagcgattgaagaagccaataaaaagatgcaagcagcagagatcagcctagaggagaaagaccagaggatcggggagctggacaggctgattgagcgcatggaaaaggtaggacacagcgttgggcctattgcccacttgcccaaacttttccctgtaggtccatctgagatacgagaggccctggatatggattcctctcacctccaaaatttgcaattaaaaaaaaaaagacaaagctataaaataaagtataaggaagtccaacaacgttctcatttttcccatgataactattttgatgcttttaaaaaatattacttgtgaaattctttagaaaaattaatattttagcagccttgctttgctggtgccccaggtgtgaacttagtttatccattgaattatcaagccctatttaggtgttacatcaacacagcagccctgttgtttctggggcatgtgtctcaagggttggcttttccttgacacgctggggacttgagagagtagggaggccccatttctctaggtgttgtaagcaggctggtgagtgtggtgggggaacctgaggaaggcgggagctcagctgggataatgaagcctgtctagtgaaagggaagaggccaggaattaagtaggaagtggaggaaggggaggaagtggtgggagaaaggaaagaggaaaagaaggaagagaaggaagagaaaggatgggtgacctttagcaggtgacggctgacttctggacccaggagttcagggccaagtctgtggctggtttctgggaatggctccctggctgcatatgagtttgcagagagcagtgacctgccaagaccctgacattattagcaccctgtgactcattcgggatgccaagaatctccaatctgatgatggaggcagaggtggggcagcaagagcaaggtcactgtcaggcttcatgtgatgctgagaagaggtcgccttagctaatggtgtttgcagcataagcccctgtactgtcccctcataaggcgaggtgtcgccactatgggaactgcatgaaattcagttctgtggagcttcagagctcactgggtgcttcgttttagctctttagctttttacttgggagagacttgggcaaactaaagagtcaattacaatctcccttctaccccctgggaaaacagaatcccatcttttattgaagagtaggtgattggcttagtcaggactaacattagtattgaccagagggggtggtggtgaagattgggcaacaagggagctttctagagcttgagtgagcttcctcccacattattgtcctcctacaacagcagaagatcccagttaactcagatgctctctctctgggcagcaggtttttctgcagcgtaaagaagcaaggtgagccggcagcatagcagggtggtctgggggagatgccgtcatacagagaaaccacaggtagtggtcatgaacataggctttagaatcagacagtctggggatttgaatcttgtgtctctttgtagttgtttgcacttacttggtttttcctaactcagtctccacttctgtaaaatgctgataatggtacttcttattcttagggcttttgtgagcaataaatgagaaaaatccacgccaagtgctaagcatggttcctcgtatatagtaagggttcgatcatttgtggctatgatttttactctgttacgaggttgcctaaatgtctaccctcagagtcaggttgtctttagcacgacccattttatgcttatcttcattgctgtcttgaggttctgaaagtttcttgtctttccccactgattttcacatggagccctcatgtgggatgaatgggtagagccaggaagctggtaaggccagccctccctgccagcatttaggaaacacaaaaccttccccaagtggtgttggcttcttctttagtgattggaaatgtattgtcctttctctaaatcttcctttccatttaggctagagaaatgctctatttattgaactaacattaggtaggccaatttacactgtttccttttcagggataaatctgtgagagcaggaatctggccaaatcgctgtctcacactacgtgaacggcatgtcctaggcagggctgtggcagtgtacgtatcctgctctcagttttggattttgctcaaggacaaaccatgtgcttttgaatggcttctctgccatatgccttagtttactgtttctcttgctgagcactgtatttcaaacacctttttttctgatcagtaaaaatcttttaaggagtgttctctaccagggacccttctggggaacagataatagtctatgccataatctgggcagtggtttcacaggtgtttacaaatgtaagaaataattgtgcagtgtacacttaagatttattgtacctcaatttaaaacaaattttaaaagtgtgctgtaagttagaccttgctctactttatgacagcctttttctttcttgttttttgttttttttttctttttggagggaggcattcacttgtgaaagcttttatcactgttatttcggggctaatgtaaaacttccaaccacataggggcaggaggaatgttctgctcaggccaggccataagaatgtgcatttgctgtagagatttaaaaacagtaacaaaaccccagtcaaagttgatctacctttgttattttaaatatttcagagataatatattcttcctgcttaaggtggactgcttccccacccctttggcctacctcttggtataccactgcttatagcttcagaagttgtggcagttaaattttcaaagatttgcttttaataatttggtagaaaagaggtttggaatctatgtagctagtaagagtttgctgggtggaatttccgaacataaagatgaggaacattagttcttagagaaggacctaaagtaaaataatctcccaattagtgagcgttatttgataaacttgcattttaaggaaatttgttacactaacatctgtaatgtatttttagcacaatttcggttatgacaggcaccatgtttttatgaacatttttcagctttgtccaaagaaatgattccagactcttttttgggcaaacttctaaatatacatatatatagcaaagtgtacaaagtgcacggcttagtgcgcgtatgtttcctattgctaccatagcaaatttccacaaggttagtggcttaaaacaacacaaatgtattatgttccattcctagaggtcagaagtgctaaaatccaggtgttggcagagctggattccttttggaagctctagaagggaatgcatttccctgccttctctaacttctggaggccacctgtactcctcaacttgtggccccctcctgcagcttcagaggcagtagcagagcatcttccaggctccttctctctgattctaaccctgctgcctcctcctccttagaagggcccaactggataacccaggatctccccattttaagatctttaacttaatcacatctgcagaattcctttctccatgtaagataacacataggattcaggaatcaggacatggacatctttggagggccatgaatctgaccacaacatatttttacaagtgaatacacctgtgtaaacaccacaagttagaatataggatattgccagaatcccagagcctcttttcttgatgattcagaaaataataaagaattttgcagtatcacaagccaccagtttaaagtattgataatcagtatttggggctataaattttcactgatcctgggctgatggaatactttggaaaatgaatcttgaatggttttatttaggatgttttgtctctgacccataaatatatctataaatacacaacaacagacttggcagttttgagccttgtttgggctttgctgagcaggtgtgtaaaacccagggggtgtcatatagacttggactccctagtgctagaattgctaaatagacattctctgtcaaacttgggatccattgattaaaatatcagtttctgtttgttttaggaacgtcatcaactgcaacttcaactcctagaacatgaaacagaaatgtctggggagttaactgattctgacaaggaaaggtaagacgtaatgcctttcgtcttgtaatggatttaggttgtggacacgctgtgtttttatgacctcatttgacccttacattttcatttgtgtggttgtaccttattacagacttaagcatacataacattgggctgagagtttccaatatggaacaagtttctttggaagcctccagccacatcctgcagatcatggctggttgttagtgtagtggaacacatcaaatactttcacaagtgcaaaagtttggtctattaatgttctccatggccttgaactccacaggatacaccttgttgatgagaaaactcatcagctgtgactaataccacttgctttggaaaccaatttaaaacatctttctttgtttccaaactttgcttagtaaaaccttgcattatcctctggcagtgagtatataaagccctacatgaaaaacacggaatagtacgctgtctgttctagaaatcaaaatgcagagaggccattcaggggtctctagtgaaggaaaacaaggttgagatgatttgagtgttttgggcaagtgacttaacctccctgagtcttgcttgtgccacatggaaattcatctttaaacgggggagacgggtatgacggtgataacagtgcccatctcactaggttactgttgttaagagaactattgggcttgctgcctgccaaatagtacgtgctgaaaaaatacccatttttccttcctcatttgcaatttcagagttttcaaagttacaggaggcttgctagtcattaacatagtgctgaggcagagatggggcacgggaactagaccaccagacctttcctccagtgcccagccccagcggccccagagaactgaagagtccaagcaatgttggagaataaattgtgctgttgtaaaacaaaagtatgaaatgttttgtgatgtggcttgctctgtttggatgtagagaaggtctttcaacttgtcccacatttgccaaaaataaaggatatgtagagcaactgtgattccagaccttttggtattctgccgttgatttcagatattttattgtgttgctggaccccttcttccccgtcctcccctccaagtaatttactggatgttccaatatgttaataaccccaaaacagagagcttctcagatctgtaaatggtgcaaaaaaattatctctcagcccctggaaaataatcatccttatatgggataaaacttgcaaatgggaacttgaaaaatagtcctgtgctcctctgttgtggtagtttgttagtaatcacactactttgtgtggtcatcacataaagtaagaagaatggatcttagagtttgatttcttgttcttggaagcatttttaaatgtttttaaatttacgtttatttttttaccaaaccttccccaaaagatacatgttttctatttttatttatttattttttttttttgtggagatgagggtctcagcatattgcccaggctggtctcaaactcctggcctcaagcagtcctcctgccttggcctcttgaagtgttgggattacaggcatgagccgccatgcttggcgctcttggcaatattctttaaagctgtgactgttgctactgctgttgctgctttggtttaggactcatttgcttttttctcctatttgtgttaggtatcagcagttggaggaggcatcagccagcctccgtgagcggatcagacacctagatgacatggtgcattgccagcagaagaaagtcaagcagatggtcgaggaggtaagcatctgcaaaaggtcacaggcctgggattgcttcctgtggtggggaagcatccccagaacaagtctgccttgcccctccatttcctgtggctcacaagccgaggtgctcaggccactgccatctaggcccagagtgggatttccccacatgtcccccatggactgatgacgatgatgcccctaaaagaggggtttcctcaggtcaaagggttacagttaagaaagctggaaagtgcagttcataagctcacccactgtgaaaggacagtgatagcctgagtgggtacccacagctcaggggacccaagggggtgatgggcagggtgaatttagcccaggtccctgcactgcctccacagccgtctgtctgtctctctctctctctctcagctaccattcttgtcctttatcgttttctgggtgtgtctttcattccctttccttgtctgtttctctcttttttctccctccttcctcgttctcttctcccactcctgcttcttcttccttttcctttgccaccatcctttctctcctaactgtctctgtaacaggaaaccaagctatacatttactgtttgggcatagtttactattctcttttttctaaatgagaaaacgggtaagttgaacatttctatttctctaagaggaacaaaatttgttttaacttgtgtcaatataatccgcctctcttgtggtgatgttccaaagaagaaagtccgtgctctgtaaagctaatcacatattattgtagttttcttcttgctcaattaaaaaatccgattgaaaaatctgatagaaaaagagcagttagtactaacagggttataagaattcccttgagtctaattctctaacctgcaaagaaaaaaaaaggtttcaatttaatcaaacatttggttggcagtggaaaaatgaaaacacattttccttatattaagtactactttaaaaagttatgttttattaatgaattattaaaattaaaagcatatctacttctaagaaataattcatgtacatgacagacaaatggaagattaaaatatatctattttattaatctctaagatattggggatattaatgttggggagttaaggtcagagaattgtgagtatgggaagggacatctttttttattgtgtgtaggataaacatacacattagataaaagtttgtccgcaaatgagaagtgcagttatactgtgttgaatcatgtacatcttatattggttcacacacaagtttctggggagcagtggaatagcagaggaggccacgcacgcatctttgcaatcgttttgtgcatccaggcaggagcactgcccataacagtaatgcggagggagatcctgccctatcgtcaacactaggtagatgtcaggagtgtattttccaaggaaaagcatcactttgccacagttagcatctcagtgagccttggccgtcggggcatagtttttctgcttttgaatttcacacgcacgaagtctggggcaagggcatcccttattttcccctatgcgagtctctaactgtgagcactacatttctcccacctcaccacaggggggtgtctgtgtcattcttgtatctaatcgttagagaactattgaacaaaacctcatactggttggcttctgattcacttaaacccttacctgtaagaggttaaggctgtaccagaatcagagacattgtttttttaaaagacattttcaaagaagtttagaattctctgtttcctaacttacttccagaatataacaaacctaccaatttgaagagagtgaaggagtacacatacgtacacacatatacatatgtgcatatgtatatgtgtatttatacatgtgtatacatatgtatatgtgtgtgtgtagggatgcatataaagatcactgtccatgctttgcttttttctacctgtgatttcatatcttccagataagcttctctaagctttgatgtggtctgtggtctggaaggcccagtcgttggaaagaaatcaccagctaaaatttaggatgccatcagagttagcaccccctaggggctggctgggtttccacagtgaatgtagaccaccaccaccaccagcaacaaaaagagagagagacactttttattcctaataatttttactgcctgatttagaaagtttgtgtttgcccagcatactacattaacttacataagaaaaaaaggatagcctagaatctcatttgctatagccatttatgtgaatattttttttaaaagttagaaacatggtcaaggggcatggacaggtgagcaccttcagaagagcaagaccaggttggaaaggagttgagaacctgagtaattcagggaactggggaagacatgcccaaggagagatgggagctgaattcacatcttagaaaacatgagggaatatgtctttgttttgtattgtgaagcaaggccaggccagaaccactgggtgacactttcaaagaggcaaattgcagctcttcattcacaacaaagaaaacatttctaatactggctgcactggtaaggcatttagctcttcatcatggttacgttctttacaaagtaagaagttgatttagaagttctctagtgttcctccacaaattctgtgttctgtaaccttaaagactgtgtggaggaagtctggtaacttcagttaagtgttcatcatataaagaattctctattgtttactatgctgtgcctgtttttgtgagctcagccttatcattatgttgcataatgagcaaaatcagcaaagtcgtaactaaatcacttcagatcacttggagcaaattttgaaaaatccggagtactgaattggtcacttgtgaaatgaatcttgaactctgactctagaagagaagtatgttttcatctgtgaactccggctccccaggcatataggcagcctttaagtgtagcggatgttaaggaccctttttcttccctcacatgggtctggaagctcgtcttcatcatagcctcactttcaccatggatggaagtctcgtctccatccattgttggtatcattttggccataatgtccatgaggaaacttagtttttttaaatgatgggcttcttttgtttagctcaaaatgtccaggtgtcactactgcgatccttgggaatccttaaatgttaagcaacatgtttcttctcaccttagtggagtatcattttatcatagtaataataaataataaaaagtaactggcccaggttttgtcatccttagctcattaatgacttgatttccatggtgggagacagtaggacttgtactatgtaggaagggctcatggtgggggtgagcccttttgaaatgaaggattagtatatatcttacggtgtcaaggtcattgagaaaagataatgcaaaacgttttctgtgaaatgtggaaccaagtccctctcactaggctagggctttctactgaattaagtctcctgtcatggatgtcagggggttgggtatctcccccatcactagttcttccagctgattctggctttgataaaaatgagagaacaaagccaaaaaagccccacgtgtgcctcttatagccggaaaatatagaaaaatgccgagggattggaaagaaaaagccctcaaggggaaattaattcattcatccattcagcagatacccaccagcacccgctccgtgctggggctgggtacacagtggggagtcaagcagacatgggccgtgctggcacggatcttacccactggtgtcacccgagttccagggtagtcttgcctttgggttttattatcctgttgaaaagctttgttgggattggtctttggtcctgaatcaagctgcattctttagattgccaggaaaggcactgggagagctgggaggagtgtaaaaagtaagagagcatcctgaggcccccacagtgcccctctgctcacacatctttgagtgtgacttcttcagtccacagagtcattcacaccctctttacctgctctcaccatggctctcctgctgccaaccaaagcagctctcctgccaaggggaaagtgatcttaaggaaaaaatcaactatttgccttccaagagggtgggtttacatttttgccaatgggcagggatattgtttagctgaataaacagtaatttcttaagaggttttttttttgttttttttttttttaagctatatcccagtgcagccattaggcatcctttcattttgtcatgtctttcttttgatttccctttgccatttgtgatataggaaatgtttcttccaacagggtctgaagggagtttcttttcatttgcagaggaggcattttctttagacttcttttgctgaaagcaattacactctaccccactttgctataattgagatgtttaataagtgcaaaggtgcaaggaattgattttctcattagtgcttctccacccaagctacacattggaatcacctggggagctttaagacatgcctgaacctggcagatgggatggaggcagactgagcattgggttttgtttcgttttaaaaactctgcaagtgattctaatatacagccaggattgagaatcgctgtcccggattctcagagcggtggcctgactctccttgctgggtttcatgttcatgcatttggccagcatccctcagaagctcctatgcctgaggtgggaagctgctggtgaactcaataggaagggctcaacagaaagcaagccagggagacagtcaccagggaccaggagcacagaagtgagaaagctggtccaagtctgtgactctctgggcactgtcaggggaccttcacttcttgccagcccctggtcctgggaggattctgtgacagctcactctttttttattttttattttgttttagagacaaagtcttgccctgttgctcaggctggagtgcagtggtgcaatcataccttcctgcagcctccaactcctgggctcaagtgatcctccccactcaacctcccaagtagatcgactataggcacgtgcacccatgcccagctaatttttgtattactgttattattattattattttttatagagacagggtttcactatgttgttcagctggtcttccaactcctggcctctagcaatcttcccatcttggcctctcagagtgttgggattacaggcgtgagccactacacctggcctgacagcctaatcttaatagctgtactggcctggtggtatccagataatacaaacttcccaaaggctatttagacccatctagagagatgttactaaggtgggaagaggtacgcttgttaaatagataatagaaacttaaagggacagaatccaatccacctaagtccttgaaagctggactaccactaagagagactaagggtgattctcatggatcctcttccaactgtgcatgtatgcacgtgtctgcctcgccctgctttaaattattcacttctgtctgtacagaagacgttacacttggccacatggtacccctttagaaagagaaggcaaaaacatcttggttaaataattatattagcaatgaccacttctcaaattcaaggcaaagcagaatattatttgtgattcctaaggaatgattttgaaagtatttaacggtcatctcttagattttttttaaagagtgatgctgtagtcataatgcagcagttccttgggggaaacaaactggatcagggagaataacagatgagtaagaactcttcagagagttgagactttgagtatctggctctctagccagttggccaaacaaggctttacattactagtccctaaatccacatgcatctgcagttagagacctttatgtgtctacaacaaaagatggcctagaaaaatagcaacaagtatggactttagcatcagacaaacctgcctttgaaaagttattagtttccttgtctataaaatagggttaataatagtatctacccaattttttgtaagagttaaatgagatgacatgtataaaatgcacagcatgttaattggatcataagaaataataaatattagtggctgttattattaccacctgtaaatgggttcggctgtgtatacctaaagttaagtgaactaaaagcaaaagtagctattgttgatttcctgagcaatgcacggggctgccctttatctttccctttgggagtcttgttggccacattcaatctttgggtatacttctctcttctcttttgtgctctgtgctgttttctagcttagccatcaatctcttcacaagaatatttatacaaaaagcgatttttaagatttaaatttgcttcatcgcaagtatctgccatttttacatggttcagtcatttgctggcacacaatttaattcaaaactgttgtgtggtgtgctgaaatgtgcaacacacgaaagtacattttactaaatgccctgtgtttagaggatttcaagtacttctcataattggtaattagccaaatgggggtaggggaaaggagccatagcaccaagcccacaaacctaatccactcaattgaactgtctccagatcatgtcgcacgagctcttctccagatttagtctccggctctttggaagatgataagttggtagcctgctctgggttggaagcgattcctttattgttcgtgattagaagaacacttgtacactctctgctgggaagaggtggtatttatctatgatgagccaatgaacaaaacaggaaggacatattatttaaaggaaaatttgaccatgtggggctcttgtttgtgaaaacacccacatactgtcaccctgacttgtacagcctcaaactgcagagtcaagagaactcacagatccacagagtatttttaggaacttgagtagacattgaagaaggaactgcaatgaaaaaggctactgaaaaaccattcagaaagatccaggtggaggcttggaagatgaatccttacttatggaaaagctgccaaagacatctgctaaggagatgggaagagagcttgaagaatgttagtgctctgggaaggaggtgctcccaccagatcacccccaagaaagtacaggagcagccaggtatccatgtggtttggttctatttgtatatgggaggtggccctgaaggtgtccttcctgaatggatatcaatactcatcttaggactcttctaagaggagtttagcttgcttctatcaccatcagcattttgcctgaattggttcaaccaacttcacgaaaaggagtgtatctgataaagagaaatctatctggctgaaatatgttgaactgaaacatccttcatgtatgttttatttttatagaggtctttcttgagattgctgcaggcattggtgttttatcagaacatggcagttttgctgagaactagcagtagtagctgcagtcatagcaatgggtggcatgagtctacataagctgggagatggggctcgtggagtgagtgcgttcagaggcccagtgtccctcagacgttggctagttctccactcctatcactccttcatggcaaagcaggcatgaagctgctttcttgctaatatttgcctttgctttcatttagatgcttctacccagcttaagcaaggagggaggggatgggaaagaagcagatgaatacttttccgcattagttattaaccattaatattgttcacctgtgcacggtgctgtgtttagacacagatccccagatacgatgctgggtattcagacttccactagggagacagaggcagatttgagaatctcatctggatgttagcttagtgttgttacctacactgttttttagggacgcctttattgctgtaatgtttttctaagtctctggtggaaaagtcactggcatttgttctagcagcattgattcattgccaagttttaaaaaaggaaataattaagagaatgcaatgacctttagagaaaacaggtcacccatgtaagtcctgctttcagggtggtgtgctttcttctgcttttagagtttcttttctcttttgggctatgaaccgtacctggaggccaggcaggccttattctggagcagatagtgagtgaggttcctagagtactgcatagcctgagagtgcctcctaagtggatgccctccacacctcctgcacttggccctggccctgggtcctaggctcattgttgatcttcttagatctgggttccttgcattgcaggacctacctcagcctgctcttgtctgcctttgctgatgcccctcaattcacctctttcctgcctgtactgtgatatggtgtgaacttgacttatactgcttgtgaaacctgagtcatgtgctgaaatcctgccccgccaccgctttcctcccttaactggatccttagccttggactccaaggctacagctctgtctcgtggccactcaagccccacccaaaggaggtgctactcaaaagtttgaggcaggagtgatttattgtgaatgacaatgttatagtttctaattctagtgtttagcatggtattattccttatttattttaaaatcttagacaatttatctaaaatgtcaatttttagaaggtatcagcacaattgtggcagccttttttctgtatgtgttatatgtattatttaaaaaagcaggttcattctatgacaggtattggtttcggtattcacaatataaattgtcttttcaagggaaaggatattttctttggaaatgtcattgaatctatgttctctttattgaaattgttctaattgactttgaactgtttctcagacacctggtgcccagtttctggccatagaaactatgtgaggctgagtaattcatgttttgggtcactaccagtcacgaatgcttctctcattccaaggctatgcatatggatgtcacattcccatgtcaatcatctctggaaggtattattcgcccagttttttaagcatgggaaactgaggcttagagtcttaaaaaataagtagctggcagtctctcagcaaataatgatggtgctgcactacagacccagatctgtgactccaaagtcagcctttgttcttttcttcttgttacttttaattggaaaaaaatttaaattgcaaaaagttgtagagtgataaaaacaaaaatccacgaatgctcttctaggattaacaaatgttgccattttggcacacttgtttctgtttttttttttttttttaaagaaaagaacacatcacagataaagaagaggttctctttttacctgtccctgattctgttccttttccttctttcaccctctcttcttctcagaggcagtttggtctctaggccatgccttgatgattttactgtgtatatatatatataaaattagtatgtggcttagtttgtgttttaaattttacgtaaattttaatttataatattaaaaataaattgtattgtacatattttgcaacttatttctcagttttgtttctgctgttattccacatagatctggattattcatttcaatggctaatatccttttatttgaatatattgtaacttatttatcctattgatagacatttttattcttttacaaacaataccaacatgtctccaggcttctctaactaggaagtatacgtaaaggaggaattgctagggcatgggattggcataatttcaccttttctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttgctcatttttatattagattgtttttcttttttccagctgacttgtaggaactctacatcttatcaatattaatcatttatcgaaaactatttgggtgccattatcttctcctagtcaatgttttttgtttgtgatatcttttataatatataagtttttaatgttggcagaagtaaagttaatctttttggctgtgttgtgtgtcttgtttgatgtaaagatagtttctgtaatagttttgcagtttgattgttcatctttaggtcttcaattacaacctgcacatccatcccctctatcctctttcttactctgtttttctccatagcacttatcatccaataatatgtcatgcactttatttatctgttttgcatatatattttgtctgttacctgtttccttccactagaatgtaagtcccatgagggcagggacttgcatctattttgtttgtggttgtatctctaacacctgggatagtcactggcaaatgatagttgctcaataaatatttgttggacaaataatgatccatgtagaatttatttttgtgtatcatatgaataggactccttttatttttggctcacggaaagcttgtttctctaatagcattgccgtactgatttttttcacgtcgctttcgtcaagctggagttgtttcccctgtgccattgtctttgaacaatcctgttttcctgcccctctgctgaagactgaaggaaactcattccttgggcttaagagtgggaataaggatgaggaggagccaggtacaatttatggggagcttatgggacagttggtacacgtttaagaagagcctcttatgagcatgagtgcaaaaatggacatgagttcctgctctcagaggaccttctggctgacatttaaactcatttgaacttgaggcagaatgtcataggtgctggaaacacagaagctgggaaacttagtggttaagttcataggctttgagtaaattcagtctgcttttgcatcctgcctctgctactgactaggctttgtatcttgagcaaattatccaagattcagtttccttatcaataatatgggaatggtcataacattacctcctcaagtggtagttatgaggattgactgatgtgatgtgtgctaaatgcttagcatagttcctgccaggacaaactaattctgatgtgggtggagagtctttagggaggaggtagtgtttgaccaggccttgtaggatgggttggatttttctaggcagggattgaatgggtggacatgtcagacaagatatagaataaataaaagcaaaaacatgcagaccagaaagtatagggtgagttcacagagcattcatctagtttggatggtacgagggagtgagaaatgaagaggctagaaatataggttgacaccaattgtgatggtttattagcaccaagccaagaaggatgtccttcatcactctgctcataattcctcaatggctccccattgcctgatcagatatgagctccagagtggtggctctggccagtgggtgctgggtgaataggaggggagaggagcacggaggacagcaagaaggctccaaggagagccctggctagtgctagagagtgtttactttccatgcacttgaactttaggaagcgcttccaaaatgcaattttttagcatcagctttgtgccagatgtggagctaggggcttccatatatatgtattacatgaatttgaagcagttcactcccttggacactcctgttcaggatttggtgttttgtctctgaaactgaattcatcgagaaaagcacaggggtaaataagcttcatccccatctccattccatctgcctcctcttgaatcatagagggaaaaaaaggacagcctaaagaattagggccccagcagatcctttgtgacagaagatatcacatgtcaaccttcctcccagccctgccaactctccaggccagctttgcagccataggttgtcatcactgggaggatggaagcaagcaaacctctgaacagggtgtggtgtgaataggacagcctgggccttgccctcacagatgcttacttgggtcgtaatatcagccctatcagcatccagatgattgtgaagggagtgaatgaatgatgaaagtcttggcacctcagtttcatggtctggtggggataaccacatagggttgtttctgagaatcgtgagctaagccagcaaagttcctggtagcttgcatgctcctcctttcttccttctcagagaatgtgctcagattgggaagcagtttaaccgtccttccctgacatttgtacagccaagtcatgtttaggtacccgggggagccagagtgctcctcctctccttctggagaagttgggttatctttaatataagatagaaatcaaaccaaattacattattttacctcagaaccccgttgcaaccgatccttttgaatggtatagttctattattatatattacttcaaacttaataggaaaaaattgattaaaatatgtgccatgttcatatctagcctggctgaatgccacaagacacattaattgaaaatgaatttccacaaacccaatcaagcatcatgaagatgaaaaatgtacctttttccctccattccttcattgatttttcattttccccactcagtgcttcatttagcaatttttcagtttcgttttgttgtggccttaattcatttcctttactcccccccaaatgagataatgtaccattttcttcatgcttattaaactcttctttcatgctgcattagtgcagggcagattctgatcttgtcatatttctctatgcattattttttttgttaaaaataggctgagcttttttctttttattcttacattttgtggtggcttttatcaaagagaatggactttaaaaaatacagtaactatgaaattacgatgttacaggacttccaaaatagaattaaggaatgctatgcaaaaataaaacactttttctgaggaagagtgtaaaatatcaattattctcatagtcacagtgggtatgtggggaccagacacaattcctcttttgttaagagaattggaaacaatggtttaccagatcatagagggatcaagaggctgggttaaagacacagcactgtcaggaaaagagcaggcagagggagacgacggctgaagcccaagtgagctctagaaggttctgtccctgacccagtcagttcaccatttccctggatttctaggggttttgaaaacaataatggggatcttcaaagtatttccttgtaaaattttcaaattttcaaataacgtgatggcataaatttcccctgaaaaggctgtaagaactcacaataaagtatcatattcctctcttttgacctagaattcatagccctagtaatctcgttttgattagatgctttgattggcagttatacatctttgataacattttcaatgtgaaatgaattattctttcgttaaagccattttaagcagaatgtctataaatgagggcccacgagaaggaataacaaagcaggggtgttggggatggtggctggggagctttggtgtatttattaacctgtggttgagttttgcgatgtgtgcaagtacacacagccccgacactctgattttgaaaacaatgaaatgaaaatgaaatgaaaacattataaagaaatttcaaataaaataatttaaaatgtttattgcaggggaagtttatgccattacattatttgaaaatttgacaatttcgcaaggaaacagcttgaagttccccatagaaatccagggaaatggtgaactgactaggtcagggatggaattttctagagctcactcaggcttcattcatttaaaatgaaaacaaaataaaacaaattttaaataaaataaacaataatgtcaaataaatgttcaaataaaataaacttaatgtggatttaaaatactgaattccattttccttataagatttaaacagtttgattaaatgtgaccatcagttttgtttttcgttttctgtttttaaagagtttatttgagcaggcagcaccaggccacatgcaattgagggcttcacctagggggcttgaggggaaaacttttataggtgtttatggaagcaagacaaggaaaatatttgattggttaaagcagaaagtccctacttaggccacacctgtaatcccagcacttcgggaggctgaggcaagaggattgcttgaggctgggggtttgaaaacagcctaagtaacatagcgagaccctgtctctacaaaaaattaaaaaattagccaggcatagttgatcacacctgtaatcctagctacttgggaggctgagatgggaggacccattgagcccaggagtttgaggctgccgtgagctatgattgtagcactatgctacagcctgggttacagaggcaaacgctgtcaaaaaaaaaaaaaaaaaaaaaaaaaaaaaagtccctatttagaggttagaggttagttggtgttttctgattggttaaatttaaatttcattttcctaagctgtgaccattcattctgacatgggtttcagtttgcttaggtcagaacccaaggcactggagccacctcagcctaatggcctcccaattaattattttaatggttcccctcttttggctagcctttcatttgtgagagattgatcaagttttagtgtgacatcttctgttaccatcatggctggttttcctttgtttcagcgggaaactcctaagtgtgacgtcagttttaacctacctcctattatcagtaagagggggcaggagggggagttgattctacacatgacactcccagtacataatcaaagtgatgtgcaccttttatatgctctgtattggtgtgtttcctgttttacataaggcatttttcgtgtttgttatcctttgccagctggtgaaagaaaataccccaaagcacaatttcttaacagcccatgtcaagcgctgtctggtatttaatacttatttgctgctgtgttttcttcattaatttctctccaagttcaatacggagttatgtttcatgagtcttgcacaattgagtgctactcacatgactacaatgctacagccatctcattttctgtcctctgatgtgaaatggactgtgtcctacatgttactaatgggaagaaattccaggaagttgagaagcctcacaacttccagctgtggattcctcactgaatccataacagaaccatactacatttttgtacaatttcactttggtctggttgacgtataagctcttttcaaaacatattggggggactttttttttttttagctatagcaatctgtttctaacgcagtttttatttaaatgtgcagattggcaagggtgatttcagctcctgagagaagttatcttttatatgagataattgatgcactaaacacttgttccctgtgggtttggggtctagtacaagggaaaaaagtcaactaaggatggcagtaactatgatgtgtcctaacaggggtaggttcaaaggctgagctatcacagagaagggggacacaaaggcagcctggaggacttggaaagcgctggcctaggtgactgtgggtagattgtgacagcagcagtttttctggtggaaaaggggatggagggtggggaggcattcctaatggagccaccagcctgtgtgttcaaagtcctggaggcgggaccatagtgtgttcatgcagtgctgagaggatggagtgtcctaaatatagggttcattgtagggacaggatgggcatgaaatgaaagtgggaaaatagggagcacagcggaagggcctcccgtgccatgctagtgagttcgaacattaaaagcgtagggggtttttaattgggagagtgagatagtctgcattcctggtaccagagcacctgtattttgtaaaagctccctccatgggtttccagcgtgtggctatggttaaggatgattacttagctcaaaccacctatgcaggtaactcgattgtagctaatgtgaaaaaaaaaagccatgatcagttttaagaaactaaaagaacttttatttcccctccctccttaaatatcaaactggcctgtattctaagagactaacatcctgcatgattgatcgggctgcaaggcccatattcacatattcagtctgagttacaaagaaacatactcatcaaaagaaaaattagaaaaaattctattaacatcagttaaaaggtcccagattttatgaaagtgtatttttccccttgttctataaggaggcctactgttttgtatttaaatttagctgttgcaagattctgttcttgtataaatcaaataggtgaggtccagaaaatgagtgcttctaatttctcagttcttaatgccctggtttgagtttggtaacttgcgtcatttaccaccacctggtgacagctagaactaaatgcagctttgtgaagggtaaattgaaggtcaaactttaacatttaatgcatcaagaagtgagatcaaaggtgcctaatggatttcttgcataccagctatatggtaacctggattttggagtagctcctgatttgggggttgctctggggacatgtgtttagcaagatcatcttggcccaactgggcctccaagcatctgatccagacagttttccccctgaagtctatgggatggattgtttaggaatggctggatggatttgttgattcattcatttgttatctgagaatataaagatgatcaaagtctttactcttgggaaactcacagcctagggaaggagaaacatcagtaatcatataataatagctaccttttgagtgtttatcatgtgctaggtgctacaagagacaatatttcaaggttctttgaagttagtagtcagaaacaataccagccacacaagtgtgtgacttaaagtttgtaaaaaatgaaccaaaggcttgagagtcagatgttcctaggaggctatcaaacccaggagcatgtgagtctatttattttagaagctgagtgcgtcacttgggaaagggatgggaggttcttcggggcagaccactggggagactaagttgggattcaaggttggcaccccttggggccggcagtgcactgactctgccagccttagcatccttagtgctcttatctgaacaagtcaattcagatcacagaatatactagaaaagaagtttctgtaagaaatgttccaggataaaagcaaatctgcacagatagcattaattcagcacaatagcatacttgtttcttggagcaccattgctgaaaaccatgagccttgttagaagctgccgcaccctcaaatcctactcctgtccagctccttctccccagaaccaagtgtctctccagactagcatcagccctctgctctctcatgagaagtctagagaccttctctctatagcactctctctaggtgatgtattaaccattcactgatttattttttaaactaccatctaggggacagtgaccagtaggatcctctcaatatcttactatgagctgctcattaaggtgttttaaaaccacctctcttgctttccttgcctcacaagccactctgatttcttcagagacagtgaaacgagtgtatttgaaatcactttttacatcatttgattaaatattacccctgactttcttggaagcttttagttccattttgcctttcatttaaagattttaaaagttaactttaacaatcttaatactataaaaaggaatgaaaaagacataccgtgagagtaatttttgggaactatttctacaaaaatggaaggaagtttacacaaaacaaactttaaccctaccacaaccccagaagtattgcatttatccaacttctcttccagcttttactttcatcattgtaaacttttgcttttctatcccttgaggctttttgtaaactttccattttgcagtatatttgtttttagtgtttgtgtagtatactccatgaaattgatatttcataatttattaccctttcctttagtgctagacattaaggttatttagtgctagacattaatagtccatattaatggaaataaccttatttctctctattataaataatgggagcaagaacatctttatatatagagctttttcctatgtttgaattatatccttaggataaattcccaggagtgggattagtggatcaaagggtatgaacagctttatggctcttaatatttattgctaaattgcctgaagggtcatactaattcacaatgccacctgcaacacaggagaggagctgcccctcccagtcctgccaacgctcatttcttcagtcaatagttttgggcaaatttaataggtagtcaagggtaaccattgctgtttttaattggtgatgtctttaactattattaacattggacattttttcttacgggtgtttctgttctattttgtatggtttacttttcatgtcaaaggattacattttttgacaccatgtgaaatttaaaatacttgataatgaaaatgccaaatgcacacagaacagagagagtaattgatggagccctctacgttacccaggttcagcaaatagcaagatttggccatacttgctttatctactccttcctcttttttcccctcttgtgcagtattttaaagcaaatcccagacattctgcatatgtttcctatacacttcaccgtgcatctctgaacatatggactttttcttacataattataacactatcatcacacctaacaaaattaatgataattccttgctattatttaataccaacctgcaataacattttccaaagtgtcttttcttctgatgctttgttccaatcagcatacactgtgtttacatttagttatgtttctaaagtctcctaatctagagcattgctgccccatctctcccgactacttttattcgtacctaagaactgagtcagttgtcttgtaaaaatgttcacattctggattcgactttttgtgtccgtgttagctctagaagcttgattagatcaagtttcaccttttcggaaaggcaagaacacttcatgggtgatgctgtgtgtttcatcgtgtatcacttctggggtgtataatgcctggttattccaccttgggtgatgccaaggctgataatggagtcaagtggtgacaacccaaaacatgattgaatgttttttcattagcttttaccatcatggtttaatctactgatgatggatgcttgaagccattatttcatagaaattgcaaaattgtgattttctaattctgtcattccttggccattgattaactggaattattctgtcaagtaaaactagggctttttagagtctcaaaatgcagtttgaacagagaaggcaagacagatgctttattttttcctccaaactcctttccaagtaaggagttgatgccttttttacatccattggagtccagtgagctgttactgttttattctaaagacatataatagtcatgttctttaatatctttatatttcatgtgttttactcaattacactcattattatttttgatgttcagaatgttccatccttggcccaaggggagacacctcatgtccttgttttcaggcataacaaggtatctcacgttcatctagtttatttttttgtcccctgaaatgagccattccaccaagatgtcctgtgtttttttagtggggaatgctatttagagaccacaatctgcacatgttatgttcttattgtttccaagttttctcagtagatagtgtagagatacatattttacaaaagaaaataaaaattatgaattcatactgatattgtcattttaaattgaacaaaattttgtttacttctttgatttcacacttgtattgctttctcttacagtaaaaatcttggttccaaacatgatgataccacaatatacatcaaacggtttcaaaataacttcagtgttactgctaacaatcttctcagtgaatgagagattactttgcagctctatttatctttaataatccactaagaatattgagtcaaattactgtattctaataacacttggattaatacttctcaccaatttgatatacatcgtttcttcaattcagtttgttctcagattttagggttcactttttttctttttggcttcattttattttttgaatctgtaaaatatgctttcaaagttaaacctatgtaacaaggcttatgtttattacataaacctatgtaataacttatgttatcctgtctccttcacctaagttcttccctttccctattggtagctatttattaataattagggttcattttgtctttgcagtgtttcttttgcaaatacatgtgcattcatgtgtccccacctgttttacatcaaagcgagtatactgtctaccttgccatacacttcatcagtgtttttgagatctgcattttttggaaggttacacagacctccatcataccatgcatggtttaaccagtcgcttattgatggagttctgttttgtgtttcctaaaataacacatatcctttgttcatatcatttcatattttggccagtgtatctttggtatctattcctaaaaatggaattgctgagtcaaagggttaatgcatatgtactttttctagatactgctatattcgcttccataggaatagtgtcattttgcatgagaaggattttaaaatttgttttgttttcagacagggtctcactttgtcacccaggctagggtgcagtggcatcatcatagctgacttccaccttgacctcctgggctcaagcaatcctcccacctcagcctcccaagtagctgggactacagggacacaccaccacacccagctaattttttgattttttgtagaggcagggtctcactatgttgcccaggctggtcttgaactcctaggctcaagcaatcctcctcccttggcctcccaaagtgctgggatcataggagtgaactactgtgctcggcctgagagtgattttttgaaataattttgtgagcacacaaatttaatatacaggatttttggaaagttaatgtgttattaatgatcctgcatactgttcccactattatgcataacacggcctggtacagagtactctggttcctgccttcagggaagctatggtttgtctagggagacatgatgtatgattggaaaacaaagagtagtctaagatagaatatattataaaaaacaaagatggatctttttaggaagcctttcttgcttactccaggccacatgagtcttcagtcctctgaatttcaacacttttaatgagacttctaatgatccttttttcaaaccaacttttgacacttggttgaacaaatatgaatgtattgaataacacagccaaatgtttgaaatgcaggctgccctgcaaattcaagccgaataatcattttttggagagttgtatctacatttcccaaagcatgttctctggaagatcttctggctgttttaaagggttacacagcaaaatcagtgtggaaatgttggattaatcaaagctgaggagctgtgactccagaatcatgtctgctgccccaagctcacctgttcacacaatccgcctgtcttggagcgtctcgcgttaatactgttccacgaaacacagagaatcagtatgcaggctgtttcaatgaaaaccatccagccccactggaaatgaggaaaaatagaaatagaaataaaaataaatgaaaaccaagggcatctattccagttgataaacctgtacttacacaattgtacatttttgattaacaattttccatccctttctttctagattgaatcattaaagaaaaagttgcaacagaaacagctcttaatactgcagcttttagaaaagatatctttcttagaaggagaggtaaggatctctgtttctttaagttggtgtcttccctaccattaaattttatgttgctaagcctaccaccgacacttaattaaaaatatggctatttcccggccttataaaattgattgagggttaagtgccagccttgaaaatgaggttctgacagctgtttttcctttaccatcggactcccctcattccagttgctgctgacttctgctttttggctctagtttttcttattaaagaatcatcctagcaagcctgataagctgttgattagcactgataattccccgcatttgtccagtgctttataatttgtgagatatgttcatatacattccttacattattctctctgcaactttaagaaaggcaagactaagattattatctctgtattaatacatgagaaaacagaggcacagagaagacaggtggttttgctcaaggttgcccagcttaataaatgtcagagccaggctgaaagactcctaaatccagtgctctcctgtcacagcgagtgaagatgtgttagaggggacttaattttacctgaaactttcagatgcttagtattcttgactttctggctttttgaaagtcatttggggattttgtatatgttccagagaagaatattatggggttggaagaactttacaaggagaagtcaaaatctatttgctctaaaggttctttattagagcttggcattgagcctttgccttttgagacttcctgaaaagctggtttgccaagcacctgtccttatctgtgttcctcgttatagtccttccacagtgagagagcccagcagacaatgataaagtaagaagaaagagaagagaaaactttgattaagccctgctgtgtgttgggcactgttagttactttggatatgttctgtgtaacacagaagttaagagtggaatccaacttacccaagtgtgaaccctggatctgcttcttatcagctgggtgatgtgggggaagtttcttatcattataaaggagggatcataactgtgctatgtgtgggtgacagtgaaatcagaatgtatagaaggtgcctggcatgtactaagcactcaataattttaaacgtattattgttgttccctctttattaaaagggacaccctctgagttagatgatattttcccccttttttagatagggaaactgaggttcgggggtattaagaagtctgcccaaggttacagtagagatgggtaagcctggatccagatcctgagctctgaaccaccatgtttgagtgggtggtgagctgagccttcttttactctgtttttgaggggttgccttacagcagtcataaccagaagtccctcatggcccataggggcctggcaccagattcaacgcccaagagtctctgtcttttgaagctgagtaaatgggtattttccccatttccactcctgtcttccctgccacagtcattggctcagtgccagccttgtgaatgaacatttctgtttctaagattcctttctgaaattgcagctccctgtgggaggaagcacaccttccccagtaagagtcagaaaatgagtgccctagtggaagcccatgtggccaaagagaaggcagtcacaggagagaggaaagacagactgacaggagaggcagaaggtcccccaagacagtgccccccacccccacctctggctgtgctgctaaagcaagctctcctactggtagattcttaaatgtccaagggaatattgcacatggggagtaatcttagaaatagctatgttggtttatgctcagtgtattaaactcatgtctcaccttagtttgggttgctccagcccttgaaatgtggagtccagatagtttatctgggaggcgatctcaggaagccccactaggggaatggggaaaatgagacagggaagggaagagagccaatagcggtgccatatcaaggaggttgccctgaggacagctgaggctcactcctgctggggatctctgggagatggtgtggaagtggccctgagctttccttactgaaaggccagaaagctggggcatttatccactaactcccatcagtcattagctgaggcctgctctggggggttgtggcagttctagcctgccctcggcagagccagttagactctggtggtcaaaggaagcccccagatgaagaatcaccagtggcctgttaggaaacaggaatgcccagaggatgtagcggggtgggtggcagtgtcagctatgtctatctaataagcaagactttgaaaaccagtttttttttgagcatatcaataatgattatcaatttgattgattaaattccctgaaactatttaaattccaatacaaatttattatgactaattgcttttggccacttcacacatccaccttaaatagcagacaatatatacaaaaaaagttgcataataacaagatttaataatacatttagacttaaacctattctaaaatactaaatatcatgggttttaatttattttgtcattgtttctgttcttgttttttttttttttaaaccttcctgaggccattgttttacttctttcaatattttcttagggctaacatcattttgacacctttcagacaggtgcagtcatctttgagatccaaaagagaaaggataccttctctaaattgctaagattagaggatgtgggttacataggttcttggttgggtcacaggaccctcagtggcttcttccaaggtgattcaaacacaggactccttatcactgtctttagcactattaaaaacttatgcattctttatcaatatttcatcatacatagctaggccatgtagagatctcctctcctagggaatcagaggtgacattcaaatacttggttttcctctttggctctcagactagctgatcatttacacacactctgccgacgctgttccttgctaattgtggatgatagctaatgctgacacgttgctgcccaactctccacttgattgctctacggcacggatgctaagcagtccttctccaggtcctgaagtcctggggtgacctaacttacatgttctttagttattctttctaacataacagaaaacttttaaatagatatctaattaatacctcctaaaagaaaccacaaaagttttggtagataaatctggtagctccccatcttactaataagtagctacatttgtgaagagtgcaattgcagactccagactcagactacctgagtacaaatctcagctctgccacttagtagtgatgtgatattgagcaagttaattaactgtcctatgccttagttggcttattggtaaataggaactctctctgtgaagtggcatcctctccatagagttgttatgatgattaaatatgttaatacttaagtgattagaaaagtacctggctcatggtaaatgccatatgtgttactgtttctttaattgcctgcgtcccagggactcttttattgtcattgataaatattttagatttatagctatgtcccataatgaatcactctttctcttttgctcatcctcaaagttggagactatcatcaaactcagctgtgtgataatttaacaaagagaatttcacctttaggtgaacatgagcagggattgtacaagccaggtcctactagcaggccatagggcccagcagtcctttgcctgcagcaacctgaaaggttcatcctgggagggtgaggctggacgtgagtcttataggctggcaatatttcagcttcttttagcagttggccccgatatttgcagaattcataggagtttgggattcatatcaagtcttagagtttaagtgtcataagctgatggtcttgtatgatgtcattactcctattatgtattctggctccatgcccaggcagtatttggggatttattgatcatgcctgtgctcctcttagccacagtgctgttggttttaaagaagcaacccttagtttcagattgaagagccttggctcttacacatgtcctcagttagtccagttcctagctgttccccaagaacactttagctgttctgcttcttgagctacgggttcaggactgcatgacatatccagcactgtgctggagctgcttcatactggttaatgaaagcggaagacatgcatcacttctcaggtctccatttggggatgtcatgttggtcgcttgcaattagctatggaggaggtcttgacaccacagaaattgacatatgtcacaatcagagctttttaacctagggattttattgtcaaaaatttactagtgcaccattagtgttatgtaactctgcagttatacctaagggctttgtgtttttaccctgacacctctgcttacaagcagagtaactctgggcaggtaattctacccctctgagcatcagtttcagcatttgtgaaatagggataatccctcccacttgaaagaaactttttatgattaaataatagatacaaaagacttagaattgtgcttggcacagtgcgaaagatggacaaatgttaattctttcttaattactcaaccttttggagacttcggttctgactcacattctgccattatctgtgcatgaccttgggcaaatcatgccaccaacaacctggactcggttagttcatctttaaaaaagggagaaggcttagatcaactctgagattattaccatttttaatgtttgaaaactttgttgaaatgttgaaatcgtattaggatcctagacagttaagggaacaccctctacctgatcctgggctcggagaaaaggacaggccctttcctaggtcatggctgacactctagaacccttcttcttttcttttaaaacagagaatatggattattttagtccctggattcatcatttgtgcttacctgggtttaaactcattagattttgaactccctcctccctctgccccaaatccaaatgacacagcagactcctaaaagcttgctctagcctggccctgtcagactacattttcatcaaccaatttaaaatcttcctgatcccgctgatgagtgagaacatgcggtgttcaggggacataaacatgggaacgataaacactggggattactagatgcgggaaagagggagggggaaaaggtctgaaaaaccacctactaggtactatgcttattacctgggtgatggcctcagtcataccccacacctcagcatcccacaatatacctttgtcaccaacctgcacatgtgccctctgattctaaaataaatgtgaaaaagaaaatcttcctgataacaaaaatatgcccattcttttttctttttctttttttcaaacaattttttttattagctcaacttctggagaagaagaaatattctccatttccaatatagaaaatgttcttaaaataacattgcaagcatttatcttcataagctttctgaaactctgaacagatttcgttacacttttctctgtcggatatactacacttacagctcaattcaaaagtcagaggaaaggagtcaaatgtcttggttttgtccatcctgcatttaatgtgtgttgtgtagcacctgagcctctcagtgtgtctgttatgcattcttgcgactattattaatttttctgtgtaatgttggagcggcagcaccaggcactcggctccccacatgcattttatggaacacacattcagtgtatgtgctacagcccccgagctgcccacacccctgggcctgaggggaatggtgggggaggtgaccgccaaacattcgtgacataatttccaaaaaatgtccagaagtgctgcacattttctcccttcgtgaaaggcacatgtgcctcccaagccattgggttggtattcgttacacatataaacacaagggggtggtgtttgaaagcaggaaaaccatggaatttgcttctcaatcccagaagcaatcttttttgtagcacagtccaggcagcagtctgaggctattctttgtcgttccactgtagtcatattctgcaagactaagaaggagatagtcttgatttattgtatcaaatcggttaatttaatttttaaagacttttcttaaatctgtcccacgctctctaactctcctcttactgcccatgttcaggctctcatcatcttttattttttaccttatcaacttagttatttattaacttacataaataagtttctgttatttattaacttacataagtaagtgtttctgtttaagcatataatccactgagttttgacagtgtttatacccatgaaataaccactacaatcaagatagagagaatttctatcaccccaccaaagattctgtttcagtttgcaacccagctttccattcatccctaggcaattcttgatcttttttttctgtagatggtgagtcactttttatcacttttggtcactatggatttccatttagtgggaatccactgtatgatttgcatttctagaaatggaatcatatagcatgccctcttctctgtccagcttctttcactcagcataatgatttgaggcgcatctaagttgtatgcattcccttttgttgcagagtggtattccattgtatgaatatatcgcagtttattcattcagctgacaaaatacatttgagttgtttccagctctgggctattgtgaataaagctgcagtgagcattagagtacaactcattatgtgaagatagttttagttcctcttgggtaaattcctggtagtggaatagctgggtcgtaaaaggaggtataagtttaactttttaagagaccgtcagtttttcaaaggggttgtagtattttaattttccagcagtttgagtgtaccagtgtctccatatcctaacccagacctagtattgccaaccttttaaatttagccattcagtgttatagcttttagaatttgtctagtaggttttctggctttgaaagctccaaaataaaaataaaaacaaaagaaaataaattgagccatgctaggggatatagagtgctgtctcatgtggttttaatgtgcatttccttgtcaactggtgatgctgagcatcttttcttcttttcgagaatcttttcatatgctttttgccatttataagtttcatcttttgaagtgtctgttccaatctttagtccgttgttttattgagcttttagttttcttactattgagttggaagagttctttatatattctggattcgagtcctttgtcagatgtatgtgctatgaacattttctcccatcctgtgacttacttttttgttttcttaatgatgtctgttgaagatatatatatatatatatatatttttttttttttgcaatggggtcttgcacagatacccaagctggagtacagtggtgcaatcttggctcaatgcagccttgacatcctgggcttaagttatctcctacctctcagcctcctgagtagctggcactgcaggtgcatgccaccacgctcggctaatttttgtatttttagtagagatggtttcaccacgttgcccgggctggtctcgaactcctgagctcaagtgatcagcccatgtcgggttcccaaagtactgggattataggcatgagccaccatgccaggccctgttgaagagattttttatttttggttttcaattaaccatttatttcttttatgatttttgtcttttgtgtcctgagaaatatttgcctactacaaggtcacaaatatgttctcctgtgatttcccctaagaattttatggtttttacttgtttatttagttgatccattttaagttgatttttgggttttgtgtgaagcaaaggtatcaatactctttttttctacacagatgcccagttgtttacttttaatgtctctttaatttctgatattatttgtaccctctttctctccctatcttatccactctgtgtctctgtctctctttctctttctcttctttaaccagatagtgggttatcaatttttgttgattttaaaaaataattaaaatagcttttggctttggtgattttctccattgcttgtctgctttctattttattgacttttgccctgatgttcattacttccttccttctaattatttcgggattactttgctcttctttttctagcttcttgaggtagaacttaggtcattgattttagacctttcttcttttttaatataaacctttaaagctataaatgtccttctaatctctgcttcacctgcatctcacaagctttgatatactttacttttattatcttccagttcaaaatatttcctaatttcccttgagatttttctttgatttatggattatttagaggcaggttatttaatttccaaatagttgaaatttttgttgatatttttatttctaatttaatacttttatagtcagagaacacagcttgtatggttttaacttttaatttattgggacttattttatggctcagcatatagtttcaattaaatttttgtgaaaaaatatatattttgctgttgtgtatatcctacaaataccagttgggtttaggtggttgataatattgtttagataactgacatttttcttggattttgtgtaattgtcctatcaattgccgagagaaaggtgttataatcccttaccatggttttagactgtctctttctttgtttttactttgtgtattttgaaactctgttactaggtatatacacatttttgttatgtcttgatgatgaattgatctttacaatatgaaatgttggtccctacctttgtcaatactctttgtcttgatatctattttaactgatatgaatgtagccatttttaccctgttatatttactgtttacgtgctatatattattccagccacttactttcaactgatttatatctctgtatttaaagtacatctcttatagaaaatagttgggacttgcttttttatacatagttatagtctctgccatttaattggagtatgtagtttactaatatttaattatatttatatgattggatttagagctaccatttcattatttgttttctgtttgttccttctggtttgttttgcttattttgcttgcttgtttgttttgttctcctttttgccttttggattatttcaattttttaaaaataccattttaagttatccattggcatttttgctgtgtctcttttctctaatatgttggtggttactctaggtattgtagtatacatcattagctgttcactgtgcacctagagataatattgtaccatttcttttaaaatgtagaagtcttgccatgatatacgttcatttaccgctgtgcctgtggttataattttatatgtattgtatctatatacattataaaaccatgatacatgattatcatttttgctttaacaatcatatgtactttaaagaaattaagagaaactagattctttcatatatactctatttctgaaggtctgagtttctctctgatgtcatctcgcctcagcctgaagaaattttatttagaattttgtgtagtgcaggccaggtggtaaaacattctcttagtttttcttatctgaaagtaaggtttttatttcgccttcattattgaaagatatagagctctaagttgccggtttatttctcttggtactcattgtttctgggttccatggtttttaatgaaatatctgtagtgattcaaatgattatgctcctgtatataacaggttgctttcaagatttttcttcatttgtggttttcagaagtttgactgtaatgtgtttctctttgaatttatcctgtttggggtttactgagcttcttgaatttgtaaatttatgtctttaactaaatttggggagttttcagctattatgttttacagtaattttctgctttagttttcctctcctctcttcctttgactaaaaaacccgtatgttaggcttttcaaattgcttcacagttccacagtgctccatttattgttttcagtcttttgtttatctactttcaattggataatttatattaatgtattgtaaaatttactgactttttcctttaccatcttcagtcttaagtccatctagtgacttttaaaaaaaaattcaggtattgtactttcctgttctaaaattttcatttagttcttttttgtattttctattttttttactacttcattaattgtaagcatatttttctttgtctgactgatcattgttatgatggctgcattaaagtctttgtctgaaaattccaacatcatagttacatcaggattggtgtctgttgattctcttttcccttaggagtgggtactattttcccgactctttatatgtcacataattttggattataagctggacattgtgagtgctttgttgggttcttgttttaaaaggcaatgaatttagccagacccaactacatcctgcctgtctgtgatgctgatggcagatctcagttcagttctttaaacattagctgcaaacttctttcagttttctccagacatgcatggttcagtggtctaccagagacttgaactgagtctgtatacaagaatttagtgttttcccccaactctgactctcctcttttgccttctcccctactgttagtagccctggcatccttctccgggtttcttcccccagaaagatgatctttctgttaatattttactttatctctactgccaccaccatgactgtgctgctctcagggcaaatctgccagcaaaaagaaaaataataaaacacggagaatatagagaactgcttgccacatgcttcaagtttcacctcatctccaaaacttgcctgtctttgttcacttctctagagatctcattagttgtttctaatctgttattcagaatgtacagctgtgagttgcagcaggatcagtgtgttgagtgcatactcctctcactgcaagtgcagcccccactctttagctgaataattgcagtggtcttcctgctgtctttagtcttattttcctccaatccagctttcacttgggagccaggtgattaaaataaattctggtgctgaccttgctattgtaagattgatttctaacttcttgtagtggcatacatagcctttcattaataacttctacacacctgtgtaatgcaataaggtgccttttctcaacccagtgtgtttccacagttctggaatactcatcacctttgatttttcttactctctttcccttgcctaactccagaaactccaccgctgtccccattttgagtcagatgtcccctctgagttccctcttaatattctgtggatccccctataatgttacttagcacatcgttctattatttgctgctcagttatctgtattcccccaagaccgagctcctcaagggttgcaaatcatgccatatttctttaacttctaactcttccctcacctaatttcactgcctgatatatagtagatatacaataatttttctactgattgcattatattctcatgagtatacattttttatttctgtttctatgggtgtctgttgtgcacacacagagttcccatgaaatagaacaaaggatttggggtcatttgtcctccattcactgtgtatcagttgcggcatatttgctaaccttgtcttttaggccccctacctataggtattagacccagcatgctgtgaaatccttatgattaaagtctttacactaagaagggataaggcgatggtattactggagtatccagcaaaggcaggcgtcttctgcctttctctttttttataaattggagagttcagacattgctggggaagctcactgtctctttctctctctctctctgtctgcacgtgtgcgcatgcgtgcatgcgtgtgtgtgtgtgtgtgtgtgtgtgtgtgtgtgtgtgtgtgtgtgtgtgtgtgtgaatgctgatgactctccgggaataagccagcactggggatgaggtgatagattcagaacccatcgatctgtcatagcatgtcatctactaaggaatctggaaagcattctcttcctttacaccatttcttatttatcagaaaggattcattgacttttacattgtacggaacatggattttcacaagaactgatacgttgctccttggtatcaacctttcagagcgggagctactgaatgtttaacccacatcctttctttcaaaacaaatgagcttctgtctccatagaacttttaaactttcttgtgttacctagtgtcttagaatagtgcctcagcttcagctccaacttaaagaagaaaagaacaaatggtttcatttctagttatgcaaataaactgctcattgtaaaatcatttataaatttatttatttagcaaatatttatcttgtatctgctgcatgccatgctttgagcatacaaccaggaagatagatatgatcactgcttcatgaacatttagtctagcgttactgaaaaatatatagaagcactttttaaaaagcatcccagaatctcaatacgcagacataaccactgttcacttctttctgaatattttttttttggcatttttgcccttcggatttcaggcaccagcacttcgtctattttcatttcagtatcttcaacttctttgtctattttcattttggtatctcttgcttctttgtccttcatttcccccatgaggcaaatctccaattgctgagcatctaatctttaacttatgtaatgtttggctctggcccgaaagaaaaaaaacttttcagaatgtgaattttaatcccaaggagcttgttctactttatatgtgtgagattctgaattttccacacctacgaaagactaattaagttatagaggtatttcccactgttaaattaaattaacagacttgctcattttatagtttaatgaggaggtgttaaaagttgggctgtaccttatttataatggcaaaaacgtgataaatatctaaatgcccatcaataagagactagttaaataaataatgtatccatagaatggaatactattaatgagttaaaatagtttgttgacataaaaagaaaactaatatagatggaaagatagctacaacaaattagtggctgaaaaagcagattataacatagattacaatattttgttttcatttatgtaaaattggatgcacatgtctgtacatgcatagcaagccatttgtatgcattcagtcaatctatttcttcaacaactattgtgtaagtgatgctctgtaaatacattgtgatagttgcccatgtcatggggcaaaatcagataatacatataaattgtatcatgcatatttgagggggaacatatttgacttactgaaagtacctttttttctcatctccagaataatgaactacaaagcaggttggactatttaacagaaacccaggccaagactgaagtggaaaccagagagataggagtgggctgtgatcttctacccaggtatttaggaatttcctgatttttttttttattcaaattcctctttggctgaagaaaatactttactaggctgttcttagcagaattgcattcttcctatcacaaatatttctgcaaagccgagtggtggctgctgagaggcttgactggtttctgtaggaacaggggcattgtgcagggtggaggggtcagcaaaggagagacctggggaagccatttagagagagatgggccctgtcagtgagtgaatgcatttgttccttccttccttccttcattcattcaactaatgctcttagtaccttccctgtgccagacagttatgacacagagaggagtgagatttggttcctgccccagagtacagtctggagggagagacaggtatgtaggtagacatatataacggtgtgagaggggcatccgaggtgctttagtgatatacaagagggaggatctaaaccttgaacaaaagtcatctgttcctcagtactgtaacagggtattgtcaagcactggatccagttcataaatacctgatctgcttgagtcatcggcagatatgtgataactataacctggtttgttcagttacattcctgagctagaggactgacctgttcattgttaagctgcttccatgcttgcgtctcttcctggtgacattagagcctgtaacacagtaacctgcctctgataactaactcaccattcccgggtgctcacaactgtgcctggcctcaagaggacataaaacaagtttacagcaaagatgctaatgacatgtgacttgtgatttaggtaatcaaagtcacaaaatgcctggtatcgtgtgtgcaggagggtggattcttgtgtgaacaggggcacttgtgtgtgctttgctggacatagtagtctagaaaaatgtcgaatcctggaatcttgagtggttacagctggtgggaagtagtgacgagccgatcaccaagctggggtgtggaatacctggttcttgtcctaccagccagcagcaggatgccttcagacaggttcttcactggggcctcggtttctcaacttctaaagtcagtgatttgactaggtaactgctcaggcctctaccagctctaacattgtacagtaaggcctcctttccttactttattaatttttatttattactggtattgtcatttttgttaattaaaatgaatcacttgccattctcaaagaatttaccaaaagcggcattaggttctttctttgacagtgtcctcaattacattgcttgccttctagtaaaaaggcattttttatcagtccaatataattaatagaaaatgttgaatatatatatatgtatatatatgtgtatatatatatatgtatatatatatatatatatatacatatatatacatatatatagactccggatctcatcatattcagatatattttcatatatgaaaatataaccaaaaagaacgatcaattgtgtacagagacctttttgaaatttaaataatttggccgtttcccccctttttgtatttttcaaaagccaagtggcctagtccactctaattgcccacataataaatcttgtttggctaagacgggtacaaaactatgtctgaaaccaataaattgtttgttttctaattcccgcattttggcttaaaacaagcttttcaatttgtatgcccaagtatagcctgaagcaaacttttatggctaagttatgaaaccacaaagcggttttcataatggaagtgctgacagacccttaacttatggccatggtgaacttggaagccacttcagtatctaaaagcagcttttccataaatgtaacatttggtttccccccggatccatcttagcagtttaactacctaggtcaatcagcagaggaaatgaaaactacatatccgtgtttccgaaaaggcagaataatatttcattcgtttcctcgcaaatatttattaagtgcctactatgtgaaaggcgccagggaagtctgggtggggaggagcccagaatctttcggtaactcagggcagtggccttccacctgcgcttcttggaactgccttactctgagctggggctcctggagaggcttcgggatgcccggggggatgaggagggttagtgagcggctggaccgtgggacccttcttcctccccaaaacaactgagaaagtcagcttttagtttgttttgtctgttggattccaagtaagattctgtttgaataaatagctctatgggcaaaaacaaattggaactcccggtctagttaatccccatgttttatggatgccagaactggggctcagagagatcaagtgattcactggaagccacatagccagaattagaaccaggccttcttgagtcttggtgcagtacatgtgtagtttgaaaatatgtaataaatagagagctactaaatggtggtgtgtatgttctaacaaaattcctggttcatacttggacttcaaatttgcatctaactaataaaagattccatggtattgtccagaatgttttttagatttttgtttctagaatgttttagaccaatacaagcattgaattaagcctgagttatgcagaagcgttttgttctttgtccctattcttctcctacaaggaattcaccagtgtggaacagtcagggaggctcaggctgtccagttccctgcccagccagctgctagctgagctcagccttgggcaagttacttcatctctctaaagcttcaactctttcatctttaaactaagaatgaagaggataatatcaaacctcattgggttgctttgaagattaaataaaaatgtgtacataaagcatttagagactgggcatggtgggtcacacctgtattgccagcactttgggaggccaaggcgggaggatcccttgaagctaggagttcaagaccagcctaagccacatagcaggaccttatctctaccaaaaaaaaaaaaaaaaaaaaagaaaagaaataaaaaataggccaggcatggtggctcatacctgtaatcctagcactttgggaggccaaggcagtggattgcctgagctccagagttcaagatcagcctgggcaacttgatgaaaccctgtctctactaaaatacaaaaaattagccgggtgtggtggtgtgcacctgtaatcccagctactcaggaggctgagacaggagaatagcttgaacccgggaggcagaggttgcagtgagccaagatcatgcccctgcactccagcctgggcctgggcaacagaatgagaccccgtctcaaataaataaaaataaaaatgaaagcattttagcatggtaactggaccagagttaagcacttaataactaatagctattactattaatattaactaaacccaaactctgattttctatgtagaacactatataaaatacaaaaaaatctgagtatgctaagatgatttcattaactttttattggtggtaatcattgattttatgaaatggattgatagcctgatcaagtatatagtacttcagtatgcattgggctcttcagttaaactctctagacaccccgtctagacactgtgtaaaactctgggaggcccagtgattgataaggtctctgtcagctaagacctgagagtggcccctgcgtgctgtaggcatggggcacttgtcttattgtagaatagcatggcctctcctactcactcatctgtacaactgcaagtgttacatgctgtgctactgctaatagcatttttagagctgctctacttttttttttgtcttgtgtgaaaaaaaaattgcatttagttgccgggtgtggtgtctcacacctgtaatcccagtactttgggaggccgaggcgggcggatcacctgaggttgggagtttgagaccagcctgaccaacatggagaaaccccgtctctactaaaaataagaaattagccaggtgtggtgacacatgcctgtaatcccagctactcaggaagctgaggcaggagaatcacttgaacccaagaggtggaggttgtgttgagctgagatcgcaccattgtactccatcctgggcaacaagagtgaaactccgtctcaaaaaaaaatgcatttagttgatgctcaataaacatttgttgggtgaataagtgaaagatacataccaaatgaagaacataggcaggtgatcagtattatcacatgatttatttatttaataaaggccttggatgaagtcattcctgcttatgtttcacctctttgtgtgtgtgtgtgtgtgtgtgtgtgtgtgtgtgtttctctctctctctctctctgtctcctcactagaatatgagctccatgagggcagggattttcatctctttcactaattgcattctccctgggacctccttagagcaatgcttggcacatactaggcactcaatatttgttgaatggagccatctccctgtagcatttgacaatccttcctaagaagaaaggaaggattcctcagcctatttcctacccttgcaggacttttctctcctggttctccacctatctccctggtctgtccttctccagcttctctgatggcttcttttcctcctccaagaccctcccatggtagtccacatggctctatcttggttccggtactttctgcaaagattacatcaagtctcacagcttcacctctcccctctgtggctgagccacagaagtgtgaacctttctcttgaatacaagtccttgttccccacagccttctgggcacactcccagctggtgtctgcttggtcttcatacttgccgtttcatggccgagtgcgccatctctttcttcaaagtctctcctcttaggagtgagtaagaatactggcttggaagttagacctgggtttgggtcctgagtccgcctcctgctttatctgcagctttggcaaattcctaccctccttgattctcatcttgaaaaggatgattttggtggcaatccctttggaagcttgttgagaggattaagggaagtaacaggcatagaatgtccagtggaagtgccccgccttttcatatttctgtggctgcagccactgctttcccagctacctaaactcagtatattgcagtcacttctgagtcagagaattattttgctccttgactcactcactcatactgtgctgttcttttccttcatgacttgactccttctttcccattcctcttgctgccagcctgcctcagactgtctaatctactcagtaccatctctctgcctcactttctcctcctcaaattcttcccctccttcatctaatctttgttttccataaatttctagtgaccaaggatctcttcataaagagagagggaaagggaaggggtgagaggggactcactgtgggttcaggagttcacacacacacacacacacacacacacacacaaatgtatgtgtgtatttaaagactcaggagtttagtttgaaaactttgatatatgttaattaaagccattgagaacaagtgcaggtcatctagccttcatttacaaagaaaaatgaaaaaacaaaaacgaaaggaaaagtgacttttctttcttctgccctgtagtgaaacttggtttccagcaaaccagcaaacttggttttcatcaattatgtcttaataggtgcaatatgatgaaaaatattccccatggtcataagtgctcagcacgtagtaagtgctttaaaatgcttatattttcgtatttcttttgcaaagaccagaacacaaagtagctttttgtcaaagctttatttgctgattctgctattgttttccccaggggaactgcccctttattgattaataaaaggttaacaatagcctaaatgtgttaaggcaaatggttgggtttcagttttgtggttgaggttatttgtgttcttgaaatcctgttgtttcctagtgatcaacaaaataaaataccccacttcttttttaaaagatcgggatatgagagcctgtttttgaacctagaaggttcacctttataaatatttctgcattttatgggctttcaggatattgtcattggagactgtttctgttatgcagaattttcacaggagttggcacaaatagccatctggcttctgcccctggcattccactaaactgcctggtcaggtcagtggggcctcctggatcaccaggtcccatggattgctctctgtggcaggtgacactgggaccacttacttcttgaaactcctccaacctttggtttcctttgtaattcatatgtggggtaatagctctgtggctggcttctgtgagctgctggattcatggagatgacggagatgtggctttcacccttaaagaaattatacctagcagtggacacaaatgtgtagaccaacaagtgcaataagatgctatagaggcttggcgtggtggctcacgcctgtaatcccagcactttgggaggccgagttgggcggatcatttgaggccaggggttcaagaccagactggcccacccagtgaaactccgtctctactaaaaatacaaaaattaaccaggtggtcatggcacgcgcctgtaatcccagctacttgggaggctgaggcaggagaattgcttgagcctgggaggcagaggttgcattgagctgagatcgtgccactgcactccagcctgggcaagagagagagatttggtctcaaaaaaaaaaagctatggaggtgtcagaagcctgtataatagtgatgttcaaggtgtatatggggattgggtggagaatatggagaatctcctgggggagacatgcaaagtttaaaatacaccccctgccatgctttttaatacatcctctatcacctggtgaatgactggatgtgggaagttaggggaaagggattcgactcttaggcttcatatacacattttgtcatcgtgttggttgggataaggaatgtagctatttgaaagaacccacagatcttggtggcttagcatggtaaagattaatttcccatgtcagtttaaggccgtttggtataggtttcactccacacagtctttcaggaacccaggaattcctccatctagcaaccctgcctgagctttggagtcctcctggattctccacttgtatgctctacataaaagggaagagagagagagagcgtgggggattatgtagatttttatgggttaaacctggaagtagtagaagtcatttctgcctgtttagtcacatggcccacctaatggcaagagaagctgggaaatgtagttgagttgtgtgtccaggagaaaaaagaaatgggatgtcttagtcacctaatcctgttaactataactctcaaatgtctccctaaaatctccccgccacttcccatcaagtgcttccgtcagaattcaagttgtcatgatctctctttcacctcctgaagagcaagaattttctaactgacctgccttcagaataatccttccctagtcaaccctcgatagtaccagaggaatcttgctagaataaaaatatgagcagatcatggccctccttaaaaacctgctgtagttccctgtccccttctgaactccttagccagggacatgggacccttctccaccaggcctcatcttctgccactctccattgtgaactctttgttccagtcgttccaaaggagcacatggtttgcagttccacatccacaaactgtgtgctcacccatctctgccttacacatactgccccttcttcctggagttcccatccccgctttgcccgcttgatgagtgctaggcatccttcaagattcaccttctctgtgtgaatttctagatgtgaatttcctggtggtgctaaattgttctgccctcaattttcccatcatgtgttcatgctcattttgttcaggtcatggcgggaagggaggcttgagagttaaatgaagggactgttgtggatgtttgggcaactttaagggaaataaacaagggacagtggcaggctgtggaactagcaacagtggaagctgttaccacccttgcctgaggaggcaggggagaaagctggggaagataacaagttggggagctgtagctatgggccctggtagagggatgccgccaactaccaagctgcagcctggctgggaaaggaaaaatgtcccgacctctttgtcctctcattccctgatcccctgctaccaccttgcagtaggccaaaaggaactgaatttgaagggcaaatggatgctgacttttccgggccacagagtagggtggagaaggggcagagtagggctgaatggcaaaagaagaatgcccagcacagctgttatgtctctgttatagttcctaacacagtacatgaaaattttttatgtacatatctttcccaccaggtgacaagtcccttgaatgcatgtttcatatttttctgaaccatggatgcctagtacaacctttacaggttgttaaaaataacttttttatttttaacctgtcgtagtctgttctggctgccataacaaagtaccataaactagttagcttataaacaacagaaatttttttctcacagttctgaaggctgggatgtctaagaccaaggtgccagcagatccagtgtttggcaaggacttgctttctggttcatgtatagtgtcttcttgctatgtcctcacatagcagaagggatgatgatgaatatttctggggcctctctttttttttttgagatggaatttagctcttgttgcccaggctggagtgcagtggcatgaacttggcttactgcaacctctgcctcccgggttcaagcagttcttctgcctcagcctcctgagtagctgggattacaggcatgtgccatcatgcccagctaattttgtatttttagtagagacagagtttctccatgttggtcaggctggtcacgaactcccgacttcaggtgatccccctgcctcggccttccaaagtgctgggattacaggcgtgagccaccacgctgggcctggggcctctctcataaggccactaatcccattcatgagggctccaccctcatgacctaatcacctcccaaagtccccacctcctaatacatcaccttaggggttaggatttcaaaatatgaatttgggaaaacgtaaagtccattgcagggcctgtttgtaatatttaagtgaaatattaagctgcattattgtctttttatttttaaacacttaaacaccattttctagagttgtcttaccatgtgaagcatatggggggttttgttttgtttcattttcctgacctgcattttctcatttctcagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaatgttgtctctctgtttcatccatgaccatgtagaaggggcagagagcagatcaggctctggaatgagtgtcaaagtcaaatcacatgatcttccagccagtacaattcatacaagcatctgtaaaccataagattgactgtgtgtgtcgggggagggtggggggcctatctgtctttttaattgctgaactttagttaatacaccatgtggaaaaagcaagataccttaatgatcacaaagtacaaaaatagattttacttttaaacctttcctcaaacctcccaccccttactgtctccacttccaaaaaaccaaagaaataaaaaagtaagaaagcaaagcaactcagttagataaatcactgtgagtcagaatcatgctaagaggaaaatgtgcatttgggagccacatttgtatttaaacactgtccgtgggaccttgggcgagtcgtcaaggctctctgaatattagtttcatcctttaaaaacctcggattatcacacctacttgataggctgacgtgagtgccacatgaggtcattcccacatagggagtgggcactgctaggcacacaggcagtgattgctgtcattctggaggttttagagcactgctgattgctggttgagtctcaccactggaggtattctagcagcaaaaaaccgtgttctgtggcagccaccaagaaggagcacttagagaaaaagctgtccttaggaccaggagatagggaagctggactcagagagaggcagagggttctgggagcccatccccctgaagaaactggtctggaagcagtttctaagtgaaatgcaatgacttaaaaaatgtcaattttaatgagaccaaggtagaaatgaaaactactctgccaatacttccacattcacttctttctctctctcttaaaacaagcaaggaaaagaaaaacttagtaattttaaatttaaaggataccagggaccattctgcagctcgggcctttgtattttaaaatatatcttcaacatatggaaaattctaaacatgatttgaactactcaagaagactattaaagagagttcctaaattgtacagactgaaaccgaaagaagctgagagataatccttccagatcctttgtcaacattgactctagtgccccccaaccctccatctaaaggactgacattcatcaacctcttcatgagcaggggtattacataaaattgggagaatgaactctaacatttcatagtaaatttatctcactgaaatggaaagcagcagtgtatgtaaagggtttttaaaaaataaaacaacatcctataatcttccaattaatatcttcattccagaccttccagaattttaaaacacacccgctccattttgtttttaaaataaatataaccctatactgagaagtggaatcatgtgatttttaagaacgtgggaacactcgagtcagctatctgagcttagtcactagtgcgcatgtgggtaagtcacaaccctgtctgagggcctgtaaaattggaactgtgagagttctttcctaatggggttggtgtgaagagtaaatgagttaatgcctgcatggttcttagaatagtgcttggcacatgataagcacttaatatatgctacctattaacattacatacttttgtagccactttttgcttactttatatatatataaatatatatatacacacactttatatagtttgctttatatatatactttatatatagtaagtttgcttactttatatatatacatataatatatatttttgcttattttatatgtatatatactttatatatgcatataatatatatgtatacaatatacataatatatattatacacatatatgtatacaatatacacatatattatacacatatatgtatacaatatacacatatatattatataatatatgtgtacaatatacacatatatattatatataatatatgtgtacaatatacacatatatattatatataatatatgtgtacaatatacacatatatattatatataatatgtgtgtacaatatacacatatatataatatgtgtgtacaatatacacatatatataatatgtgtgtacaatatacacatatatatgtgtgtacaatatacacatatatatgtgtgtacaatatacacatatatatgtgtgtacaatatacacatatatatgtgtgtacaatatacacatatatataatatgtgtgtacaatatacacatatatataatatgtgtgtacaatatacacatatataatatgtgtgtacaatatacacatatatataatatgtgtgtacaatatacacatatatataatatgtgtgtacaatatacacatatatataatatgtgtgtacaatatacacatatataatatgtgtgtacaatatacacatatataatatgtgtgtacaatatacacatatatataatatgtgtgtacaatatacacatatataatatgtgtgtacaatatacacatatataatatgtgtgtacaatatacacatatataatatgtgtgtacaatatacacatatataatatgtgtgtacaatatacacatatataatgtgtgtacaatatacacatatataaatgtgtgtacaatatacacatatataaatgtgtgtacaatatacacatatataatatgtgtgtacaatatacacatatatatgtgtgtacaatatacacatatatatgtgtgtacaatatacacatatatatgtgtgtacaatatacacatatatatgtgtgtacaatatacacatatatatgtgtgtacaatatacacatatatatgtgtgtacaatatacacatatatatgtgtgtacaatatacacatatattatgtgtgtacaatatacacatatattatgtgtgtacaatatacacatatataatatgtgtgtacaatatacacatatatataatatgtgtgtacaatatacacatatatataatatgtgtgtacaatatacacatataatataaaatatatgtgtgtacaatatacacatatatattatataaaatatatatgtgtacaatgtacacctatatactctatatgtgtacaatgtacacctatatactctatatgtgtacaatgtacacctatatactctatatgtgtacaatgtacacctatatatactctatatgtgtacaatgtgcacatatatactctatatgtgtacaatgtgcacatatatactctatatgtgtacaatgtgcacatatatactctatatgtgtacaatgtgcacatatatactctatagagtatatatatatactctatgtatattctatagaatatatatgtgtacaatgtacatatatattctatagaatatatgtgtagaatatacacatacattctatagaatatatgtgttcaatgtacacctacagaatatatgtgttcaatgtacacctacagaatatatgtgttcaatgtacacatacagaatatatgtgttcaatgtacacatacagaatatatgtgtacaatgtacacatacagaatatatgtgtacaatgtacacatacagaatatatgtgtacaatgtacacatatataatatatatgtgcacaatatacacatatataatatatgtgtacaatatacacatatatatgtataatatacacatatattatatataatatgtgtatattatacatatatgtgtatagtatacacatatatattatataatatgtgtatagtatacacatatatgtataatatacacatatatatgtataatatacacatatatatgtataatatacacatatgtattatatataatatgtgtatattatatacatgtatgttatatataatatgtgtatataattgtatataatggatataatatatactatatgtatataatataccaatagtgtatataatatatacgtatatatattatatatagtatataatatatacgtatatatattatatgcgtatatattatatacacctgtgtaatatatgcatatgttatatacgcatatgtaatatatgcatatattatatacgcgtatgtaatatatacatatatatacgtgtatataatatatcatattatatattgtatacgtacataatatatcatatataatatacgtatatatcatatataatatacatatatatatcatacattatataatatacgtatataatatatcatatattatataatataagtatatcgtatatcatatatcatatattatatatgtatataatatatcatacatgtatatattatatacgtatattatatatcatacatgtatatattatatacgtatatatcatatataatatatgatatatacgtatataatatatacatgtatgatatatgatatacgtatatcatatattatatattatatacgtatatcatatataatatatactatatcatatatatgatatagtatatattatataatatattatatataatatattcacatgcatatatatgtgtatatatataaagtatatatacatataaagtaagcaaaaagtatacatatgtattatatatagaaatatatacatatacataaagtaagcaaaaagtgtatatatactatatatataatctacaccattgcttcttataggtaattggattccattttttgatgtcccataatttatttgacccatcccttagtgttggaatcttggatgttgtcttcacttttcttcagcagtcctctgatgaaccatcttgtccacacgtttttgcacacttgactgattattttctcaggatcagttcctagaggaattgtctggtcaaaaggtgtgcacacttttggtgcctatggtccaatacggcctatggaaatttgaattcattgaaattctcactaacaggctgagaatgtgacttcctgactcttttgccaacatgaggaatgagaaacagagtgtacaacatggctttctttaggcagacctgccccccaaacaggtggtgaacaaagttccttcagcatattgcctgtggatatcagaactcagggacatgcaggtgtgagctgcgggcctggaggtgtccctagggcccagagagtgcctgggcagccgacgggaaactggatggactcagaaggagcaagtgtccctcaggatccaggaatcaaagaaggcctgccgcttagtgagccagcatcaagagcctgtcactcaggccacatgcctaagatgcggtttgactctgagtggggcatgccccctatttcagggatagcctgggagagaggatcaacatttgggaagtgcttggagggtgcaccaaccaaggctgacccctgagctggtccatgtgtccactgtgagcacccactttcttcccagtgaatgccatctgcctactccaggaactctagggtggtcaccagggcaaggagtgggggtgataggaatgggtcctggctcaagtcccactgggccatggtgctcttcttgacggccagactgagagggccagttcagttcacccagcacatgccaggtgcttggaagacaaagaaatgcacctcgagacccttgctgtctccaaaatcttttccagcaagtccaggccctcctgatctttcccatctctgaatcccaggggaacttattttcagccccttctttattcttacatctcatgaccaatctttgtgtacatttattatctctccagtgacataaactcctcaggggcagtgtcccataaggggcacactagtcatttggagggaagccattgtaaaccttgataagcatgaagaaatctacaaatgaggagtattccagaaaaagcctcggctttggggaagtaaataataccaggagttactgagctggacacagcacacatacactgagtctttacaacagtcctgcctggaagatgttatcaccaccatttcatggataaggaaattgaaactcaaaaagatgtgaaaattgtctgaaaccactcagacctgtctgatttcagaacacaggtgggaggcctggagtcagtcccaggtctgccattaaatcacaatacctccttggtcaggtcactacagcactctgcagctccgtgccccaggatgcagctttttcgatgaagtaaatggaattgcatcccccacccaggcttgctgcacagatcatggcatagcattgacaaatttcctagcagttcatcagagatatgccaataattgatacctgctactattactagtaattaccgggaagccagtattgcaccaagaatatttgcaaacccaaggatttcttcttattggacacagagattgaatgaatgctagcgaatggaattgtgcagaagacaaacaggagtgagggaaatgctactggataagcaggaggttaaataaactgtatctccttttgtttagatgtgaatttaagaataatctattttactttgtcagggaaggaaaggcctaaaagggagactaaagatgagttgctaaaaaagagagaacagaagcaaagagaccagaaggtgagtgctgctaaagcttggggtaattcgttaggcaggattagataactaatacatggtgtgaaaaatatcgttgcattttgtttttgcatgcaaatatctaattgttttagcactatttgttgaaaagactacccattttccactgaattgcccttgtaccattgttgaaaataaattggccatatatgcataaatctatttctatactctctatactgttatattgggatctagttgcttatcttgacactaatactatgctgtcttgtttgctgtagctttatcatcggccatgaagtcaggtagcacaggctctctaattatatttttctaagttgattgggctattctaggtcctttgcatttctatatgaattttacagtctgtcaatttccacaaaagcgctattgggattttccttgggactgcattgaatagacaggtcaccaaggataacatcaagaccttgctgtgtcaggccagctcctagcaacactgcagcccaagttgggagcactaggttggctcctggatgtcagtgactgctcttctcttccttagctggaaaggtactgggaaaaacctccatagtgtattttggtaaaggtatagtataatctttgtgggattccgaacaaaatattataagaaacattcatttgtgcccaagggccataaacttggtgtaatctgaatgcaataaattataaataaatggcaaacagttcttgatggttttctcttaatttttcaagttttaacatagagcgtttacaggattcaccttcctgatttagggatgggaggggggttgagaaataattagtaggcaattttttggccctgggacttttcttgtaaatgttttctttggcagccatactcttgagaacaggaagttactctcttgttacagatttaagacttttctgagccaaataacagaaagctggattagttctgaaatgaagtggggggaaaaaaaacaactctaggctcttgctggagattaatgacatcttacaaatattttaattctcccctttcctcttaacttgctacctcctaaacaaaacacactcagactgaaaaaaaaaaaaaaacaaaaaacttaactgatcactttgtagcccaaccttaaaataaaatatctttatggtgcccacaaatttatgtaaacatttttggggtgttaaagggaaggaaaatagggctgtcttaagtcgatcctttttttgttacaaaatccccaatatgaaatttagagcataaaatgtagttgtaaagatgctaatttttctatgataatcacacagattcataattttctttgatctttttaaaatggcttttaaaaatagataaaagtgtttaatcaagctttgaaaactatgcctatatgttgtttgagatggttgcaaacaattctttagaaattgttccaaatgacaggattatatcctttgactagagcatctctgactataaaacaaaggaattatttcctccaaaaagactgagtcctcacagaagggcatgctgaggtagaaataaaaaaaaattaaatttttacacttgattctaaaaaaaagttgtaatcttaatgaagttcataatctggaggaacattaattccgtgaattatctgagaactatttgtgaggattgtttttaaaattgctttaaatgtaaaagtttttattttttgcaaggattcttaaaacacagaaggccttataaaaactttgagattgagaagtaaagaacgctttcctgtaacaagtatatatcttctactagtaatctaggaagtttctatggtattaattgcagcctcagaaaataaaagagttggtctaagtgttttatttgcacttgcctcctgcacccaaattcaaatgccctggtacccaagaagtttgcctatagttgagaagggtaggataatagggccagtagctgatgggagcaggggaggatgcttccctgggctataagaacatgcctatcctaaagtcactcaaattcctaagtctgaaaaacactgtgctgccaaacacacccatctgtaatttgaatgtggccaaagacccacaatttgccacccttgacttgcattatctaatgtttttctttctgtatattatgaagaggatatttattccttcatactaactttcttcagtctgcttgaggtgatgcccttccacatcattcataatagtttcttgtcttctactattattgacaacttcacttttttaaccttataaacaattttaaattactcggagctgtcatccattagatataaaaattaaatggagcccaggaattctaggtgatgggaaacattatccagggctgtaagacatgcacaactatgggagtccagcaaaggctgataagcctggagctccagcaatgttgggtgagcatttatttaaagggagctacttgcttcctggtttgactgcataccaaatatatcttctcaacatttatgagcttaaatagatgcagatgttgccagagagtgtattgtaacattcatcatcctagaatcatataatttaagtgttgagaggcatcttggacttcggttcaatactctcattttaagcaggaggaagctgaggttcagaagagttaactgacttgccacaaagttagtggtccacaaaccctgccccataaaaacattgttgagggttgacaaattttactaccaccacctccgttctctcatctggattgctttaattgtcctatacactatgcttgactattatctcctcccaattttcaagaagaaaattaatgagaatttttttttcctgaataattcttctttatatttcgtgggcatcccttacttctctccatctccccactgttgatgattttcagagctgtgttctttctcatgtaagatggaaattaaaggtgaccagacactgattttggccaggtctagtgagaggagaggggttagtttgttttctctaactctagcctgctgctgatcactagtttatttatttcatggcctctgatggacatcagactccaaatagtgagagccatggtgtgctgacactgtagcagaaatcagttctttccatccactaaaaagacaactacctccttggtgaaacctgaaatgatcttatgaaatctcatcctgtagtgactttgcaaattacctcactcctccttttctgttttctcataaatatatgtgcagactgtctttcctcaaccacaaaggaagtgtaaacatagtttatctgatgttttatgaattaaataatttctatagccagacttatatgatgtacttgatgttttatgaaaaatcttcagtgaggcccatttaagtgtaggacagtctgccctccagcatagaatttgaaccaattctaagcaaagtttggctgttatatcctcctactttcctgccctacatactctccaaatcctagagatgagtactctggggtcttcctattatcctaaactcactgatgtaatagtctgtctggtgtgttcttcttctcagattactcaaaattctctccattttctccctttccctcctgaacaaatttcactctttgggtttaggtcatcatctcagctaggctgttatgaagaagcattttggaactaaataatactcacgtgtaaatgactaatagatcatttatgttctcaaaggaagatctttgttcaccatataatcttcttattggtggaatttcactcaatgtgtcaaagggaaggaaaataagtcaaggagaggggaaggtatttttaatcttgtttaagattttatgtcttaaactgagaggaggggccttagctacaatgtctatatagtctgtgtcaaagaccgtgtgctctttcaaggatttttttcccagtttgtgagttttttcatatttaaaaatcttacaaagttttattattcaatcacaattcagttggtcacatatctaaccagcaatcttcattaaatttattaaaaagtaaacttacatgaaatttcagagtaccaaacatttaataatttaaaaaactatgtcttcccacactatcaagatcataaaacacagtggtggcctgaaatgggacattcgtcactaaaaaacacttcagccatgtgacggtattaacagaaaagggttcttttccaccaacttgaacctcacttggctgagattttctcaccacagtctttgtatttttttttcccatgggcaactgcccccttgattaatcccatttcccttagtcctagtttttccaggcagctgagcaaacaaagatgcaggcagccattttaacgtgcttcctccctcaagccctctgggatgggccgtctgttcatcctgttcataaaccaacggcctgaatgggcttggagaaagcagcaaggatcttctgtcaggattaattttaataggccatagtctgtcacccgggaaccatagcccaggcaaatggctttaaattactatttgctgataaaaagggagatatgagctgaaaatttggttcctcatttaaaacaacttggataactaatgcaagaatttacttttagtgtggagtgcaggtactttacagcctaaacccttgggtagctgaggaaaatcttttgttgccatgggatcacagtgaaatataaagaggggaaatgtggcagtttgtagaagtatagaattttagagctggaagggaaataaaaaatgtatctgtgacttcctaaggacttacgtttagagctttatatttctgatttctgtgcagagaaacgcgattcctcttattgccccttctacttttttgtctccctctttaccaattcctttctctttcctttttttcactgtttttctcatacccaattccagttccttgttccttcccttggttcctcatccctcaccagccaggctcctgtcatttctctgtgaagctctgcactggggggcacatgaggtagcgtggtgaatgtagcccctaggcaaacaagtcaggaggccctagctcttgtctcttcccttgtaaagtgtgagaaggcagtttgggggactgactggaagggatggttttgtaaaatgacacactgatgtcagccattattgttcaataaagtcctctgtgtaccattcataagtaatttttttattagctatggccattgttttggtttgtttaaaaattcagaatgtggctgggcatggaggcttacatctgtcatctcagcactttgggaggccaagatgggaggatcatatgagcccaggagttccagaccagccctgggcaatatagccagaccccatctctccacacacacacacacacacacacacacacacacaaatcagctgggcatggtggtgcacaccagtagtcccagctacttgggaggttgaagcaggagtaacctttgagcccaggagtttgagactgcagtgagctatgattgtgccactgcacttcagcctgggtgacagagggagactctttctcaaaaaagagaaaaaaatcagtgtgttccatactcaaatggatgcttccaagaaaaatcatggaagaaaatagaatttgcttcatacttctttatgacccttggttcccatctcttcctttccagccagctcccctcaactctcatagatcatatcacttgttcatggagaaaatgttctccacattcctttacaaacatgactgataccataaaaaatgtttggtgcaagttctgtaatctttcttaaatagcccagcctgggcacttgagcaagaaggctggtggctaaaattaaacaaaacataacaaaaccaaaaacaggctgggcgcgatggctcacgcctgtaatcccagcactctgggaggatgaggcgggcagatcccttgaggccaggagtttaagaccagcctggccaacatggcaaaaacctgtctctactaaaaatacaaaagattagccaggggtggtggtgcgcgcctatagtcctagctactcgggaggctgaggcaggagaatcgcttaaacccgggaagtggaggttgcagtgagccaagatcatgccactgcactccagactgggtgacagagcaagactacatctcgaaagaaaaaaaaatgcaaagaacaaaaacaaaacccaagtgtcaatgaagatgttgagcaacttcattgctgatagagtgcaaaatggtatagatactttgtaaacaatttggtagattcttagaaacattcatttaccctatgacctagttatcccactcccaagtgaaatggaagcttatgttcatgcaaaaacctatacacaaggtttatagtgacttgattcataatcagcaataacttaaagcaaataaatacctttcaactgtttaatgtataagtaaactcctacaatggactactatacccatagaatacaacactacttagcaataaaaaggatcaggttactgatacctgcagtggcataaatgaatctcaaaaccattatgctaagagaaagaaggcagattcaaaaggctactgtatgattctacttatatgacattctggaaaaggcaaaactctaggacagaagacaaaccagtagttgccagggataggggttcagtggagaggctgactacattttggggggcatgatagaactgttctatatcatgattatggtggtcatcacaaaactgtatgcatttgtcaaaactcagacctgtacactaaaaagggggaattttactacatgtaaactatatcaataaatctgacaaagaaaagaaatatacagtattaatttgcatgttattcattttaaaataaatggtattgttctgcaacttgcttttttcacttaaccttaagttttggagattaaaccttgttgaaatctgtagatttagttccttcattttaattgacgtagttttcaatttttgctaccactataaacaatgtggcaatgaatgttctgacacacgtcttctttagtacatacaccgagtttccttaggaaggctagtacataaatgctgtgtgttggattgcagagtaggcacgtcttccagtttactagatgtgactgcatatctttcctaagtgtttctgccagttcagtctctgtaacacatgagctcctgtttctccaatcagaaagagtttggaatttttaagatttttttactttgcatttccctgaagttgaggatccttttttaaagcatgttttctggtttttccagtttcctcttctgtgaactgttcgtatttttcctttttttttttctgacttgttttgcttattgatgtataagaattctttttgtaaagtgtgagtttttgtattctggatgccagcttgctgtttatatgtataatagcctttacccttctacactacagaagtttttgccttaatgtagttaatttacaaattatttcctgtaaagtttgtaaaatgtgtcttaagaaatccttcctaaacttgtgatcattgaaatgtttttctgtaaatattatttttcaattttaaatagtagtttgttaattcctctggaattaatcctcatgtctattggaagtaggaaactatttatattaatactttttcccatatacacaaccaatctctctagcactatttatgaaaattcactctttcctcactaatcttaaatctcaaatcaagttcccatatatgcatgggtctatttcggtgttctctattttgttccattggtctatttgctgcaacaattatataaaattaataaaatgtaattaaaaggccaggcacacagtagggccaaagcaaaagctagcttcccccactcctcagtcagctctctaaccctaaagtctggtcatcagtgaagtcttggtttttctaaaagaatgatgctgtttggctcccttgttggtgatctttattcccactgacttcatctggtccaaatctctggccagcctctcctttaaattcccttttggtactagctccccactaatcatcaatctgctgcctgcatacccccaacttggcccagtgtcactatggccaagtctaggcatagaggctggacatgcttctgcattgccccataacacccccaccccctcattctccagcaatccccatgtggcggtcgggccatttctcatgctgagaggcccaacaagtgtgaagttgaacactttcagtctttgtacattgacactaatgtatcccacattagtaatccaagtgaaggaagcaaaattaaatttcttaaagaaaaaaaggctgggtgtggtggctcatgcctgtaatctcagcagtttgggaggctgaggcgggcagatcgcttgaacctaggagttcaagtctagcatcggcaacatggcaaaaccctgtccctacaaaaaaattaaaaaaaaatttagcggggcgtgggacacacacctgtagtcccagctacgtgggagggaggctgaggtgggaggattgtttgagccaagaaggctgaggttacagtgtgccgacattataccactgcactccagcctgtgcaacagagcaagacccgtctcaaaaaagaaaaaaaaggtcagaatttaagagaggaagagagggtcgaaggagggaaatacaaattcagttttggacaggttgagactgagaaacctttgagacattcaggtggtaaggcctttaccctgactctaattctagtcccagagcaaaaccccaaaagactcctgtgcttaaaagcctggagagattggtaccttggaatttatggtaagagagagttttaagagggagaaactgctcaacagggtcagatgctgtgagaaggggaaggactaagacatattccttgaatctgacagccatgaagggatccatggtgcttgcaagatggtgaagaaatggagtcagagaatgtggacaattcttttaggacgcgtatctctgaaaaaagaaggcaggtggaagctgggggcagcttttaactgctttattggggtataactgacgtgctatacactggacatatttaaagtatacagcgcaataagttttttttaattttctctttttatctctagaagtaagttttgacttatcaaatgattacacccatataaccatcaccgcaattaaggtattgagcatccccgtcactcccaaatgtttcctcctgcccctttgtcatccttcctcccagcctctccctgacaccccacaacatccgataatcactgatctgctttctatcactatagatgcgttcgtattttttacaattttatataaatggagtcatacggtgtgtaattttttcctggcctctttctcagtatactcgagattcatcagagttgttgcatgtaccagagtattcgatcatatgcacagactacaacgtgtttatccacttacctactaatggattgtgtcaagttttgggctattacaaataaagctgcaatgacacttatgtgcaagcctttctattaatatatgctttcatttacctgtttctcttaggtaaatacctagcagaagaatggctgggtcaaacggtatattttaagaaactgccaaactggtttccaaagaggttgtactattttgcattcccattagcagtgtatcaaagttccagttgctctacatcctttacaacacttggaatggtcagtctttctggtaggcatgtactaatatctcattgtgattttattatttattttttcttggatatagagtcttgctatggtgcccaggctggtcttgaacttctgggctgaagcaatccttccacctcagcctcctgagtagatgagattacaggcatgagccaccatgcccagcttctccatgtatttttaatttgcattttcctaatggctaataacactggtcttctttcatgtgcttatttttcacttatatatcttctttggtaaactgtcttttcaaatcttttattccctaatctggaaagtggtgcccatcacttctaccatatttattagaagtgagtcagttaagtccagtcaacattccatgggagaggattacattggagtgggacactgggggccatcctagaggctgtctaccacgtgtggcttcccatttcttttagggtaaaatccaaactccatatcctggtctacaaagccctgctagatctagccccagccttccacattgcttttttttgttatttgaacatgctaagctccttctccttttacggccttagtatcttctcttgcctctacttgggatgtttttccatcagattttcccacagttgatcatttgtcatttgaagtcccagcttaaaagttacctcctcagaaaacccaacctcagtcacccaatcaaagtagtctaccagtcactccttatcaaatcactctgtactaattctctatgtgactcttagtactgatagaataaaagtttcaatgtaacaggaaatttctttacctcattcatcgttatatcaccaaatcctagaatagcgtttcacttgtgatagacgctcaataaatatttacttactgaacaaatgaatgagatctccaaagaagcaagaacagatgggatccatagtatagctgaagggattaaccttggataaagttcctgtgactactgctgtttaataaacgaccccaaatttagaaaaggcatagtgaagatgtctctgctccacaatgtctgaggcttcaatttggatgtcgtgaaggctggaagtgactggacagttggggctgaaattatccaaagttttgctcactcacatgtctggtggttgatgctacctgttggctgaaacttcagcttgggatgatagccaaaacatctacgcaaatgcagacttcttcatggcttgcttgctgagttccaagagtaagcacttcaagaaagctaggtagaagttgcatcaccttttgtcatctagactagaaaaatcacttttgctctagttataagcacgcccagattcaaggatagagaagaataaccccatttcttgacaggaggagtgttaaactcacatagcaagaagaacacatttaggatgggaaatattgttgctgccattctggtcaactccaactatatcatggccagttttgtggccattcatgccccaacaatgacaatcaaagcaagaaaacagaggagaacagcctggaaattctaaacatttatgtttatcagttttacaattgattgtcagtttttatcttcaactaggtaaggacaagtggaaatcattcccaggtcttgtttttgttcagtgtccttgtgtagcttcgtggcagtgggatgtctataggtcatcttggcagcacctcacgtgactaatgaaattttcctttcccttaattctgttttgaattttccttcctttcaaacgcagccaaatttattagtttactctgagagcaacattcaggagattaatccaagtaccactggaaaagtgattcatctttttaatgagcactgaaaaacacaaacaaaaaaaccccaaaacacttgcccagattcatttttataacggatgggctctttgacaggcaactggaattctttagcagagattagctgtctgtggtttgtgggctccatttcctttcaagtgtttggttcagctgcaaacaggtataacctgtagcactcattgtttctctctttagtcttcatttctccattgttaaatttctccattttatatcttcttctctagacactgctgtgaaaatttgtgtcctagatatttattttttgtttcataaattataaaagaatactttgcctattttccttttgaagtgtaaataggctgcaagtagtctgcttctgttgtagagtgatgttttccacttgccatgcttcctggttactgacaaaattagacagtttgtgcttggatgctggtgggaatttagatctgtattatgatatcttgaagccctaagccatactgtataaaagattctatcccaaaccactgaaaaatctacacagtaatgatgattaattatataaaaagcttaagatttgcatataagaaacatttcattaagagaaagaggaatatgggggaaaggtagagaaaaaaatatgagagaaggagattgtgtcaattactacatgctatgttcctgagaggagacagaaaaagtacaattatagctccctcacagaaaggactttacaattttgttaggaaaggaaaaagaaatctcgatgcataacacaattagagaagtataatatgcttcatgcagtgaggttccaactttaactaagccctataattgtgctgaaaagaaagagaagtttggtttggaataacatgggaaggttcagggaggaggtgagacttcagccaagacttacaattggcaaggggagaagagatagccttccacaaaagggtaacagaagggggcaaaattctgaggcctaaaagaaaggcatccttgccttggggacacctgtggcctacaatcagcacatggggagttcactactgtgggagaaataaaggcctccagctggggtccaggggtggggtgagggaggcttgcggggtgcttatcactgtaaaccaaaaataaaatttgaaggtccgccctcaaccgtctgaatggacttcctcctgtagtccagggtcctccaaatttaacctaaaagactggcttaggccatgatgggaagctgaggtcagacatgcctcattatgcccttctttcttttagaatccaggaaaagctacacagcatttaatatcaacacatataccttgagtctgataagaaacacaacttactttctctgaagcctgctaactggaggcttcatctgcatgataaaatttcggtctccacaagttcttatgctaacctagacattcctttaaatcaattaccaatcagaaaaaaacttaaatttacctataacttgggagcccatcttgccccacacccgctctgctttgagttgtcccacctttgtggattaagccaatgtttatcttaaatgtatttgattgatgtctcatgtctccctaaaatgtataaaaccaagctgtgcaccaaccaccttaggcacgtgttctcaggatctcctgagggctgtgtcacgggccatggtcactcatatttggcacagaatacatctcttcaacattttacggagtcttttttttttttttttgtcagtaccacagacaaccacctgactcgaggaccttacctatttctcattcagccaatgctgcagcacgttattaacgtccttgaaagcaagtcttatacagagaaaacttattttgatatattaatgaatctgatcagaatggaccagattggggggatagataaatggttgcaattgtgctccctggaatagctttggagtttacctagatcttctgtctctttaggacagagctgcttgtgtttatatagcatcttacacaggattgagacaacttcaatttcctatatcaaaaaatcgggggagggcggtgggttatgggggtgttcaaacctcccaagtgacatctgctgtgactgcatgtcttcctactctttccactgggatgcacctctggtagctgaactataacgagaaggtaaaagctgtgtccaatacctattaagctgccttcttctcaacagctggggaggtggcgggggtgggggggggcggagggaagtcttttcaacagttttacacatttggaaataggcctaaagtgaagaaggggattttcaaattggtgtgttggaaaaggggctgggcttttgagtttgaaatctggtgctgtcacttactggttttgtgccctgggaatatttatttcagttttcatgcctctgtttttctataggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccaggtgcccatcccaacgttactattatatcataatttgattctccctccccccatccccccgccaactctgtaaaccccaagtataacacaggacgttgctatttgttgactgacacatagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccaggcacgtatgcctgcgaggatagctcggattgaacggctacctggcgttgcagggagttagtagcccctggtcggttttatttacccggggactgtggtggttccatgagtctgctttctaaacccttttgtcgcccgcacccctaacccataacagattgtcagcttcatctctggattctaagcttacaggaaccgtaggaaatgggaagagtgggatatgaagaggggtttattaggccgggaaagttcgaccctcattcagctggctggttgaacggattttagcaagggagccacgtaataaaagtgattttgttttttaggcagctttgttcagcagcttgttgcaaaagatggtttgaaggaataaaaagcagaagacagtagaaggatattttcagagagacttcccacgagacacttgtaagaaagtgagctaggaagggattgggagaacttttaagcatggactaatttaaatgcagttgacagagatggctgaagtttccaatctatatggaagaccactagcaaaaataggaaaattcagggagaggaatagatccaaggttgattttacttagggtgtgcagagttgagaggagagcaggacagacatttggttaatcgaaaaccaaacacttaaaagctggagaagtagtcatgaggctcaagaaagagagaaccctggaaaaatacagaaaacaggaatttcagctgtagagtgttgttaatagttgaaattgtggggatgaatgtagtgtcaaaaagaacagaggacttaaggtgtaattttttctttccatttattgtatagttaaagaaaagggaatcagaaaaggaactctgtcatccagcaaaagggacaaataaataattggttgggatcaagacatgtgttttgaccttgtgagaataggttttgaatgtatagcagtgaattaactttttggtctcaggactccgttatactttaagaattattgacatcccaaagagctattttatgtgttgtatctagcgaaatgtatttacttatcagaaatacgtctgaagtctttaaaacataagcatacacaagcacacattctattctagaacaatgatgtcatcacatgccatgtagcctctggaaaactccactgtacccatgcgagaaaatgagagggaaataatatcttagtattattatgaaagtagttttgacctaataggcccatccccacactccaccccatccccaaattttggagattgcactttaatgactgctggttcttggaatgtcttatgtgattattatatgcttaaaatacttttgctgaaattctaatttgctgagacaaatgaggcatatattccctattcttcctgcattcccttgttttttgggctatttggataatgaccattttaattgttttattcttgttttggggcagttagaaatcagatatttgacttaaaaatcagcttttctttctttgaagataatgccttgcctttttaatgttatatctcaagttaaaaaaatggctgtaatgtaatagtattcttttccatttgacagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgtaagtaccctcggaaacaggcctgtaacaggaacgtgatatttgttaaactcaaaaatttacgagaaactgggtgtggtggtgcttgcctgtagtcccaggctactcaggaggctgaggtgggaagacagctttgagtccaggagttgtagaccagcttgggcaatataataagaccttttctcttaaataagtcaggagaatgctctaagttccgtgggctttgtatgagaactacttgtagttaggaaataacatgttgtggcaacactgagaccagcctggccggagtagaagattcatgttgaaaaatatttagttttgaaaccaaataatcgacaaggtcttttaaagcacatgggggagtgttaaattttaggatgcttagccagtatttcataataaacacagagttggagagaatttattatgacttctttttttcagaaccattttttagtgtacagctttgattagtgtactatcaaagtgtactctctttgattagtctgtgaactaagggtaaagcaattgcaggagctgatgggctttccagcagaaattatttgcatgctcactgtatgtaagcaagcagcaggtgttgtggggacacaattaagtcaagattcttaaaactcctttgccttttttgatgttaaatctcaagtttaaaaacatggctgtaatgtatacatgtgtaatgtaatacaataccatgttcttcaaggagtttaagagctacatgaggacccaaggtttacacacttggaaaagagttaagctacataataataacagtttcagggggaaggaagctgagaagaggtttgaaaaactgtgaaaatagattcaggcaggataggcaaaaactctgcttatcagttccttgccataaatttgtttctgaaatttcaggaaaagtaaaatctttttgaaaataattgctatttacttgcagcaaatgtaacattcaactcaggtaactggtaccttcttcctatattgtatttacaagtatgtaacatcaaagttaaatcactactacctttctttgaaaaacagaaaacctctagtgaaaagtatctaaaacatgcttcttttttgttagactttaattctaccccagcattcattttaacctcaaaacattttatttctgctgtatagaaaatcaggattatactacattaacgtgatcaagtactctcttgtgtacagtggggtatctttcttcacttccaggatgacattttagaaaactagaaccatcatctagtcaataaataaaacaaagaatacattaatcccagttctgtattatggtcatttagctgggagtgggagagaggtaagggaatagtgaagagggctaccaagaattcaggaagtttaagagacagggagcctcctgtataagttagaggagaacaggaaaggcagggctttgaggagtccttaggccatagacaggtagggattgagagggttccgtgtgagaggtggcttggaggttggaaggtggggtcaggtagtgtcctttgggtcctttctgctcttccttctgcatactcttctggcttcatgtatcacctggatgctggaggctgacccctgtgcacctctatcccagatcttcccagaactttaggtttgcatagccaattaaccatgaaacttgatcacttgggtgttcccaggtacctcagcttaatgatgtacaaagtggaactgcagtttctttccaaggtgatttccatattccctaatagtgccaccaccttctcggttttcttcccctaaggtatcttcgatttttctcatctccatatctgctagccatgaagacctacttatttctttgatcttcatctctataattgttcttcatcttctgtcgaagtgaagactctcatctctctcgggctgtaattgtggccccttctacctctagtcttaactaccagtctatctccactgctgccagagtgaaatttgtaagatggaaatccgaacttgttacggagaactcttcattgcagtctgggcctaggctacttcccagccctctttctcgctgtcttttctgtgtagccagaaaagctgagtctgtctaccttctgtactttctctcactccccttgctgggatgcacttctctccttatttacatgggtaagcagttattattccaagactgttcaaagcttttttgaaacttttcttagcctccctgtctcccactagaactggccatttccttatgttccaatgtatcttgttgagatatctatcacagtatctctggtattgtattgcactgaaactttacatgtgtatttctttctactgggcaataagcccttttgcaaatgttctttgaataaatgaaaaaaaaaaaaaaaactccagatgaaatacaaggtttgaataaggaaggaaaaggcaaagagcctgtatgcacacaaacacacccctatttgttagagcaatgaatactggtaaattacttactgttacctttggaggagaattaattgctaaggtaaaggccatttgtgtgaatgttttaaatgtgtctacaaataaaataatctgattgtataacacaagttttcctttcatcaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggtatttagagtattttttttcttgtctgtttgttgggtgctgcttacataagctagaatttactccaggttcaaggaggaaggaatggaatagaggggattaggtgcttccatgagctcagatctatgccactagttttcagagagtcacaaagttgctagaactgcaggaagtagctagagatgatcacagctaccttcaacattaaagtggtgatttgcctggagatgtggggagacttgtagaatttcatgtcttaaagctcatttacctgcctgttcctgttaggatagtagtagcatcgcatctctccctttcaccttgtaaaactcatgtgacagcttctcagtggcggactcaaacccagaccccttgttagagaatgaggagaatgtagttcccaggcttccatcttctgcagtacaggggagggcatagaaggagtgggaggataatgttgtgtagccagcagacagtgagacactgctttagagcataatctgcaggcccatgtgaagagagaaatatctcctgcttttggcagcttaatcaattttgcatagcactttgtttccatgtgttttgcattgaacttcaaacatgtatgttgagagtttgtatacagaataatgggatgggagaaaataagtgtgaaggaccataggggaacagaaaagtttagaagtatttagtaataattttagcctccaggagaacagtatcctgtctcacttcctaggtattgattagctagattttagtcaggtactagtgcaccaactagtataacaccagactgttcaggagttcgagaccagcgtgggcaacatagctagactccatctttaccaaaaaattagccgggcattggggcatgcaactgtggttccagctacctgtggggctgaggtaggaggattgcttgagctcaggaggtcgaggctgcagtgagccgcagtcacaccactgcactctgtatagcctgggtgacagagtgagaccctgtctcaaaaaaaaaaacaacaaaacaggctgttaatctgctttggcttttcataaaagccttggcatggattggcattatcaaggtgctctttttgaaaaaaaccatttttctttcagtgcattaaaatgactgtctagttatggctgtagcattgaggaagtgtttactgtctctgagctcttaaatgcctgtcctaagatatttttaggttgaattaaacccttcatctttaaattgtttttttttagcagagaagttgtagtggtaatagctcccacttttactgacccatattcatggcttgaagaggaggacatcaagaagttcaagaaagcatgagaaaagggaagaactgaattaggaatgacattgccacctaccatcagttggtggtaaagtccttgggagtttttaagtacattgccagtgtctgaaatttacttggactttttattggatactagttgctgtaggactttatttggagaggaatagtcagctttttagtattaatttcttgattttcattttgccattgaaatgtaattcccaagtctggaagtcatgattgtaattagggaagaaggtcctgtcagttgtagaaatctagacagcattagtccttctttttttttttttttttttttttttttttttttttttttgagacggagtcttgttctgtcacccaggctggagttcagtggcgcagtctcagctcactgcaagctccgcctcccgggttcacgccattcttgttcattcttgtgaacccgggaacacgccgggttcacaggcacccgccaccacgcccggctaattttttgtatatttagtagagacggggattcatcgtgttagccaggatggtctcgatctcctgacctcgtgatccgcctgcctcagcttcccaaagtgctgggattacaggcgtgagccactgcaccgggccccagcattagtcatttttgacatttgataggtcaaattgttatgtgagtgtgtatacatgtgcatgtgcccccatatttaacgcatctgtatttataagtattgtagtgctaagctcattactcagtttcttatatagaggagtgtatttcagtgcaatgttgtatattaatggaggtcagtaacttcaactgtagcaggctggtggctgtcagaagcattacccagttgtgtctgatagggcacagccatcaggcttgtattgcccaagggagcactcagtgaggtgtcagtgtccctcttattgctgattctaggtaacttcccattgaaaaattgtaaggaagagatgtgaacgtgtaactttgtgctttgctctttgttttaaaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatact
